United States Patent 7,745,391 (HUMAN THROMBOSPONDIN POLYPEPTIDE) - sequence listing, part 190

SEQ ID NO: 455468 - DNA, 5161 bp, Homo sapiens
cgggattcggctggctctgccacaccaccgcgcgcccccgctccgcccgcccctccgggcgcgtcttttccgggctcgcgctgagtcccgcctccgccggctgtccgggtgcgcgcgcgccgctgcggctttttctctggcctccgccgcgcgctcctcctcgtcccagcgctagcgggcacgcggttcctttttgcgagctttccgagtgccaggcgccggccggctgcgaagacgcggtgggccgcccctccgattgaaatcacagaagatattcgtgttcttcttaagagaaaaagaggacatttaagaaaaacgctatggcaaagagaataaaagctaagcccacttcagacaaacctggaagtccatatcgctctgtcacacacttcgactcactagctgtaatagacatccctggagcagatactctggataaattatttgaccatgctgtatccaagtttgggaagaaggacagccttgggaccagggaaatcctaagtgaagaaaatgaaatgcagccaaatggaaaagtttttaagaagttaattcttgggaattataaatggatgaactatcttgaagtgaatcgcagagtgaataactttggtagtggactcactgcactgggactaaaaccaaagaacaccattgccatcttctgtgagaccagggccgaatggatgattgcagcacagacctgctttaagtacaactttcctcttgtgactttatatgccacacttggcaaagaagcagtagttcatgggctaaatgaatctgaggcttcctatctgattaccagtgttgaacttctggaaagtaaacttaagactgcattgttagatatcagttgtgttaaacatatcatttatgtggacaataaggctatcaataaagcagagtaccctgaaggatttgagattcacagcatgcaatcagtagaagagttgggatctaacccagaaaacttgggcattcctccaagtagaccaacgccttcagacatggccattgttatgtatactagtggttctactggccgacctaagggagtgatgatgcatcatagcaatttgatagctggaatgacaggccagtgtgaaagaatacctggactgggaccgaaggacacatatattggctacttgcctttggctcatgtgctagaactgacagcagagatatcttgctttacctatggctgcaggattggatattcttctccgcttacactctctgaccagtccagcaaaattaaaaaaggaagcaaaggagactgtactgtactgaagcccacacttatggctgctgttccggaaatcatggatagaatttataagaatgttatgagcaaagtccaagagatgaattatattcagaaaactctgttcaagatagggtatgattacaaattggaacagatcaaaaagggatatgatgcacctctttgcaatctgttactgtttaaaaaggtcaaggccctgctgggagggaatgtccgcatgatgctgtctggaggggccccgctatctcctcagacacaccgattcatgaatgtctgcttctgctgcccaattggccagggttatggactgacagaatcatgtggtgctgggacagttactgaagtaactgactatactactggcagagttggagcacctcttatttgctgtgaaattaagctaaaagactggcaagaaggcggttatacaattaatgacaagccaaaccccagaggtgaaatcgtaattggtggacagaacatctccatgggatattttaaaaatgaagagaaaacagcagaagattattctgtggatgaaaatggacaaaggtggttttgcactggtgatattggagaattccatcccgatggatgtttacagattatagatcgtaagaaagatctagtgaagttacaagcaggagagtatgtatctcttgggaaagtagaagctgcactgaagaattgtccacttattgacaacatctgtgcttttgccaaaagtgatcagtcctatgtgatcagttttgtggttcctaaccagaaaaggttgacacttttggcacaacagaaaggggtagaaggaacttgggttgatatctgcaataatcctgctatggaagctgaaatactgaaagaaattcgagaagctgcaaatgccatgaaattggagcgatttgaaattccaatcaaggttcgattaagcccagagccatggacccctgaaactggtttggtaactgatgctttcaaactgaaaaggaaggagctgaggaaccattacctcaaagacattgaacgaatgtatgggggcaaataaaatgttgttgtcttattgacagttgtgcaggaggtagcctggtggttttcaacctctagaattttaagcctttgttgaactgttagaatgtaaggtatatcattctaaagatagagtaaaaagaaaacaaaaccaaaagttattaaaattgttgtccggtttactttaacttagttttgcatagttctagtgcagctgaaattgaaaagttatttccctttagctgtgttattatagagcagaaattctgtttttaaaaattagcctaagatatacttgtttttgtaaagaaaaatatttaatgttgaacaaaataaattggagttggagtagaatgtagtttgaggaaatttgcagcttccaatgcctcttgtcttcctatttcagaagtttaaatattaagcatgacagaaaatatgtattaacactactcaaagcaaaagtgctgcagggctttaaaattctcttccaaccatttatcttgaaggaaaaattcaatagtaatataatacacaaaatcaaataataccttagaaggtattaagattataattgttgcataggttagatatagagtcattgtaatgttgtgaataattacagtgcctaaaataagaatagaacaacatatacaacaccaaaaaatatctagtaatatatttaaagggaaattgagctgctttttttgaaactttgagatctaaaaataactgtaattatttgaatgactaagaggaaagtacattttttgaaatgctgaaaattgcctttctgtgtttattcaaactgaaaagctgagaccaagagcaaggaaggtaaaaagttaacaggcaaacattttctcttagaaaaggtgataaaatcataagtatttggaattagaacccttgcacagcactgaacctgggaaagagatttaaactctgaatttatctttgataacagggattgattttaaaatgtacatgtattaaattacatttgtaatttaaggtctgtttgctgttgctgattttattcttgatcagtagtttgcatttcagaaagcctttcattttgctttaattttagcaaagcgggttataatgaatgacttccccaatatcttgcttgaacttacaggtgattaacttggatgagttttgggaagttaaagggaagaaaacactgttatcattttttcctgtttgggaagagcttagaaactggaaatactagatttgggagaagggcagagttacttgataagggactgatgtttgtgcagtaacttgggagtgtggtttctttttgaatctttaattaaaacctgggattatatatccctgataaatattcacacttgaaccatagttactgtaaaatgcaaaaaatcttaatactgttattctttgcactttttcttaatcattttttatatatatgcatatatatatgtgtgtgtgtgtgttgcttatgttgttttgtacagatgtgggccaccattgcaacaaaatacattctttttgctctaaaatatttatgaagaaaatacttaaatgttatgtatatggtggtaataagggaaaaatcaagtattataaacaagaatgaaggtttttgtaaagatttctgttcagcgttttgcaaggtaaaattttaggcaagttttccctgaagttatgtgtatgtgagtattctcattcttcccaacttgcctttgaagagtgaaataccattattatcaagtagactactgttcagcttttattcctgccctgctgtttatcccttaagaatgagtttcttagacttttccaatatgtgattttttttcccatttagaatggtgattttaaatgtgtgagtgcatgtactatcttatctcagatatttgcacccccaatctgcccccaactcccaaaagctagaacactgccaactgatctgttataggtcctttagaaacacataattaacacttaaggttgggtgctgctaattctttgcaaaaatccaaatattgttaagggaccagggagatgccactaccccttgattttccatctaaaaatatacatgtttatgtaaacaaatctttccatatccatagtgacttttcaagtatttaagcctaaagattttgatctcacatttttatacctgtttaaattgctcacagttattacatacacatcagccatcaactaaagttgtactttaaaaatttactacaatatgtacatttctaagtcaaacacttgtgacttttgctttaattccatgaatgttcctgcctccttgatatttgtatttattctttttttctctagagtagaggtataattgtgtgatatttcagaaatacagataaatgattcaaaaagtcacagttaaggagaatcatgtttctttgatcatgaataactgattagtaagtcttgcctatattttcctgatagcatatgacaaatgtttctaaggtaacaagatgagaacagataaagattgtgtggtgttttggatttggagagaaatattttaatttttaaatgcagttacaaattataatgtattcatatttgtactttctgttaaaatgcatgattgcagaattgtttagattttgtgtttattcttgatgaaaaggcttgtggtctgttttagttgcctccattctagaattatccccctgtttccaaaaaatagtgtataaaaataaaaagcaataaaatgacatcaataaaaaggggggcggatattcggaggacaccatttaaagaaaagaataagggggacaaagaagtagtctaacgcttgtgtcaacgattttttgtgtttatagaaga

SEQ ID NO: 455469 - DNA, 1361 bp, Homo sapiens
aatacatcccatcctcgaaagaatttaagtgaacaaactttaaaaagaaaaaaaaaatagatacagccttcatcttttacaaatatatttccttcccaatatcttcccaatataaacactgtggagtgtttatatattcagtgcaagaaacagtatcatcggtacattctttttgctctaaaatatttatgaagaaaatacttaaatgttatgtatatggtggtaataagggaaaaatcaagtattataaacaagaatgaaggtttttgtaaagatttctgttcagcgttttgcaaggtaaaattttaggcaagttttccctgaagttatgtgtatgtgagtattctcattcttcccaacttgcctttgaagagtgaaataccattattatcaagtagactactgttcagcttttattcctgccctgctgtttatcccttaagaatgagtttcttagacttttccaatatgtgattttttttcccatttagaatggtgattttaaatgtgtgagtgcatgtactatcttatctcagatatttgcacccccaatctgcccccaactcccaaaagctagaacactgccaactgatctgttataggtcctttagaaacacataattaacacttaaggttgggtgctgctaattctttgcaaaaatccaaatattgttaagggaccagggagatgccactaccccttgattttccatctaaaaatatacatgtttatgtaaacaaatctttccatatccatagtgacttttcaagtatttaagcctaaagattttgatctcacatttttatacctgtttaaattgctcacagttattacatacacatcagccatcaactaaagttgtactttaaaaatttactacaatatgtacatttctaagtcaaacacttgtgacttttgctttaattccatgaatgttcctgcctccttgatatttgtatttattctttttttctctagagtagaggtataattgtgtgatatttcagaaatacagataaatgattcaaaaagtcacagttaaggagaatcatgtttctttgatcatgaataactgattagtaagtcttgcctatattttcctgatagcatatgacaaatgtttctaaggtaacaagatgagaacagataaagattgtgtggtgttttggatttggagagaaatattttaatttttaaatgcagttacaaattataatgtattcatatttgtactttctgttaaaatgcatgattgcagaattgtttagattttgtgtttattcttgatgaaaagctttgtttgttcttgtttttaagtttgcactcaaatcttaagaaataaatccacccatgttatcaa

SEQ ID NO: 455470 - DNA, 399 bp, Homo sapiens
taggtaaatcctgaaaaactcatattttattaattgcttctccttccccttctttccccgtccccactcctttctcgtctctttccccccctctccttttctcccatctttcacttctaatttcagtgaaattggagcgatttgaaattccaatcaaggttcgattaagcccagagccatggacccctgaaactggtttggtaactgatgctttcaaactgaaaaggaaggagctgaggaaccattacctcaaagacattgaacgaatgtatgggggcaaataaaatgttgttgtcttattgacagttgtgcaggaggtagcctggtggttttcaacctctagaattttaagcctttgttgaactgttagaatgtaaggtatatcattctaaagataga

SEQ ID NO: 455471 - DNA, 5336 bp, Homo sapiens
cgggattcggctggctctgccacaccaccgcgcgcccccgctccgcccgcccctccgggcgcgtcttttccgggctcgcgctgagtcccgcctccgccggctgtccgggtgcgcgcgcgccgctgcggctttttctctggcctccgccgcgcgctcctcctcgtcccagcgctagcgggcacgcggttcctttttgcgagctttccgagtgccaggcgccggccggctgcgaagacgcggtgggccgcccctccgattgaaatcacagaagatattcgtgttcttcttaagagaaaaagaggacattttagctttctcagttgaaggcgtactttattgtcggcttccaaagattactaacttttatctgtatcactaagattgaactgccttggctgtactgctattcttactgctgcttctattattgccttcttcagcacaataaggctttcaaaagccaaagaataacaagaaataagcaccattttagaagcctttccactatgaaacttaagctaaatgtgctcaccattattttgctgcctgtccacttgttaataacaatatacagtgcccttatatttattccatggtattttcttaccaatgccaagaagaaaaacgctatggcaaagagaataaaagctaagcccacttcagacaaacctggaagtccatatcgctctgtcacacacttcgactcactagctgtaatagacatccctggagcagatactctggataaattatttgaccatgctgtatccaagtttgggaagaaggacagccttgggaccagggaaatcctaagtgaagaaaatgaaatgcagccaaatggaaaagtttttaagaagttaattcttgggaattataaatggatgaactatcttgaagtgaatcgcagagtgaataactttggtagtggactcactgcactgggactaaaaccaaagaacaccattgccatcttctgtgagaccagggccgaatggatgattgcagcacagacctgctttaagtacaactttcctcttgtgactttatatgccacacttggcaaagaagcagtagttcatgggctaaatgaatctgaggcttcctatctgattaccagtgttgaacttctggaaagtaaacttaagactgcattgttagatatcagttgtgttaaacatatcatttatgtggacaataaggctatcaataaagcagagtaccctgaaggatttgagattcacagcatgcaatcagtagaagagttgggatctaacccagaaaacttgggcattcctccaagtagaccaacgccttcagacatggccattgttatgtatactagtggttctactggccgacctaagggagtgatgatgcatcatagcaatttgatagctggaatgacaggccagtgtgaaagaatacctggactgggaccgaaggacacatatattggctacttgcctttggctcatgtgctagaactgacagcagagatatcttgctttacctatggctgcaggattggatattcttctccgcttacactctctgaccagtccagcaaaattaaaaaaggaagcaaaggagactgtactgtactgaagcccacacttatggctgctgttccggaaatcatggatagaatttataagaatgttatgagcaaagtccaagagatgaattatattcagaaaactctgttcaagatagggtatgattacaaattggaacagatcaaaaagggatatgatgcacctctttgcaatctgttactgtttaaaaaggtcaaggccctgctgggagggaatgtccgcatgatgctgtctggaggggccccgctatctcctcagacacaccgattcatgaatgtctgcttctgctgcccaattggccagggttatggactgacagaatcatgtggtgctgggacagttactgaagtaactgactatactactggcagagttggagcacctcttatttgctgtgaaattaagctaaaagactggcaagaaggcggttatacaattaatgacaagccaaaccccagaggtgaaatcgtaattggtggacagaacatctccatgggatattttaaaaatgaagagaaaacagcagaagattattctgtggatgaaaatggacaaaggtggttttgcactggtgatattggagaattccatcccgatggatgtttacagattatagatcgtaagaaagatctagtgaagttacaagcaggagagtatgtatctcttgggaaagtagaagctgcactgaagaattgtccacttattgacaacatctgtgcttttgccaaaagtgatcagtcctatgtgatcagttttgtggttcctaaccagaaaaggttgacacttttggcacaacagaaaggggtagaaggaacttgggttgatatctgcaataatcctgctatggaagctgaaatactgaaagaaattcgagaagctgcaaatgccatgaaattggagcgatttgaaattccaatcaaggttcgattaagcccagagccatggacccctgaaactggtttggtaactgatgctttcaaactgaaaaggaaggagctgaggaaccattacctcaaagacattgaacgaatgtatgggggcaaataaaatgttgttgtcttattgacagttgtgcaggaggtagcctggtggttttcaacctctagaattttaagcctttgttgaactgttagaatgtaaggtatatcattctaaagatagagtaaaaagaaaacaaaaccaaaagttattaaaattgttgtccggtttactttaacttagttttgcatagttctagtgcagctgaaattgaaaagttatttccctttagctgtgttattatagagcagaaattctgtttttaaaaattagcctaagatatacttgtttttgtaaagaaaaatatttaatgttgaacaaaataaattggagttggagtagaatgtagtttgaggaaatttgcagcttccaatgcctcttgtcttcctatttcagaagtttaaatattaagcatgacagaaaatatgtattaacactactcaaagcaaaagtgctgcagggctttaaaattctcttccaaccatttatcttgaaggaaaaattcaatagtaatataatacacaaaatcaaataataccttagaaggtattaagattataattgttgcataggttagatatagagtcattgtaatgttgtgaataattacagtgcctaaaataagaatagaacaacatatacaacaccaaaaaatatctagtaatatatttaaagggaaattgagctgctttttttgaaactttgagatctaaaaataactgtaattatttgaatgactaagaggaaagtacattttttgaaatgctgaaaattgcctttctgtgtttattcaaactgaaaagctgagaccaagagcaaggaaggtaaaaagttaacaggcaaacattttctcttagaaaaggtgataaaatcataagtatttggaattagaacccttgcacagcactgaacctgggaaagagatttaaactctgaatttatctttgataacagggattgattttaaaatgtacatgtattaaattacatttgtaatttaaggtctgtttgctgttgctgattttattcttgatcagtagtttgcatttcagaaagcctttcattttgctttaattttagcaaagcgggttataatgaatgacttccccaatatcttgcttgaacttacaggtgattaacttggatgagttttgggaagttaaagggaagaaaacactgttatcattttttcctgtttgggaagagcttagaaactggaaatactagatttgggagaagggcagagttacttgataagggactgatgtttgtgcagtaacttgggagtgtggtttctttttgaatctttaattaaaacctgggattatatatccctgataaatattcacacttgaaccatagttactgtaaaatgcaaaaaatcttaatactgttattctttgcactttttcttaatcattttttatatatatgcatatatatatgtgtgtgtgtgtgttgcttatgttgttttgtacagatgtgggccaccattgcaacaaaatacattctttttgctctaaaatatttatgaagaaaatacttaaatgttatgtatatggtggtaataagggaaaaatcaagtattataaacaagaatgaaggtttttgtaaagatttctgttcagcgttttgcaaggtaaaattttaggcaagttttccctgaagttatgtgtatgtgagtattctcattcttcccaacttgcctttgaagagtgaaataccattattatcaagtagactactgttcagcttttattcctgccctgctgtttatcccttaagaatgagtttcttagacttttccaatatgtgattttttttcccatttagaatggtgattttaaatgtgtgagtgcatgtactatcttatctcagatatttgcacccccaatctgcccccaactcccaaaagctagaacactgccaactgatctgttataggtcctttagaaacacataattaacacttaaggttgggtgctgctaattctttgcaaaaatccaaatattgttaagggaccagggagatgccactaccccttgattttccatctaaaaatatacatgtttatgtaaacaaatctttccatatccatagtgacttttcaagtatttaagcctaaagattttgatctcacatttttatacctgtttaaattgctcacagttattacatacacatcagccatcaactaaagttgtactttaaaaatttactacaatatgtacatttctaagtcaaacacttgtgacttttgctttaattccatgaatgttcctgcctccttgatatttgtatttattctttttttctctagagtagaggtataattgtgtgatatttcagaaatacagataaatgattcaaaaagtcacagttaaggagaatcatgtttctttgatcatgaataactgattagtaagtcttgcctatattttcctgatagcatatgacaaatgtttctaaggtaacaagatgagaacagataaagattgtgtggtgttttggatttggagagaaatattttaatttttaaatgcagttacaaattataatgtattcatatttgtactttctgttaaaatgcatgattgcagaattgtttagattttgtgtttattcttgatgaaaagctttgtttgttcttgtttttaagtttgcactcaaatcttaagaaataaatccacccatgttatcaa

SEQ ID NO: 455472 - DNA, 5320 bp, Homo sapiens
cgggattcggctggctctgccacaccaccgcgcgcccccgctccgcccgcccctccgggcgcgtcttttccgggctcgcgctgagtcccgcctccgccggctgtccgggtgcgcgcgcgccgctgcggctttttctctggcctccgccgcgcgctcctcctcgtcccagcgctagcgggcacgcggttcctttttgcgagctttccgagtgccaggcgccggccggctgcgaagacgcggtgggccgcccctccgattgaaatcacagaagatattcgtgttcttcttaagagaaaaagaggacatttaggcgtactttattgtcggcttccaaagattactaacttttatctgtatcactaagattgaactgccttggctgtactgctattcttactgctgcttctattattgccttcttcagcacaataaggctttcaaaagccaaagaataacaagaaataagcaccattttagaagcctttccactatgaaacttaagctaaatgtgctcaccattattttgctgcctgtccacttgttaataacaatatacagtgcccttatatttattccatggtattttcttaccaatgccaagaagaaaaacgctatggcaaagagaataaaagctaagcccacttcagacaaacctggaagtccatatcgctctgtcacacacttcgactcactagctgtaatagacatccctggagcagatactctggataaattatttgaccatgctgtatccaagtttgggaagaaggacagccttgggaccagggaaatcctaagtgaagaaaatgaaatgcagccaaatggaaaagtttttaagaagttaattcttgggaattataaatggatgaactatcttgaagtgaatcgcagagtgaataactttggtagtggactcactgcactgggactaaaaccaaagaacaccattgccatcttctgtgagaccagggccgaatggatgattgcagcacagacctgctttaagtacaactttcctcttgtgactttatatgccacacttggcaaagaagcagtagttcatgggctaaatgaatctgaggcttcctatctgattaccagtgttgaacttctggaaagtaaacttaagactgcattgttagatatcagttgtgttaaacatatcatttatgtggacaataaggctatcaataaagcagagtaccctgaaggatttgagattcacagcatgcaatcagtagaagagttgggatctaacccagaaaacttgggcattcctccaagtagaccaacgccttcagacatggccattgttatgtatactagtggttctactggccgacctaagggagtgatgatgcatcatagcaatttgatagctggaatgacaggccagtgtgaaagaatacctggactgggaccgaaggacacatatattggctacttgcctttggctcatgtgctagaactgacagcagagatatcttgctttacctatggctgcaggattggatattcttctccgcttacactctctgaccagtccagcaaaattaaaaaaggaagcaaaggagactgtactgtactgaagcccacacttatggctgctgttccggaaatcatggatagaatttataagaatgttatgagcaaagtccaagagatgaattatattcagaaaactctgttcaagatagggtatgattacaaattggaacagatcaaaaagggatatgatgcacctctttgcaatctgttactgtttaaaaaggtcaaggccctgctgggagggaatgtccgcatgatgctgtctggaggggccccgctatctcctcagacacaccgattcatgaatgtctgcttctgctgcccaattggccagggttatggactgacagaatcatgtggtgctgggacagttactgaagtaactgactatactactggcagagttggagcacctcttatttgctgtgaaattaagctaaaagactggcaagaaggcggttatacaattaatgacaagccaaaccccagaggtgaaatcgtaattggtggacagaacatctccatgggatattttaaaaatgaagagaaaacagcagaagattattctgtggatgaaaatggacaaaggtggttttgcactggtgatattggagaattccatcccgatggatgtttacagattatagatcgtaagaaagatctagtgaagttacaagcaggagagtatgtatctcttgggaaagtagaagctgcactgaagaattgtccacttattgacaacatctgtgcttttgccaaaagtgatcagtcctatgtgatcagttttgtggttcctaaccagaaaaggttgacacttttggcacaacagaaaggggtagaaggaacttgggttgatatctgcaataatcctgctatggaagctgaaatactgaaagaaattcgagaagctgcaaatgccatgaaattggagcgatttgaaattccaatcaaggttcgattaagcccagagccatggacccctgaaactggtttggtaactgatgctttcaaactgaaaaggaaggagctgaggaaccattacctcaaagacattgaacgaatgtatgggggcaaataaaatgttgttgtcttattgacagttgtgcaggaggtagcctggtggttttcaacctctagaattttaagcctttgttgaactgttagaatgtaaggtatatcattctaaagatagagtaaaaagaaaacaaaaccaaaagttattaaaattgttgtccggtttactttaacttagttttgcatagttctagtgcagctgaaattgaaaagttatttccctttagctgtgttattatagagcagaaattctgtttttaaaaattagcctaagatatacttgtttttgtaaagaaaaatatttaatgttgaacaaaataaattggagttggagtagaatgtagtttgaggaaatttgcagcttccaatgcctcttgtcttcctatttcagaagtttaaatattaagcatgacagaaaatatgtattaacactactcaaagcaaaagtgctgcagggctttaaaattctcttccaaccatttatcttgaaggaaaaattcaatagtaatataatacacaaaatcaaataataccttagaaggtattaagattataattgttgcataggttagatatagagtcattgtaatgttgtgaataattacagtgcctaaaataagaatagaacaacatatacaacaccaaaaaatatctagtaatatatttaaagggaaattgagctgctttttttgaaactttgagatctaaaaataactgtaattatttgaatgactaagaggaaagtacattttttgaaatgctgaaaattgcctttctgtgtttattcaaactgaaaagctgagaccaagagcaaggaaggtaaaaagttaacaggcaaacattttctcttagaaaaggtgataaaatcataagtatttggaattagaacccttgcacagcactgaacctgggaaagagatttaaactctgaatttatctttgataacagggattgattttaaaatgtacatgtattaaattacatttgtaatttaaggtctgtttgctgttgctgattttattcttgatcagtagtttgcatttcagaaagcctttcattttgctttaattttagcaaagcgggttataatgaatgacttccccaatatcttgcttgaacttacaggtgattaacttggatgagttttgggaagttaaagggaagaaaacactgttatcattttttcctgtttgggaagagcttagaaactggaaatactagatttgggagaagggcagagttacttgataagggactgatgtttgtgcagtaacttgggagtgtggtttctttttgaatctttaattaaaacctgggattatatatccctgataaatattcacacttgaaccatagttactgtaaaatgcaaaaaatcttaatactgttattctttgcactttttcttaatcattttttatatatatgcatatatatatgtgtgtgtgtgtgttgcttatgttgttttgtacagatgtgggccaccattgcaacaaaatacattctttttgctctaaaatatttatgaagaaaatacttaaatgttatgtatatggtggtaataagggaaaaatcaagtattataaacaagaatgaaggtttttgtaaagatttctgttcagcgttttgcaaggtaaaattttaggcaagttttccctgaagttatgtgtatgtgagtattctcattcttcccaacttgcctttgaagagtgaaataccattattatcaagtagactactgttcagcttttattcctgccctgctgtttatcccttaagaatgagtttcttagacttttccaatatgtgattttttttcccatttagaatggtgattttaaatgtgtgagtgcatgtactatcttatctcagatatttgcacccccaatctgcccccaactcccaaaagctagaacactgccaactgatctgttataggtcctttagaaacacataattaacacttaaggttgggtgctgctaattctttgcaaaaatccaaatattgttaagggaccagggagatgccactaccccttgattttccatctaaaaatatacatgtttatgtaaacaaatctttccatatccatagtgacttttcaagtatttaagcctaaagattttgatctcacatttttatacctgtttaaattgctcacagttattacatacacatcagccatcaactaaagttgtactttaaaaatttactacaatatgtacatttctaagtcaaacacttgtgacttttgctttaattccatgaatgttcctgcctccttgatatttgtatttattctttttttctctagagtagaggtataattgtgtgatatttcagaaatacagataaatgattcaaaaagtcacagttaaggagaatcatgtttctttgatcatgaataactgattagtaagtcttgcctatattttcctgatagcatatgacaaatgtttctaaggtaacaagatgagaacagataaagattgtgtggtgttttggatttggagagaaatattttaatttttaaatgcagttacaaattataatgtattcatatttgtactttctgttaaaatgcatgattgcagaattgtttagattttgtgtttattcttgatgaaaagctttgtttgttcttgtttttaagtttgcactcaaatcttaagaaataaatccacccatgttatcaa

SEQ ID NO: 455473 - DNA, 2292 bp, Homo sapiens
ggaattcccgcccggcccggccccgcgccccgcgcagccccgggcgccgcgcgtcctgcccggcctgcggcccagcccttgcgccgctcgtccgacccgcgatcgtccaccagaccgtgcctcccggccgcccggccgccccgcgtgcatgcttcggtctgggccagcctctgggccgtccgtccccactggccgggccatgccgagtcgccgcgtcgccagaccgccggctgcgccggagctgggggccttagggtcccccgacctctcctcactctcgctcgccgtttccaggagcacagatgaattggagatcatcgacgagtacatcaaggagaacggcttcggcctggacgggggacagccgggcccgggcgaggggctgccacgcctggtgtctcgcggggctgcgtccctgagcacggtcaccctgggccctgtggcgcccccagccacgccgccgccttggggctgccccctgggccgactagtgtccccagcgccgggcccgggcccgcagccgcacctggtcatcacggagcagcccaagcagcgcggcatgcgcttccgctacgagtgcgagggccgctcggccggcagcatccttggggagagcagcaccgaggccagcaagacgctgcccgccatcgagctccgggattgtggagggctgcgggaggtggaggtgactgcctgcctggtgtggaaggactggcctcaccgagtccacccccacagcctcgtggggaaagactgcaccgacggcatctgcagggtgcggctccggcctcacgtcagcccccggcacagttttaacaacctgggcatccagtgtgtgaggaagaaggagattgaggctgccattgagcggaagattcaactgggcattgacccctacaacgctgggtccctgaagaaccatcaggaagtagacatgaatgtggtgaggatctgcttccaggcctcatatcgggaccagcagggacagatgcgccggatggatcctgtgctttccgagcccgtctatgacaagaaatccacaaacacatcagagctgcggatttgccgaattaacaaggaaagcgggccgtgcaccggtggcgaggagctctacttgctctgcgacaaggtgcagaaagaggacatatcagtggtgttcagcagggcctcctgggaaggtcgggctgacttctcccaggccgacgtgcaccgccagattgccattgtgttcaagacgccgccctacgaggacctggagattgtcgagcccgtgacagtcaacgtcttcctgcagcggctcaccgatggggtctgcagcgagccattgcctttcacgtacctgcctcgcgaccatgacagctacggcgtggacaagaagcggaaacgggggatgcccgacgtccttggggagctgaacagctctgacccccatggcatcgagagcaaacggcggaagaaaaagccggccatcctggaccacttcctgcccaaccacggctcaggcccgttcctcccgccgtcagccctgctgccagaccctgacttcttctctggcaccgtgtccctgcccggcctggagccccctggcgggcctgacctcctggacgatggctttgcctacgaccctacggcccccacactcttcaccatgctggacctgctgcccccggcaccgccacacgctagcgctgttgtgtgcagcggaggtgccggggccgtggttggggagacccccggccctgaaccactgacactggactcgtaccaggccccgggccccggggatggaggcaccgccagccttgtgggcagcaacatgttccccaatcattaccgcgaggcggcctttgggggcggcctcctatccccggggcctgaagccacgtagccccgcgatgccagaggaggggcactgggtggggagggaggtggaggagccgtgcaatcccaaccaggatgtctagcacccccatccccttggcccttcctcatgcttctgaagtggacatattcagccttggcgagaagctccgttgcacgggtttccccttgagcccattttacagatgaggaaactgagtccggagaggaaaagggacatggctcccgtgcactagcttgttacagctgcctctgtccccacatgtgggggcaccttctccagtaggattcggaaaagattgtacatatgggaggagggggcagattcctggccctccctccccagacttgaaggtggggggtaggttggttgttcagagtcttcccaataaagatgagtttttgagcctc

SEQ ID NO: 455474 - DNA, 2466 bp, Homo sapiens
ggaattcccgcccggcccggccccgcgccccgcgcagccccgggcgccgcgcgtcctgcccggcctgcggcccagcccttgcgccgctcgtccgacccgcgatcgtccaccagaccgtgcctcccggccgcccggccgccccgcgtgcatgcttcggtctgggccagcctctgggccgtccgtccccactggccgggccatgccgagtcgccgcgtcgccagaccgccggctgcgccggagctgggggccttagggtcccccgacctctcctcactctcgctcgccgtttccaggagcacagatgaattggagatcatcgacgagtacatcaaggagaacggcttcggcctggacgggggacagccgggcccgggcgaggggctgccacgcctggtgtctcgcggggctgcgtccctgagcacggtcaccctgggccctgtggcgcccccagccacgccgccgccttggggctgccccctgggccgactagtgtccccagcgccgggcccgggcccgcagccgcacctggtcatcacggagcagcccaagcagcgcggcatgcgcttccgctacgagtgcgagggccgctcggccggcagcatccttggggagagcagcaccgaggccagcaagacgctgcccgccatcgagctccgggattgtggagggctgcgggaggtggaggtgactgcctgcctggtgtggaaggactggcctcaccgagtccacccccacagcctcgtggggaaagactgcaccgacggcatctgcagggtgcggctccggcctcacgtcagcccccggcacagttttaacaacctgggcatccagtgtgtgaggaagaaggagattgaggctgccattgagcggaagattcaactgggcattgacccctacaacgctgggtccctgaagaaccatcaggaagtagacatgaatgtggtgaggatctgcttccaggcctcatatcgggaccagcagggacagatgcgccggatggatcctgtgctttccgagcccgtctatgacaagaaatccacaaacacatcagagctgcggatttgccgaattaacaaggaaagcgggccgtgcaccggtggcgaggagctctacttgctctgcgacaaggtgcagaaagaggacatatcagtggtgttcagcagggcctcctgggaaggtcgggctgacttctcccaggccgacgtgcaccgccagattgccattgtgttcaagacgccgccctacgaggacctggagattgtcgagcccgtgacagtcaacgtcttcctgcagcggctcaccgatggggtctgcagcgagccattgcctttcacgtacctgcctcgcgaccatgacagctacggcgtggacaagaagcggaaacgggggatgcccgacgtccttggggagctgaacagctctgacccccatggcatcgagagcaaacggcggaagaaaaagccggccatcctggaccacttcctgcccaaccacggctcaggcccgttcctcccgccgtcagccctgctgccagaccctgacttcttctctggcaccgtgtccctgcccggcctggagccccctggcgggcctgacctcctggacgatggctttgcctacgaccctacggcccccacactcttcaccatgctggacctgctgcccccggcaccgccacacgctagcgctgttgtgtgcagcggaggtgccggggccgtggttggggagacccccggccctgaaccactgacactggactcgtaccaggccccgggccccggggatggaggcaccgccagccttgtgggcagcaacatgttccccaatcattaccgcgaggcggcctttgggggcggcctcctatccccggggcctgaagccacgtagccccgcgatgccagaggaggggcactgggtggggagggaggtggaggagccgtgcaatcccaaccaggatgtctagcacccccatccccttggcccttcctcatgcttctgaagtggacatattcagccttggcgagaagctccgttgcacgggtttccccttgagcccattttacagatgaggaaactgagtccggagaggaaaagggacatggctcccgtgcactagcttgttacagctgcctctgtccccacatgtgggggcaccttctccagtaggattcggaaaagattgtacatatgggaggagggggcagattcctggccctccctccccagacttgaaggtggggggtaggttggttgttcagagtcttcccaataaagatgagtttttgagcctccggggtttcgtctgttctgggcttgggaaacgccctagtcccttagtagcaaagaaagcctccaggctgggggctcaggcctgtcatcccagcactttgggagccaccccacagagagagcgcaccccacagagagagcgtcccccacagagagaacgtcgggccagctcatca

SEQ ID NO: 455475 - DNA, 998 bp, Homo sapiens
ggaattcccgcccggcccggccccgcgccccgcgcagccccgggcgccgcgcgtcctgcccggcctgcggcccagcccttgcgccgctcgtccgacccgcgatcgtccaccagaccgtgcctcccggccgcccggccgccccgcgtgcatgcttcggtctgggccagcctctgggccgtccgtccccactggccgggccatgccgagtcgccgcgtcgccagaccgccggctgcgccggagctgggggccttagggtcccccgacctctcctcactctcgctcgccgtttccaggagcacagatgaattggagatcatcgacgagtacatcaaggagaacggcttcggcctggacgggggacagccgggcccgggcgaggggctgccacgcctggtgtctcgcggggctgcgtccctgagcacggtcaccctgggccctgtggcgcccccagccacgccgccgccttggggctgccccctgggccgactagtgtccccagcgccgggcccgggcccgcagccgcacctggtcatcacggagcagcccaagcagcgcggcatgcgcttccgctacgagtgcgagggccgctcggccggcagcatccttggggagagcagcaccgaggccagcaagacgctgcccgccatcgagctccgggattgtggagggctgcgggaggtggaggtgactgcctgcctggtgtggaaggactggcctcaccgagtccacccccacagcctcgtggggaaagactgcaccgacggcatctgcagggtgcggctccggcctcacgtcagcccccggcacagttaacaactgggcatcagtgttgaagaacaaggggatcggggtgcattgagcggagatcaaggggcatgacccacaggtgggccggagacatcagagtagacatacgggtcagatcgccaggcaaacggacgagggcaacccgaggacgggccgcgcgagaaagccaggtcacggcgaggaaaagaag

SEQ ID NO: 455476 - DNA, 1402 bp, Homo sapiens
aaaattttaaaaagggggaatattagtcttgattttaggggaggctgggcaagttgggagcacagtggtccagatgtcctggcttagctgatgtcccccgtttcctgccagaggacatatcagtggtgttcagcagggcctcctgggaaggtcgggctgacttctcccaggccgacgtgcaccgccagattgccattgtgttcaagacgccgccctacgaggacctggagattgtcgagcccgtgacagtcaacgtcttcctgcagcggctcaccgatggggtctgcagcgagccattgcctttcacgtacctgcctcgcgaccatgacagctacggcgtggacaagaagcggaaacgggggatgcccgacgtccttggggagctgaacagctctggtgtgtgccctctgcccctttccacccccatccccaggttctggggaggggacagctgaccccactgccctgtcccaccccaggctggggaggaagggctgtcggggaacaggggtcctcatctctgccttccctcagacccccatggcatcgagagcaaacggcggaagaaaaagccggccatcctggaccacttcctgcccaaccacggctcaggcccgttcctcccgccgtcagccctgctgccagaccctgacttcttctctggcaccgtgtccctgcccggcctggagccccctggcgggcctgacctcctggacgatggctttgcctacgaccctacggcccccacactcttcaccatgctggacctgctgcccccggcaccgccacacgctagcgctgttgtgtgcagcggaggtgccggggccgtggttggggagacccccggccctgaaccactgacactggactcgtaccaggccccgggccccggggatggaggcaccgccagccttgtgggcagcaacatgttccccaatcattaccgcgaggcggcctttgggggcggcctcctatccccggggcctgaagccacgtagccccgcgatgccagaggaggggcactgggtggggagggaggtggaggagccgtgcaatcccaaccaggatgtctagcacccccatccccttggcccttcctcatgcttctgaagtggacatattcagccttggcgagaagctccgttgcacgggtttccccttgagcccattttacagatgaggaaactgagtccggagaggaaaagggacatggctcccgtgcactagcttgttacagctgcctctgtccccacatgtgggggcaccttctccagtaggattcggaaaagattgtacatatgggaggagggggcagattcctggccctccctccccagacttgaaggtggggggtaggttggttgttcagagtcttcccaataaagatgagtttttgagcctc

SEQ ID NO: 455477 - DNA, 278 bp, Homo sapiens
atttttctcatgtataaaactaggaatcctctatcacaggagcctggttggaggattcctagttttatacatgagaaatagaatgcagatttctctgaagagtgtttaaagaaggaatggtagttgagggggcttatttcccaggctcctgtgatagagttcttttaagcccaagattttttatttgagggttttttgttttttaaaaaaaaattgaacaaagactactaatgactttgtttgaattatccacatgaaaataaagagccatagtttca

SEQ ID NO: 455478 - DNA, 1791 bp, Homo sapiens
  misc_feature (1491)..(1491): n is a, c, g, or t
acccacgtgggggctcagcgtgcacccttctttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttcaaaaaaaaaaaanaaaaaaaaaaaaaaaaaaaaaaaaaaaaaaaaaaaaaaaaaaaaagagaaagagagaagagagaaaaaaagaaaaaaaaaaagagagaaaaagaacaaaagcaacaaaaaagagtaacgacactcaaagaagctacacacaactgcataacagcaacggcaaatgcctactgtaccaacccaccgcgaaccgcgataacccttacacccaaaaccccaacccgcgccggaccaccggcccccaccctactgccacaccccgcccccccccccgcccccacccatcccaccacaggagcga

SEQ ID NO: 455479 - DNA, 1541 bp, Homo sapiens
acccacgtgggggctcagcgtgcacccttctttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttcaaaaaaaaaaaacactggcccgcggttaccaccgggggactgggccctggcgtacccctttcc

SEQ ID NO: 455480 - DNA, 1423 bp, Homo sapiens
acccacgtgggggctcagcgtgcacccttctttgtgctcgggttaggaggagctaggctgccatcgggccggtgcagatacggggttgctcttttgctcataagaggggcttcgctggcagtctgaacggcaagcttgagcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttca

SEQ ID NO: 455481 - DNA, 1454 bp, Homo sapiens
gagctcgaagtttgtaactcactaggtctaggttttcaccgtgtcagatcgtatacggggttgctcttttgctcataagaggggcttcgctggcagtctgaacggcaagcttgagtcaggacccttaattaagatcctcaattggctggagggcagatctcgcgagtagggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttca

SEQ ID NO: 455482 - DNA, 1418 bp, Homo sapiens
acccacgtgggggctcagcgtgcacccttctttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttca

SEQ ID NO: 455483 - DNA, 1295 bp, Homo sapiens
  misc_feature (1178)..(1179): n is a, c, g, or t
  misc_feature (1182)..(1182): n is a, c, g, or t
  misc_feature (1184)..(1184): n is a, c, g, or t
  misc_feature (1186)..(1186): n is a, c, g, or t
  misc_feature (1193)..(1193): n is a, c, g, or t
  misc_feature (1195)..(1195): n is a, c, g, or t
  misc_feature (1206)..(1206): n is a, c, g, or t
  misc_feature (1219)..(1219): n is a, c, g, or t
  misc_feature (1222)..(1222): n is a, c, g, or t
  misc_feature (1227)..(1227): n is a, c, g, or t
  misc_feature (1238)..(1238): n is a, c, g, or t
acccacgtgggggctcagcgtgcacccttctttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggcaagnnagncnanactaacnanggaacaccaanattgacgggaaanccnaaaanttttaactcanaaaggttttcgttaaaggaccacagggcgtggagtaccgcatgggggtaaaggaccg

SEQ ID NO: 455484 - DNA, 1662 bp, Homo sapiens
acccacgtgggggctcagcgtgcacccttctttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggtacaaggcactatgaaatgatctagtttcgtgggtgaggggctgaagggcctatgatgcacggaggcggggaaaggatttagagataacgtggtttgaaaggcgggacctggtgcggggacgctcttgggaggagtcttctccccagccttagctggtttcatgatttctttgcgtctgtaggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttca

SEQ ID NO: 455485 - DNA, 1321 bp, Homo sapiens
acccacgtgggggctcagcgtgcacccttctttgtgcgcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttca

SEQ ID NO: 455486 - DNA, 1488 bp, Homo sapiens
gagctcgaagtttgtaactcactaggtctaggttttcaccgtgtcagatcgtatacggggttgctcttttgctcataagaggggcttcgctggcagtctgaacggcaagcttgagtcaggacccttaattaagatcctcaattggctggagggcagatctcgcgagtagggtacaaggcactatgaaatgatctagtttcgtgggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttca

SEQ ID NO: 455487 - DNA, 1872 bp, Homo sapiens
acccacgtgggggctcagcgtgcacccttctttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggtacaaggcactatgaaatgatctagtttcgtgggtgaggggctgaagggcctatgatgcacggaggcggggaaaggatttagagataacgtggtttgaaaggcgggacctggtgcggggacgctcttgggaggagtcttctccccagccttagctggtttcatgatttctttgcgtctgtaggcaacgcggtaaaaatattgcttcggtgggtgacgcggtacagctgcccaagggcgttcgtaacgggaatgccgaagcgtgggaaaaagggagcggtggcggaagacggggatgagctcaggacaggtaagggaatgaaatcagcccttcttcctagaagctgcggcgggggtgtttgtcattcccttgatgtacggtaagtacgggccgactcatttttgcaggggtttgtgaagaagtcgcaggaaccgtaggctttcgttgggtctatagttaacgccggatcgcagttggaaaccaccagctttttgtcagtatatattactcattttatagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttca

SEQ ID NO: 455488 - DNA, 1425 bp, Homo sapiens
acccacgtgggggctcagcgtgcacccttctttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcaggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttca

SEQ ID NO: 455489 - DNA, 1803 bp, Homo sapiens
gagctcgaagtttgtaactcactaggtctaggttttcaccgtgtcagatcgtatacggggttgctcttttgctcataagaggggcttcgctggcagtctgaacggcaagcttgagtcaggacccttaattaagatcctcaattggctggagggcagatctcgcgagtagggtacaaggcactatgaaatgatctagtttcgtgggtgaggggctgaagggcctatgatgcacggaggcggggaaaggatttagagataacgtggtttgaaaggcgggacctggtgcggggacgctcttgggaggagtcttctccccagccttagctggtttcatgatttctttgcgtctgtaggcaacgcggtaaaaatattgcttcggtgggtgacgcggtacagctgcccaagggcgttcgtaacgggaatgccgaagcgtgggtaagggaatgaaatcagcccttcttcctagaagctgcggcgggggtgtttgtcattcccttgatgtacggtaagtacgggccgactcatttttgcaggggtttgtgaagaagtcgcaggaaccgtaggctttcgttgggtctatagttaacgccggatcgcagttggaaaccaccagctttttgtcagtatatattactcattttatagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttca

SEQ ID NO: 455490 - DNA, 1389 bp, Homo sapiens
acccacgtgggggctcagcgtgcacccttctttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtaggctgcggcgggggtgtttgtcattcccttgatgtacgagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttca

SEQ ID NO: 455491 - DNA, 1369 bp, Homo sapiens
acccacgtgggggctcagcgtgcacccttctttgtgctcgggttaggaggagctaggctgccatcgggccggtgcagatacggggttgctcttttgctcataagaggggcttcgctggcagtctgaacggcaagcttgagcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcaggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttca

SEQ ID NO: 455492 - DNA, 1583 bp, Homo sapiens
gagctcgaagtttgtaactcactaggtctaggttttcaccgtgtcagatcgtatacggggttgctcttttgctcataagaggggcttcgctggcagtctgaacggcaagcttgagtcaggacccttaattaagatcctcaattggctggagggcagatctcgcgagtagggtacaaggcactatgaaatgatctagtttcgtgggtgaggggctgaagggcctatgatgcacggaggcggggaaaggatttagagataacgtggtttgaaaggcgggacctggtgcggggacgctcttgggaggagtcttctccccagccttagctggtttcatgatttctttgcgtctgtaggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcaggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttca

SEQ ID NO: 455493 - DNA, 1014 bp, Homo sapiens
  misc_feature (826)..(826): n is a, c, g, or t
  misc_feature (832)..(832): n is a, c, g, or t
  misc_feature (1012)..(1013): n is a, c, g, or t
acccacgtgggggctcagcgtgcacccttctttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctngctggngaagctgtggaagtccgagggctggttccaaagcctggctggtggactatgggctggaatgtctccccgggacagagtggttcgccagcgcgtcggattcggggccgggctggctcccccgtgctgggtagtgcgggggttgcctcgcgggccggtgcttccctttcgctccctttccgnnc

SEQ ID NO: 455494 - DNA, 444 bp, Homo sapiens
acccacgtgggggctcagcgtgcacccttctttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggcaacgcggtaaaaatattgcttcggtgggtgacgcggtacagctgcccaagggcgttcgtaacgggaatgccgaagcgtgggaaaaagggagcggtggcggaagacggggatgagctcaggacagagcccgaggccaagaagagtacgacgccccacgatgacatacaggcaccggcagaggccccagccctgatgagtgaccctccacatagattacctaccagcgctctgcccactcacgtctgtc

SEQ ID NO: 455495 - DNA, 1479 bp, Homo sapiens
acccacgtgggggctcagcgtgcacccttctttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttca

SEQ ID NO: 455496 - DNA, 1553 bp, Homo sapiens
acccacgtgggggctcagcgtgcacccttctttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttcaaaaaaaaaaacaagagcaaaaacaaacacaaattttgaggggaggctgggacctaagagaaggtttcaagacag

SEQ ID NO: 455497 - DNA, 1418 bp, Homo sapiens
acccacgtgggggctcagcgtgcacccttctttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacagccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttca

SEQ ID NO: 455498 - DNA, 1499 bp, Homo sapiens
acccacgtgggggctcagcgtgcacccttctttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtatattttttatttgagggttttttgttttttaaaaaaaaattgaacaaagactactaatgactttgtttgaattatccacatgaaaataaagagccatagtttcaaaaaaaaaaacaagagcaaaaacaaacacaaattttgaggggaggctgggacctaagagaaggtttcaagacag

SEQ ID NO: 455499 - DNA, 1407 bp, Homo sapiens
acccacgtgggggctcagcgtgcacccttctttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcatagatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttca

SEQ ID NO: 455500 - DNA, 1425 bp, Homo sapiens
acgtcgctgagaatatacgcgtagggctcatctcttacacgcaggtctcggttataaccgctggcagtctgaacggcaagcttgagtcaggacccttaattaagatcctcaattggctggagggcagatctcgcgagtagggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttca

SEQ ID NO: 455501 - DNA, 1050 bp, Homo sapiens
acccacgtgggggctcagcgtgcacccttctttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccaagagggcaggttgggattttgcggctgtgccgtgtgcagttggcccttccaaacctgctccttggtttttttgccccccagtgtg

SEQ ID NO: 455502 - DNA, 1689 bp, Homo sapiens
acccacgtgggggctcagcgtgcacccttctttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggcaacgcggtaaaaatattgcttcggtgggtgacgcggtacagctgcccaagggcgttcgtaacgggaatgccgaagcgtgggaaaaagggagcggtggcggaagacggggatgagctcaggacaggtaagggaatgaaatcagcccttcttcctagaagctgcggcgggggtgtttgtcattcccttgatgtacggtaagtacgggccgactcatttttgcaggggtttgtgaagaagtcgcaggaaccgtaggctttcgttgggtctatagttaacgccggatcgcagttggaaaccaccagctttttgtcagtatatattactcattttatagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttca

SEQ ID NO: 455503 - DNA, 1535 bp, Homo sapiens
acccacgtgggggctcagcgtgcacccttctttgtgctcgggttaggaggagctaggctgccatcgggccggtgcagatacggggttgctcttttgctcataagaggggcttcgctggcagtctgaacggcaagcttgagcaacgcggtaaaaatattgcttcggtgggtgacgcggtacagctgcccaagggcgttcgtaacgggaatgccgaagcgtgggaaaaagggagcggtggcggaagacggggatgagctcaggacaggggtttgtgaagaagtcgcaggaaccgtaggctttcgttgggtctatagttaacgccggatcgcagttggaaaccaccagctttttgtcagtatatattactcattttatagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttca

SEQ ID NO: 455504 - DNA, 1243 bp, Homo sapiens
  misc_feature (40)..(40): n is a, c, g, or t
  misc_feature (68)..(70): n is a, c, g, or t
cgcaacccacccagacccaccccttaaaaaccttagaagnccgagagcgcgccccccatgacgccgtnnnaaggccggcgagcagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttca

SEQ ID NO: 455505 - DNA, 1290 bp, Homo sapiens
  misc_feature (28)..(28): n is a, c, g, or t
  misc_feature (34)..(34): n is a, c, g, or t
acagacaaacaggcagaatcacctaagncgaaancaaaatcccacttcattttaacgaatgtagttaaattgaataggctcattatcaagagctgaacacggctctctgttctttccggtattctaaaagatgcataaacacaaaaaccatccagttctagatttgaaaattgaagggaatcgcttttaatctattctggctcaggtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttca

SEQ ID NO: 455506 - DNA, 949 bp, Homo sapiens
  misc_feature (874)..(874): n is a, c, g, or t
acccacgtgggggctcagcgtgcacccttctttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcctgtgtggngggcccagtggctgaattgcttcggcccgggacaatgttcccccggccgtcggaagcggcccggagtgccccctg

SEQ ID NO: 455507 - DNA, 259 bp, Homo sapiens
tatgctaattctgtttcatttctataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaa

SEQ ID NO: 455508 - DNA, 677 bp, Homo sapiens
  misc_feature (550)..(551): n is a, c, g, or t
  misc_feature (556)..(556): n is a, c, g, or t
  misc_feature (571)..(571): n is a, c, g, or t
gcctactactactaaattcgcggccgcgtcgactatctttttttcctcctctaagcccaaagattaactagagtccctccaaccttatagattgttggctttcacaatcttataacctaggatacaggtagtttcgagtatggtgccagtgatgttttgtttttgtttggtcaaggggtaggtgcaacccaatggaccacttatgcaaaagatgtaaactcttgcataatacattgataacatgttttgccaactttaaatgcttaaacataagcgaaaccagtagcaagtatgtgggtcagcttaaaaattttgattgttaatgccctattttctaatttggcacctcttgatgcctaagcaggtaagcagatgcctaagctgtatttctccaaataaatcaagatgaagtactgcccaagttaaatattgatagcctaaagacaagtttatgtagtacttaatgtacatgatatgaatgtgaagcataaaattaaataaaatttttccccattggcttggttttattttaaaaattaaaaaaaaaaannaaaanactataaagagtcgnttttcagtgcactggcccgccttttacaacatggggactggggcgtatatcgataggcccgaccgtcgtcctcccaacagtgccacctgatgggtggttgtagcgt

SEQ ID NO: 455509 - DNA, 2397 bp, Homo sapiens
  misc_feature (25)..(25): n is a, c, g, or t
aacgactatgtactcgcgacgagcnccgggttgttatttcagtcaccagggccggggcttcggtgttcgtgggctttgtcggtccgtgcctcgtctctccctggaaagggagggaggcttcgacgtcgagagggagccgctgccgcgttagttccgagcttgaagtcactaggacttctctcaaacttgtgtgctgaggagactcagatgttggcctcagctcctaggctgaactcagcagatcggcccatgaaaacttctgtattgagacaaaggaagggatctgtcagaaagcaacacttgttatcttgggcttggcagcaaggaagaggacaggtagtggagatcctgcaatctgaaaagcagactgaaaggtgacaaagaagctgaagatgggtggtggagagaggtataacattccagcccctcaatctagaaatgttagtaagaaccaacaacagcttaacagacagaagaccaaggaacagaattcccagatgaagattgttcataagaaaaaagaaagaggacatggttataactcatcagcagctgcctggcaggccatgcaaaatggggggaagaacaaaaattttccaaataatcaaagttggaattctagcttatcaggtcccaggttactttttaaatctcaagctaatcagaactatgctggtgccaaatttagtgagccgccatcaccaagtgttcttcccaaaccaccaagccactgggtccctgtttcctttaatccttcagataaggaaataatgacatttcaacttaaaaccttacttaaagtacaggtataaaataagacaaatgtttaaatttagttatgttcacggatagttgtcaattggtctgaaacaaattcgctagggaatctatttgtgtagaactaattaatgtaaaaaaaatagaccatctcgtgttgtgtgcactgtgatataatggtagtatcagtgcaacttaaactaatgattgtacttgatattaagtgttctcaactgagtaacttttaagtggaaaccaagtttagatttggggagtggtaaaggaatcagctttttctattgttaggggaagacagtaatttatcattcatggaccagtagattgttgaaagttggtgaatcggattataagcttctagctaacacaaggattcagaattaggtaaacatctgaaggtttagtatattagaaacacccaaaccagtaatatgctaacctgatgcactgctgaaagaaaatgtgaatttttcgtaataattgcattttagtgaattgtacagtgggtggaaagggcatttggagctcattagaatgagacatagtacaccccaatggccctgtttattaaatgtagtggattaagtgtctgtcaacaaatacaccaaaaccattttttatagaaacagtatttaatggtcactcaatagctttcaaaatacatttttgtattacagcactgcacaagctattctaatagtgctctggcctcatcattcctgcaaagcttgctttggggagttggataatgtgaaaattttaagtacctaggggagaaagagccatgtaaatatctgtaataaacttgtagcatatgtaaagttttcttggcctttatcttacaaaaatggagtattttagtatgaatttgctgaatgtaagaccgtggactgttttttataatatggcctaattttaaaggtccaaaataacttgtttttaaagtttgcccttgtgctaaagtgccagtgtatgtatgttatacttgatttggttgtaaactatatttcaaagtaaaccctagtgtaataagttttataactaaaaaggtttaagctgctaaaactatttttaagagatgtgaaatgcagtatgggactatctttttttcctcctctaagcccaaagattaactagagtccctccaaccttatagattgttggctttcacaatcttataacctaggatacaggtagtttcgagtatggtgccagtgatgttttgtttttgtttggtcaaggggtaggtgcaacccaatggaccacttatgcaaaagatgtaaactcttgcataatacattgataacatgttttgccaactttaaatgcttaaacataagcgaaaccagtagcaagtatgtgggtcagcttaaaaattttgattgttaatgccctattttctaatttggcacctcttgatgcctaagcaggtaagcagatgcctaagctgtatttctccaaataaatcaagatgaagtactgcccaagttaaatattgatagcctaaagacaagtttatgtagtacttaatgtacatgatatgaatgtgaagcataaaattaaataaaatttttccccattggcttggttttattttaaaaa

SEQ ID NO: 455510 - DNA, 2287 bp, Homo sapiens
tgcagtcgctgccgactccattttgtcggtagaggcagaaggagaaggtcgggttgtagaagctggggtggccggcagctcgctcatcggtgttcgtgggctttgtcggtccgtgcctcgtctctccctggaaagggagggaggcttcgacgtcgagagggagccgctgccgcgttagttccgagcttgaagtcactaggacttctctcaaacttgtgtgctgaggagactcagatgttggcctcagctcctaggctgaactcagcagatcggcccatgaaaacttctgtattgagacaaaggaagggatctgtcagaaagcaacacttgttatcttgggcttggcagcaaggaagaggacaggtagtggagatcctgcaatctgaaaagcagactgaaaggtgacaaagaagctgaagatgggtggtggagagaggtataacattccagcccctcaatctagaaatgttagtaagaaccaacaacagcttaacagacagaagaccaaggaacagaattcccagatgaagattgttcataagaaaaaagaaagaggacatggttataactcatcagcagctgcctggcaggccatgcaaaatggggggaagaacaaaaattttccaaataatcaaagttggaattctagcttatcaggtcccaggttactttttaaatctcaagctaatcagaactatgctggtgccaaatttagtgagccgccatcaccaagtgttcttcccaaaccaccaagccactgggtccctgtttcctttaatccttcagataaggaaataatgacatttcaacttaaaaccttacttaaagtacaggtataaaataagacaaatgtttaaatttagttatgttcacggatagttgtcaattggtctgaaacaaattcgctagggaatctatttgtgtagaactaattaatgtaaaaaaaatagaccatctcgtgttgtgtgcactgtgatataatggtagtatcagtgcaacttaaactaatgattgtacttgatattaagtgttctcaactgagtaacttttaagtggaaaccaagtttagatttggggagtggtaaaggaatcagctttttctattgttaggggaagacagtaatttatcattcatggaccagtagattgttgaaagttggtgaatcggattataagcttctagctaacacaaggattcagaattaggtaaacatctgaaggtttagtatattagaaacacccaaaccagtaatatgctaacctgatgcactgctgaaagaaaatgtgaatttttcgtaataattgcattttagtgaattgtacagtgggtggaaagggcatttggagctcattagaatgagacatagtacaccccaatggccctgtttattaaatgtagtggattaagtgtctgtcaacaaatacaccaaaaccattttttatagaaacagtatttaatggtcactcaatagctttcaaaatacatttttttgtagcatatgtaaagttttcttggcctttatcttacaaaaatggagtattttagtatgaatttgctgaatgtaagaccgtggactgttttttataatatggcctaattttaaaggtccaaaataacttgtttttaaagtttgcccttgtgctaaagtgccagtgtatgtatgttatacttgatttggttgtaaactatatttcaaagtaaaccctagtgtaataagttttataactaaaaaggtttaagctgctaaaactatttttaagagatgtgaaatgcagtatgggactatctttttttcctcctctaagcccaaagattaactagagtccctccaaccttatagattgttggctttcacaatcttataacctaggatacaggtagtttcgagtatggtgccagtgatgttttgtttttgtttggtcaaggggtaggtgcaacccaatggaccacttatgcaaaagatgtaaactcttgcataatacattgataacatgttttgccaactttaaatgcttaaacataagcgaaaccagtagcaagtatgtgggtcagcttaaaaattttgattgttaatgccctattttctaatttggcacctcttgatgcctaagcaggtaagcagatgcctaagctgtatttctccaaataaatcaagatgaagtactgcccaagttaaatattgatagcctaaagacaagtttatgtagtacttaatgtacatgatatgaatgtgaagcataaaattaaataaaatttttccccattggcttggttttattttaaaaa

SEQ ID NO: 455511 - DNA, 2370 bp, Homo sapiens
tgcagtcgctgccgactccattttgtcggtagaggcagaaggagaaggtcgggttgtagaagctggggtggccggcagctcgctcatcggtgttcgtgggctttgtcggtccgtgcctcgtctctccctggaaagggagggaggcttcgacgtcgagagggagccgctgccgcgttagttccgagcttgaagtcactaggacttctctcaaacttgtgtgctgaggagactcagatgttggcctcagctcctaggctgaactcagcagatcggcccatgaaaacttctgtattgagacaaaggaagggatctgtcagaaagcaacacttgttatcttgggcttggcagcaaggaagaggacaggtagtggagatcctgcaatctgaaaagcagactgaaaggtgacaaagaagctgaagatgggtggtggagagaggtataacattccagcccctcaatctagaaatgttagtaagaaccaacaacagcttaacagacagaagaccaaggaacagaattcccagatgaagattgttcataagaaaaaagaaagaggacatggttataactcatcagcagctgcctggcaggccatgcaaaatggggggaagaacatttttaaatctcaagctaatcagaactatgctggtgccaaatttagtgagccgccatcaccaagtgttcttcccaaaccaccaagccactgggtccctgtttcctttaatccttcagataaggaaataatgacatttcaacttaaaaccttacttaaagtacaggtataaaataagacaaatgtttaaatttagttatgttcacggatagttgtcaattggtctgaaacaaattcgctagggaatctatttgtgtagaactaattaatgtaaaaaaaatagaccatctcgtgttgtgtgcactgtgatataatggtagtatcagtgcaacttaaactaatgattgtacttgatattaagtgttctcaactgagtaacttttaagtggaaaccaagtttagatttggggagtggtaaaggaatcagctttttctattgttaggggaagacagtaatttatcattcatggaccagtagattgttgaaagttggtgaatcggattataagcttctagctaacacaaggattcagaattaggtaaacatctgaaggtttagtatattagaaacacccaaaccagtaatatgctaacctgatgcactgctgaaagaaaatgtgaatttttcgtaataattgcattttagtgaattgtacagtgggtggaaagggcatttggagctcattagaatgagacatagtacaccccaatggccctgtttattaaatgtagtggattaagtgtctgtcaacaaatacaccaaaaccattttttatagaaacagtatttaatggtcactcaatagctttcaaaatacatttttgtattacagcactgcacaagctattctaatagtgctctggcctcatcattcctgcaaagcttgctttggggagttggataatgtgaaaattttaagtacctaggggagaaagagccatgtaaatatctgtaataaacttgtagcatatgtaaagttttcttggcctttatcttacaaaaatggagtattttagtatgaatttgctgaatgtaagaccgtggactgttttttataatatggcctaattttaaaggtccaaaataacttgtttttaaagtttgcccttgtgctaaagtgccagtgtatgtatgttatacttgatttggttgtaaactatatttcaaagtaaaccctagtgtaataagttttataactaaaaaggtttaagctgctaaaactatttttaagagatgtgaaatgcagtatgggactatctttttttcctcctctaagcccaaagattaactagagtccctccaaccttatagattgttggctttcacaatcttataacctaggatacaggtagtttcgagtatggtgccagtgatgttttgtttttgtttggtcaaggggtaggtgcaacccaatggaccacttatgcaaaagatgtaaactcttgcataatacattgataacatgttttgccaactttaaatgcttaaacataagcgaaaccagtagcaagtatgtgggtcagcttaaaaattttgattgttaatgccctattttctaatttggcacctcttgatgcctaagcaggtaagcagatgcctaagctgtatttctccaaataaatcaagatgaagtactgcccaagttaaatattgatagcctaaagacaagtttatgtagtacttaatgtacatgatatgaatgtgaagcataaaattaaataaaatttttccccattggcttggttttattttaaaaa

SEQ ID NO: 455512 - DNA, 2370 bp, Homo sapiens
tgcagtcgctgccgactccattttgtcggtagaggcagaaggagaaggtcgggttgtagaagctggggtggccggcagctcgctcatcggtgttcgtgggctttgtcggtccgtgcctcgtctctccctggaaagggagggaggcttcgacgtcgagagggagccgctgccgcgttagttccgagcttgaagtcactaggacttctctcaaacttgtgtgctgaggagactcagatgttggcctcagctcctaggctgaactcagcagatcggcccatgaaaacttctgtattgagacaaaggaagggatctgtcagaaagcaacacttgttatcttgggcttggcagcaaggaagaggacaggtagtggagatcctgcaatgtataacattccagcccctcaatctagaaatgttagtaagaaccaacaacagcttaacagacagaagaccaaggaacagaattcccagatgaagattgttcataagaaaaaagaaagaggacatggttataactcatcagcagctgcctggcaggccatgcaaaatggggggaagaacaaaaattttccaaataatcaaagttggaattctagcttatcaggtcccaggttactttttaaatctcaagctaatcagaactatgctggtgccaaatttagtgagccgccatcaccaagtgttcttcccaaaccaccaagccactgggtccctgtttcctttaatccttcagataaggaaataatgacatttcaacttaaaaccttacttaaagtacaggtataaaataagacaaatgtttaaatttagttatgttcacggatagttgtcaattggtctgaaacaaattcgctagggaatctatttgtgtagaactaattaatgtaaaaaaaatagaccatctcgtgttgtgtgcactgtgatataatggtagtatcagtgcaacttaaactaatgattgtacttgatattaagtgttctcaactgagtaacttttaagtggaaaccaagtttagatttggggagtggtaaaggaatcagctttttctattgttaggggaagacagtaatttatcattcatggaccagtagattgttgaaagttggtgaatcggattataagcttctagctaacacaaggattcagaattaggtaaacatctgaaggtttagtatattagaaacacccaaaccagtaatatgctaacctgatgcactgctgaaagaaaatgtgaatttttcgtaataattgcattttagtgaattgtacagtgggtggaaagggcatttggagctcattagaatgagacatagtacaccccaatggccctgtttattaaatgtagtggattaagtgtctgtcaacaaatacaccaaaaccattttttatagaaacagtatttaatggtcactcaatagctttcaaaatacatttttgtattacagcactgcacaagctattctaatagtgctctggcctcatcattcctgcaaagcttgctttggggagttggataatgtgaaaattttaagtacctaggggagaaagagccatgtaaatatctgtaataaacttgtagcatatgtaaagttttcttggcctttatcttacaaaaatggagtattttagtatgaatttgctgaatgtaagaccgtggactgttttttataatatggcctaattttaaaggtccaaaataacttgtttttaaagtttgcccttgtgctaaagtgccagtgtatgtatgttatacttgatttggttgtaaactatatttcaaagtaaaccctagtgtaataagttttataactaaaaaggtttaagctgctaaaactatttttaagagatgtgaaatgcagtatgggactatctttttttcctcctctaagcccaaagattaactagagtccctccaaccttatagattgttggctttcacaatcttataacctaggatacaggtagtttcgagtatggtgccagtgatgttttgtttttgtttggtcaaggggtaggtgcaacccaatggaccacttatgcaaaagatgtaaactcttgcataatacattgataacatgttttgccaactttaaatgcttaaacataagcgaaaccagtagcaagtatgtgggtcagcttaaaaattttgattgttaatgccctattttctaatttggcacctcttgatgcctaagcaggtaagcagatgcctaagctgtatttctccaaataaatcaagatgaagtactgcccaagttaaatattgatagcctaaagacaagtttatgtagtacttaatgtacatgatatgaatgtgaagcataaaattaaataaaatttttccccattggcttggttttattttaaaaa

SEQ ID NO: 455513 - DNA, 1989 bp, Homo sapiens
tgcagtcgctgccgactccattttgtcggtagaggcagaaggagaaggtcgggttgtagaagctggggtggccggcagctcgctcatcggtgttcgtgggctttgtcggtccgtgcctcgtctctccctggaaagggagggaggcttcgacgtcgagagggagccgctgccgcgttagttccgagcttgaagtcactaggacttctctcaaacttgtgtgctgaggagactcagatgttggcctcagctcctaggctgaactcagcagatcggcccatgaaaacttctgtattgagacaaaggaagggatctgtcagaaagcaacacttgttatcttgggcttggcagcaaggaagaggacaggtagtggagatcctgcaatctgaaaagcagactgaaaggtgacaaagaagctgaagatgggtggtggagagaggtataacattccagcccctcaatctagaaatgttagtaagaaccaacaacagcttaacagacagaagaccaaggaacagaattcccagatgaagattgttcataagaaaaaagaaagaggacatggttataactcatcagcagctgcctggcaggccatgcaaaatggggggaagaacaaaaattttccaaataatcaaagttggaattctagcttatcaggtcccaggttactttttaaatctcaagctaatcagaactatgctggtgccaaatttagtgagccgccatcaccaagtgttcttcccaaaccaccaagccactgggtccctgtttcctttaatccttcagataaggaaataatgacatttcaacttaaaaccttacttaaagtacaggtataaaataagacaaatgtttaaatttagttatgttcacggatagttgtcaattggtctgaaacaaattcgctagggaatctatttgtgtagaactaattaatgtaaaaaaaatagaccatctcgtgttgtgtgcactgtgatataatggtagtatcagtgcaacttaaactaatgattgtacttgatattaagtgttctcaactgagtaacttttaagtggaaaccaagtttagatttggggagtggtaaaggaatcagctttttctattgttaggggaagacagtaatttatcattcatggaccagtagattgttgaaagttggtgaatcggattataagcttctagctaacacaaggattcagaattaggtaaacatctgaaggtttagtatattagaaacacccaaaccagtaatatgctaacctgatgcactgctgaaagaaaatgtgaatttttcgtaataattgcattttagtgaattgtacagtgggtggaaagggcatttggagctcattagaatgagacatagtacaccccaatggccctgtttattaaatgtagtggattaagtgtctgtcaacaaatacaccaaaaccattttttatagaaacagtatttaatggtcactcaatagctttcaaaatacatttttgtattacagcactgcacaagctattctaatagtgctctggcctcatcattcctgcaaagcttgctttggggagttggataatgtgaaaattttaagtacctaggggagaaagagccatgtaaatatctgtaataaacttgtagcatatgtaaagttttcttggcctttatcttacaaaaatggagtattttagtatgaatttgctgaatgtaagaccgtggactgttttttataatatggcctaattttaaaggtccaaaataacttgtttttaaagtttgcccttgtgctaaagtgccagtgtatgtatgttatacttgatttggttgtaaactatatttcaaagtaaaccctagtgtaataagataatttctttttcactagtttcctaagaaatgggtagatcttatctttcagaaatgaaaggtagaccctaaagtctctatgttacttaataagtgtataaatagagaagacagttttcttttgtgagcagcga

SEQ ID NO: 455514 - DNA, 1303 bp, Homo sapiens
  misc_feature (1271)..(1271): n is a, c, g, or t
tgcagtcgctgccgactccattttgtcggtagaggcagaaggagaaggtcgggttgtagaagctggggtggccggcagctcgctcatcggtgttcgtgggctttgtcggtccgtgcctcgtctctccctggaaagggagggaggcttcgacgtcgagagggagccgctgccgcgttagttccgagcttgaagtcactaggacttctctcaaacttgtgtgctgaggagactcagatgttggcctcagctcctaggctgaactcagcagatcggcccatgaaaacttctgtattgagacaaaggaagggatctgtcagaaagcaacacttgttatcttgggcttggcagcaaggaagaggacaggtagtggagatcctgcaatctgaaaagcagactgaaaggtgacaaagaagctgaagatgggtggtggagagaggtataacattccagcccctcaatctagaaatgttagtaagaaccaacaacagcttaacagacagaagaccaaggaacagaattcccagatgaagattgttcataagaaaaaagaaagaggacatggttataactcatcagcagctgcctggcaggccatgcaaaatggggggaagaacaaaaattttccaaataatcaaagttggaattctagcttatcaggtcccaggttactttttaaatctcaagctaatcagaactatgctggtgccaaatttagtgagccgccatcaccaagtgttcttcccaaaccaccaagccactgggtccctgtttcctttaatccttcagataaggaaataatgacatttcaacttaaaaccttacttaaagtacaggtataaaataagacaaatgtttaaatttagttatgttcacggatagttgtcaattggtctgaaacaaattcgctagggaatctatttgtgtagaactaattaatgtaaaaaaaatagaccatctcgtgttgtgtgcactgtgatataatggtagtatcagtgcaacttaaactaatgattgtacttgatattaagtgttctcaactgagtaacttttaagtggaaaccaagtttagatttggggagtggtaaaggaatcagctttttctattgttaggggaagacagtaatttatcattcatggaccagtagattgttgaaagttggtgaatcggattataagcttctagctaacacaaggattcagaattaggtaaacatctgaaggtttagtatattagaaacacccaaaccagtaatatgctaacctgatgcacnactgtcgagattcggtccgagctcgatcgacc

SEQ ID NO: 455515 - DNA, 690 bp, Homo sapiens
gcctactactactaaattcgcggccgcgtcgactttgcccttgtgctaaagtgccagtgtatgtatgttatacttgatttggttgtaaactatatttcaaagtaaaccctagtgtaataagttttataactaaaaaggtttaagctgctaaaactatttttaagagatgtgaaatgcagtatgggactatctttttttcctcctctaagcccaaagattaactagagtccctccaaccttatagattgttggctttcacaatcttataacctaggatacaggtagtttcgagtatggtgccagtgatgttttgtttttgtttggtcaaggggtaggtgcaacccaatggaccacttatgcaaaagatgtaaactcttgcataatacattgataacatgttttgccaactttaaatgcttaaacataagcgaaaccagtagcaagtatgtgggtcagcttaaaaattttgattgttaatgccctattttctaatttggcacctcttgatgcctaagcaggtaagcagatgcctaagctgtatttctccaaataaatcaagatgaagtactgcccaagttaaatattgatagcctaaagacaagtttatgtagtacttaatgtacatgatatgaatgtgaagcataaaattaaataaaatttttccccattggcttggttttattttaaaaa

SEQ ID NO: 455516 - DNA, 536 bp, Homo sapiens
gcctactactactaaattcgcggccgcgtcgactatctttttttcctcctctaagcccaaagattaactagagtccctccaaccttatagattgttggctttcacaatcttataacctaggatacaggtagtttcgagtatggtgccagtgatgttttgtttttgtttggtcaaggggtaggtgcaacccaatggaccacttatgcaaaagatgtaaactcttgcataatacattgataacatgttttgccaactttaaatgcttaaacataagcgaaaccagtagcaagtatgtgggtcagcttaaaaattttgattgttaatgccctattttctaatttggcacctcttgatgcctaagcaggtaagcagatgcctaagctgtatttctccaaataaatcaagatgaagtactgcccaagttaaatattgatagcctaaagacaagtttatgtagtacttaatgtacatgatatgaatgtgaagcataaaattaaataaaatttttccccattggcttggttttattttaaaaa

SEQ ID NO: 455517 - DNA, 484 bp, Homo sapiens
tatggtgccagtgatgttttgtttttgtttggtcaaggggtaggtgcaacccaatggaccacttatgcaaaagatgtaaactcttgcataatacattgataacatgttttgccaactttaaatgcttaaacataagcgaaaccagtagcaagtatgtgggtcagcttaaaaattttgattgttaatgccctattttctaatttggcacctcttgatgcctaagcaggtaagcagatgcctaagctgtatttctccaaataaatcaagatgaagtactgcccaagttaaatattgatagcctaaagacaagtttatgtagtacttaatgtacatgatatgaatgtgaagcataaaattaaataaaatttttccccattggcttggttttattttaaaaaaaatggttttgattgcttaatattctttttaaaaatgtgttttacttgtcactgacttgaagctcataatacactcacaatattcc

SEQ ID NO: 455518 - DNA, 2424 bp, Homo sapiens
tgcagtcgctgccgactccattttgtcggtagaggcagaaggagaaggtcgggttgtagaagctggggtggccggcagctcgctcatcggtgttcgtgggctttgtcggtccgtgcctcgtctctccctggaaagggagggaggcttcgacgtcgagagggagccgctgccgcgttagttccgagcttgaagtcactaggacttctctcaaacttgtgtgctgaggagactcagatgttggcctcagctcctaggctgaactcagcagatcggcccatgaaaacttctgtattgagacaaaggaagggatctgtcagaaagcaacacttgttatcttgggcttggcagcaaggaagaggacaggtagtggagatcctgcaatctgaaaagcagactgaaaggtgacaaagaagctgaagatgggtggtggagagaggtataacattccagcccctcaatctagaaatgttagtaagaaccaacaacagcttaacagacagaagaccaaggaacagaattcccagatgaagattgttcataagaaaaaagaaagaggacatggttataactcatcagcagctgcctggcaggccatgcaaaatggggggaagaacaaaaattttccaaataatcaaagttggaattctagcttatcaggtcccaggttactttttaaatctcaagctaatcagaactatgctggtgccaaatttagtgagccgccatcaccaagtgttcttcccaaaccaccaagccactgggtccctgtttcctttaatccttcagataaggaaataatgacatttcaacttaaaaccttacttaaagtacaggtataaaataagacaaatgtttaaatttagttatgttcacggatagttgtcaattggtctgaaacaaattcgctagggaatctatttgtgtagaactaattaatgtaaaaaaaatagaccatctcgtgttgtgtgcactgtgatataatggtagtatcagtgcaacttaaactaatgattgtacttgatattaagtgttctcaactgagtaacttttaagtggaaaccaagtttagatttggggagtggtaaaggaatcagctttttctattgttaggggaagacagtaatttatcattcatggaccagtagattgttgaaagttggtgaatcggattataagcttctagctaacacaaggattcagaattaggtaaacatctgaaggtttagtatattagaaacacccaaaccagtaatatgctaacctgatgcactgctgaaagaaaatgtgaatttttcgtaataattgcattttagtgaattgtacagtgggtggaaagggcatttggagctcattagaatgagacatagtacaccccaatggccctgtttattaaatgtagtggattaagtgtctgtcaacaaatacaccaaaaccattttttatagaaacagtatttaatggtcactcaatagctttcaaaatacatttttgtattacagcactgcacaagctattctaatagtgctctggcctcatcattcctgcaaagcttgctttggggagttggataatgtgaaaattttaagtacctaggggagaaagagccatgtaaatatctgtaataaacttgtagcatatgtaaagttttcttggcctttatcttacaaaaatggagtattttagtatgaatttgctgaatgtaagaccgtggactgttttttataatatggcctaattttaaaggtccaaaataacttgtttttaaagtttgcccttgtgctaaagtgccagtgtatgtatgttatacttgatttggttgtaaactatatttcaaagtaaaccctagtgtaataagttttataactaaaaaggtttaagctgctaaaactatttttaagagatgtgaaatgcagtatgggactatctttttttcctcctctaagcccaaagattaactagagtccctccaaccttatagattgttggctttcacaatcttataacctaggatacaggtagtttcgagtatggtgccagtgatgttttgtttttgtttggtcaaggggtaggtgcaacccaatggaccacttatgcaaaagatgtaaactcttgcataatacattgataacatgttttgccaactttaaatgcttaaacataagcgaaaccagtagcaagtatgtgggtcagcttaaaaattttgattgttaatgccctattttctaatttggcacctcttgatgcctaagcaggtaagcagatgcctaagctgtatttctccaaataaatcaagatgaagtactgcccaagttaaatattgatagcctaaagacaagtttatgtagtacttaatgtacatgatatgaatgtgaagcataaaattaaataaaatttttccccattggcttggttttattttaaaaa

SEQ ID NO: 455519 - DNA, 2352 bp, Homo sapiens
gaaacggtaacacggcgcgtaaagggctctaattgaacttaaggaccaatggggccaccaagcaggaagtgactgacttgcccgcgtgtgtctgaaccgccttcacagggaggcaacttttgactaggacttctctcaaacttgtgtgctgaggagactcagatgttggcctcagctcctaggctgaactcagcagatcggcccatgaaaacttctgtattgagacaaaggaagggatctgtcagaaagcaacacttgttatcttgggcttggcagcaaggaagaggacaggtagtggagatcctgcaatctgaaaagcagactgaaaggtgacaaagaagctgaagatgggtggtggagagaggtataacattccagcccctcaatctagaaatgttagtaagaaccaacaacagcttaacagacagaagaccaaggaacagaattcccagatgaagattgttcataagaaaaaagaaagaggacatggttataactcatcagcagctgcctggcaggccatgcaaaatggggggaagaacaaaaattttccaaataatcaaagttggaattctagcttatcaggtcccaggttactttttaaatctcaagctaatcagaactatgctggtgccaaatttagtgagccgccatcaccaagtgttcttcccaaaccaccaagccactgggtccctgtttcctttaatccttcagataaggaaataatgacatttcaacttaaaaccttacttaaagtacaggtataaaataagacaaatgtttaaatttagttatgttcacggatagttgtcaattggtctgaaacaaattcgctagggaatctatttgtgtagaactaattaatgtaaaaaaaatagaccatctcgtgttgtgtgcactgtgatataatggtagtatcagtgcaacttaaactaatgattgtacttgatattaagtgttctcaactgagtaacttttaagtggaaaccaagtttagatttggggagtggtaaaggaatcagctttttctattgttaggggaagacagtaatttatcattcatggaccagtagattgttgaaagttggtgaatcggattataagcttctagctaacacaaggattcagaattaggtaaacatctgaaggtttagtatattagaaacacccaaaccagtaatatgctaacctgatgcactgctgaaagaaaatgtgaatttttcgtaataattgcattttagtgaattgtacagtgggtggaaagggcatttggagctcattagaatgagacatagtacaccccaatggccctgtttattaaatgtagtggattaagtgtctgtcaacaaatacaccaaaaccattttttatagaaacagtatttaatggtcactcaatagctttcaaaatacatttttgtattacagcactgcacaagctattctaatagtgctctggcctcatcattcctgcaaagcttgctttggggagttggataatgtgaaaattttaagtacctaggggagaaagagccatgtaaatatctgtaataaacttgtagcatatgtaaagttttcttggcctttatcttacaaaaatggagtattttagtatgaatttgctgaatgtaagaccgtggactgttttttataatatggcctaattttaaaggtccaaaataacttgtttttaaagtttgcccttgtgctaaagtgccagtgtatgtatgttatacttgatttggttgtaaactatatttcaaagtaaaccctagtgtaataagttttataactaaaaaggtttaagctgctaaaactatttttaagagatgtgaaatgcagtatgggactatctttttttcctcctctaagcccaaagattaactagagtccctccaaccttatagattgttggctttcacaatcttataacctaggatacaggtagtttcgagtatggtgccagtgatgttttgtttttgtttggtcaaggggtaggtgcaacccaatggaccacttatgcaaaagatgtaaactcttgcataatacattgataacatgttttgccaactttaaatgcttaaacataagcgaaaccagtagcaagtatgtgggtcagcttaaaaattttgattgttaatgccctattttctaatttggcacctcttgatgcctaagcaggtaagcagatgcctaagctgtatttctccaaataaatcaagatgaagtactgcccaagttaaatattgatagcctaaagacaagtttatgtagtacttaatgtacatgatatgaatgtgaagcataaaattaaataaaatttttccccattggcttggttttattttaaaaa

SEQ ID NO: 455520 - DNA, 2677 bp, Homo sapiens
tgcagtcgctgccgactccattttgtcggtagaggcagaaggagaaggtcgggttgtagaagctggggtggccggcagctcgctcatcggtgttcgtgggctttgtcggtccgtgcctcgtctctccctggaaagggagggaggcttcgacgtcgagagggagccgctgccgcgttagttccgagcttgaagtcactaggacttctctcaaacttgtgtgctgaggagactcagatgttggcctcagctcctaggctgaactcagcagatcggcccatgaaaacttctgtattgagacaaaggaagggatctgtcagaaagcaacacttgttatcttgggcttggcagcaaggaagaggacaggtagtggagatcctgcaatctgaaaagcagactgaaaggtgacaaagaagctgaagatgggtggtggagagaggtataacattccagcccctcaatctagaaatgttagtaagaaccaacaacagcttaacagacagaagaccaaggaacagaattcccagatgaagattgttcataagaaaaaagaaagaggacatggttataactcatcagcagctgcctggcaggccatgcaaaatggggggaagaacaaaaattttccaaataatcaaagttggaattctagcttatcaggtcccaggttactttttaaatctcaagctaatcagaactatgctggtgccaaatttagtgagccgccatcaccaagtgttcttcccaaaccaccaagccactgggtccctgtttcctttaatccttcagataaggaaataatgacatttcaacttaaaaccttacttaaagtacaggtataaaataagacaaatgtttaaatttagttatgttcacggatagttgtcaattggtctgaaacaaattcgctagggaatctatttgtgtagaactaattaatgtaaaaaaaatagaccatctcgtgttgtgtgcactgtgatataatggtagtatcagtgcaacttaaactaatgattgtacttgatattaagtgttctcaactgagtaacttttaagtggaaaccaagtttagatttggggagtggtaaaggaatcagctttttctattgttaggggaagacagtaatttatcattcatggaccagtagattgttgaaagttggtgaatcggattataagcttctagctaacacaaggattcagaattaggtaaacatctgaaggtttagtatattagaaacacccaaaccagtaatatgctaacctgatgcactgctgaaagaaaatgtgaatttttcgtaataattgcattttagtgaattgtacagtgggtggaaagggcatttggagctcattagaatgagacatagtacaccccaatggccctgtttattaaatgtagtggattaagtgtctgtcaacaaatacaccaaaaccattttttatagaaacagtatttaatggtcactcaatagctttcaaaatacatttttgtattacagcactgcacaagctattctaatagtgctctggcctcatcattcctgcaaagcttgctttggggagttggataatgtgaaaattttaagtacctaggggagaaagagccatgtaaatatctgtaataaacttgtagcatatgtaaagttttcttggcctttatcttacaaaaatggagtattttagtatgaatttgctgaatgtaagaccgtggactgttttttataatatggcctaattttaaaggtccaaaataacttgtttttaaagtttgcccttgtgctaaagtgccagtgtatgtatgttatacttgatttggttgtaaactatatttcaaagtaaaccctagtgtaataagttttataactaaaaaggtttaagctgctaaaactatttttaagagatgtgaaatgcagtatgggactatctttttttcctcctctaagcccaaagattaactagagtccctccaaccttatagattgttggctttcacaatcttataacctaggatacaggtagtttcgagtatggtgccagtgatgttttgtttttgtttggtcaaggggtaggtgcaacccaatggaccacttatgcaaaagatgtaaactcttgcataatacattgataacatgttttgccaactttaaatgcttaaacataagcgaaaccagtagcaagtatgtgggtcagcttaaaaattttgattgttaatgccctattttctaatttggcacctcttgatgcctaagcaggtaagcagatgcctaagctgtatttctccaaataaatcaagatgaagtactgcccaagttaaatattgatagcctaaagacaagtttatgtagtacttaatgtacatgatatgaatgtgaagcataaaattaaataaaatttttccccattggcttggttttattttaaaaaaaaaaaacaaaaaaaacaaaaagagggggggcggtaaaaaatttccttggggggtgccaagttaagcggtaccaggtttttgggacaagggggccacaaggggggataaaagaaagaacgggcgggttaacaggtcgggtggcaaaactgtagtgaattttgaagagacaatttggggggctattggaaatcctaagattaagctaggaaatacattagttggtacacgatgtgggagtgtcggtatttgata

SEQ ID NO: 455521 - DNA, 2380 bp, Homo sapiens
tgcagtcgctgccgactccattttgtcggtagaggcagaaggagaaggtcgggttgtagaagctggggtggccggcagctcgctcatcggtgttcgtgggctttgtcggtccgtgcctcgtctctccctggaaagggagggaggcttcgacgtcgagagggagccgctgccgcgttagttccgagcttgaagtcactaggacttctctcaaacttgtgtgctgaggagactcagatgttggcctcagctcctaggctgaactcagcagatcggcccatgaaaacttctgtattgagacaaaggaagggatctgtcagaaagcaacacttgttatcttgggcttggcagcaaggaagaggacaggtagtggagatcctgcaatctgaaaagcagactgaaaggtgacaaagaagctgaagatgggtggtggagagaggtataacattccagcccctcaatctagaaatgttagtaagaaccaacaacagcttaacagacagaagaccaaggaacagaattcccagatgaagattgttcataagaaaaaagaaagaggacatggttataactcatcagcagctgcctggcaggccatgcaaaatggggggaagaacaaaaattttccaaataatcaaagttggaattctagcttatcaggtcccaggttactttttaaatctcaagctaatcagaactatgctggtgccaaatttagtgagccgccatcaccaagtgttcttcccaaaccaccaagccactgggtccctgtttcctttaatccttcagataaggaaataatgacatttcaacttaaaaccttacttaaagtacaggtataaaataagacaaatgtttaaatttagttatgttcacggatagttgtcaattggtctgaaacaaattcgctagggaatctatttgtgtagaactaattaatgtaaaaaaaatagaccatctcgtgttgtgtgcactgtgatataatggtagtatcagtgcaacttaaactaatgattgtacttgatattaagtgttctcaactgagtaacttttaagtggaaaccaagtttagatttggggagtggtaaaggaatcagctttttctattgttaggggaagacagtaatttatcattcatggaccagtagattgttgaaagttggtgaatcggattataagcttctagctaacacaaggattcagaattaggtaaacatctgaaggtttagtatattagaaacacccaaaccagtaatatgctaacctgatgcactgctgaaagaaaatgtgaatttttcgtaataattgcattttagtgaattgtacagtgggtggaaagggcatttggagctcattagaatgagacatagtacaccccaatggccctgtttattaaatgtagtggattaagtgtctgtcaacaaatacaccaaaaccattttttatagaaacagtatttaatggtcactcaatagctttcaaaatacatttttgtattacagcactgcacaagctattctaatagtgctctggcctcatcattcctgcaaagcttgctttggggagttggataatgtgaaaattttaagtacctaggggagaaagagccatgtaaatatctgtaataaacttgtagcatatgtaaagttttcttggcctttatcttacaaaaatggagtattttagtatgaatttgctgaatgtaagaccgtggactgttttttataatatggcctaattttaaaggtccaaaataacttgtttttaaagtttgcccttgtgctaaagtgccagtgtatgtatgttatacttgatttggttgtaaactatatttcaaagtaaaccctagtgtaataagttttataactaaaaaggtttaagctgctaaaactatttttaagagatgtgaaatgcagtatgggactatctttttttcctcctctaagcccaaagattaactagagtccctccaaccttatagattgttggctttcacaatcttataacctaggatacaggtagtttcgagtatggtgccagtgatgttttgtttttgtttggtcaaggggtaggtgcaacccaatggaccacttatgcaaaagatgtaaactcttgcataatacattgataacatgttttgccaactttaaatgcttaaacataagcgaaaccagaacacagcaaggtgggtagcataaaccggacggaacgggctaaattataaatagggacgccggataccaaaccaggaaggaaatgccaactagatgaaccaaccaataaatcacgtaagtccgcgcaattatagcagacacgccgtaagtcacctgactatcgagtaggcgagcacaaatccccgccccaagaacagcccacgacagcc

SEQ ID NO: 455522 - DNA, 1797 bp, Homo sapiens
tgcagtcgctgccgactccattttgtcggtagaggcagaaggagaaggtcgggttgtagaagctggggtggccggcagctcgctcatcggtgttcgtgggctttgtcggtccgtgcctcgtctctccctggaaagggagggaggcttcgacgtcgagagggagccgctgccgcgttagttccgagcttgaagtcactaggacttctctcaaacttgtgtgctgaggagactcagatgttggcctcagctcctaggctgaactcagcagatcggcccatgaaaacttctgtattgagacaaaggaagggatctgtcagaaagcaacacttgttatcttgggcttggcagcaaggaagaggacaggtagtggagatcctgcaatctgaaaagcagactgaaaggtgacaaagaagctgaagatgggtggtggagagaggtataacattccagcccctcaatctagaaatgttagtaagaaccaacaacagcttaacagacagaagaccaaggaacagaattcccagatgaagattgttcataagaaaaaagaaagaggacatggttataactcatcagcagctgcctggcaggccatgcaaaatggggggaagaacaaaaattttccaaataatcaaagttggaattctagcttatcaggtcccaggttactttttaaatctcaagctaatcagaactatgctggtgccaaatttagtgagccgccatcaccaagtgttcttcccaaaccaccaagccactgggtccctgtttcctttaatccttcagataaggaaataatgacatttcaacttaaaaccttacttaaagtacaggtataaaataagacaaatgtttaaatttagttatgttcacggatagttgtcaattggtctgaaacaaattcgctagggaatctatttgtgtagaactaattaatgtaaaaaaaatagaccatctcgtgttgtgtgcactgtgatataatggtagtatcagtgcaacttaaactaatgattgtacttgatattaagtgttctcaactgagtaacttttaagtggaaaccaagtttagatttggggagtggtaaaggaatcagctttttctattgttaggggaagacagtaatttatcattcatggaccagtagattgttgaaagttggtgaatcggattataagcttctagctaacacaaggattcagaattaggtaaacatctgaaggtttagtatattagaaacacccaaaccagtaatatgctaacctgatgcactgctgaaagaaaatgtgaatttttcgtaataattgcattttagtgaattgtacagtgggtggaaagggcatttggagctcattagaatgagacatagtacaccccaatggccctgtttattaaatgtagtggattaagtgtctgtcaacaaatacaccaaaaccattttttatagaaacagtatttaatggtcactcaatagctttcaaaatacatttttgtattacagcactgcacaagctattctaatagtgctctggcctcatcattcctgcaaagcttgctttggggagttggataatgtgaaaattttaagtacctaggggagaaagagccatgtaaatatctgtaataaacttgtagcatatgtaaagttttcttggccttatttctgggattaggataattctgagttaacgggcggttatacagggcattagggacaaacgtgttggccgtgtacaggcggtgttgtacagggtgcgattagaccggtagtataacggagggatatgagggtgtgctcg

SEQ ID NO: 455523 - DNA, 902 bp, Homo sapiens
tggcgtaacgtccggtcaaggcagccatctcgccgtgagacagcaagtgtcggatccgcaggcgcagccgtgcgatgttgtcctctacagccatgtattcggctcctggcagagacttggggatggaaccgcacagagccgcgggccctttgcagctgcgattttcgccctacgttttcaacggaggtactatactggcaattgctggagaagattttgcaattgttgcttctgatactcgattgagtgaagggttttcaattcatacgcgggatagccccaaatgttacaaattaacagacaaaacagtcattggatgcagcggttttcatggagactgtcttacgctgacaaagattattgaagcaagactaaagatgtataagcattccaataataaggccatgactacgggggcaattgctgcaatgctgtctacaatcctgtattcaaggcgcttctttccatactatgtttacaacatcatcggtggacttgatgaagaaggaaagggggctgtatacagctttgatccagtagggtcttaccagagagactccttcaaggctggaggctcagcaagtgccatgctacagcccctgcttgacaaccaggttggttttaagaacatgcagaatgtggagcatgttccgctgtccttggacagagccatgcggctggtgaaagatgtcttcatttctgcggctgagagagatgtgtacactggggacgcactccggatctgcatagtgaccaaagagggcatcagggaggaaactgtttccttaaggaaggactgatctgtgtgctcttatcaccaatcagttcagacctggttgattttgtactttggaactgtaccttggatggttttgtttattaaaagagaaacctgaagtact

SEQ ID NO: 455524 - DNA, 1028 bp, Homo sapiens
gtaattttttctgtaaaggaccagatagtaaatatttacagctttatgggcctcatttgatctgcttctgtagtgaaaaagcagccacggacaatattcatagcaatagggagtaggctggatttggcccctgagccaaactacaggggtagtttgttgacccctggtctatatgcagagtgagggagagagatggatttaaacccatcttccttaggccacttcatgtgccctttcatacacattagctcttggattagcagtacctgagataagggtggtatggaaaatagagtctaaaccagagagctgagggcaaacttggcattccttcccttaaaattttatgttagtaatactgtgttggttgatcatgaaggaaataggcatgctttccccttccactgtggtatgcatttatttattcactttatactgttgattgttctagtctataatggcctctgcctctacatgcctgtgacttttatcaataattgcagatgtataagcattccaataataaggccatgactacgggggcaattgctgcaatgctgtctacaatcctgtattcaaggcgcttctttccatactatgtttacaacatcatcggtggacttgatgaagaaggaaagggggctgtatacagctttgatccagtagggtcttaccagagagactccttcaaggctggaggctcagcaagtgccatgctacagcccctgcttgacaaccaggttggttttaagaacatgcagaatgtggagcatgttccgctgtccttggacagagccatgcggctggtgaaagatgtcttcatttctgcggctgagagagatgtgtacactggggacgcactccggatctgcatagtgaccaaagagggcatcagggaggaaactgtttccttaaggaaggactgatctgtgtgctcttatcaccaatcagttcagacctggttgattttgtactttggaactgtaccttggatggttttgtttattaaaagagaaacctgaagtact

SEQ ID NO: 455525 - DNA, 948 bp, Homo sapiens
tggcgtaacgtccggtcaaggcagccatctcgccgtgagacagcaagtgtcggatccgcaggcgcagccgtgcgatgttgtcctctacagccatgtattcggctcctggcagagacttggggatggaaccgcacagagccgcgggccctttgcagctgcgattttcgccctacgttttcaacggaggtactatactggcaattgctggagaagattttgcaattgttgcttctgatactcgattgagtgaagggttttcaattcatacgcgggatagccccaaatgttacaaattaacagacaaaacagtcattggatgcagcggttttcatggagactgtcttacgctgacaaagattattgaagcaagactaaagatgtataagcattccaataataaggccatgactacgggggcaattgctgcaatgctgtctacaatcctgtattcaaggcgcttctttccatactatgtttacaacatcatcggtggacttgatgaagaaggaaagggggctgtatacagctttgatccagtagggtcttaccagagagactccttcaaggctggaggctcagcaagtgccatgctacagcccctgcttgacaaccaggttggttttaagaacatgcagaatgtggagcatgttccgctgtccttggacagagccatgcggctggtgaaagatgtcttcatttctgcggctgagagagatgtgtacactggggacgcactccggatctgcatagtgaccaaagagggcatcagggaggaaactgtttccttaaggaaggactgatctgtgtgctcttatcaccaatcagttcagacctggttgattttgtactttggaactgtaccttggatggttttgtttattaaaagagaaacctgaagtactaaaaaaaaaacagaattgggggattaatgtgggtgcggaaaacaga

SEQ ID NO: 455526 - DNA, 2043 bp, Homo sapiens
  misc_feature (1010)..(1010): n is a, c, g, or t
ttcttgctcagaataccttcatgatttcttgctaaaattccaaaatctttagcttggcatttgggattttctacagtaggaaccctgtccatcacataaaccttaacgtcactacatgtgcttatgcaaaaagggctgcctgaatgagttgcttgaatgtatgtactatttgaataattacctgtttgccattgcttgctgtttatattacctggaatgccatccttttcttcttgagagctttagcacaaatccctcctcagtaaaaatagtggcttaagtttcctgagtgcttacgtctgtgaggcaccatgcctttaatttccactattgcattgaagcagtggttatagttatcagtcaagccttgtacattaaaatatacacacccaaatatatatacacaccttgtgacacaggtactgttatcatcaacttgcatttggaggatttgtccaagatcacatacctagtaagtagcaagagtgggtctctgtctcatgtaattccagagcccaggtgcttagtcatactccagtgccatagcacttatagctaacacttactagaggaccagttacatgtcagggactgctataagggcttacatatttgatcctttgaacaccctaatgaggtagcaactgcagtgatctctgttgtatatatgatgaaattgacgctttgagaagtaacttacccacagtctcatatctgcgaaacgggaaagccagaattagaacccaggcggtctgcttttggaattctactgtaagtctctttgataagctgtcaaattgtacagccacagagggaaaaatttactgtttgtccatctatttgtcattatataagggattgggtataaagaaataagcattatataggcgttatataaggacttggatataaagaaatgaagcaagaaaaaaaaatctcatcttctctaaactcatagagcttgcgttgtagtaccactgtctatacctgatcctcaagggcacagatgnggtatttagttgttctgtattagtagtaccttgcgcgagtaagtatttaatgtgttggtgatgataattcattggcttttctgttaactcctgccaaggagactttgccctgatttaggcttattaataatttttttttcccagacaactcgtagccaggcgttcattctcttcccgctcatctttcctcttcccatttgaatcatgtttttgttgacatctagagtattttatcccattatgtactatggagcattcttctatttgtagggataggattaccaccctggagaattaatttttttcttttttcctcagtactatactggcaattgctggagaagattttgcaattgttgcttctgatactcgattgagtgaagggttttcaattcatacgcgggatagccccaaatgttacaaattaacagacaaaacagtcattggatgcagcggttttcatggagactgtcttacgctgacaaagattattgaagcaagactaaagatgtataagcattccaataataaggccatgactacgggggcaattgctgcaatgctgtctacaatcctgtattcaaggcgcttctttccatactatgtttacaacatcatcggtggacttgatgaagaaggaaagggggctgtatacagctttgatccagtagggtcttaccagagagactccttcaaggctggaggctcagcaagtgccatgctacagcccctgcttgacaaccaggttggttttaagaacatgcagaatgtggagcatgttccgctgtccttggacagagccatgcggctggtgaaagatgtcttcatttctgcggctgagagagatgtgtacactggggacgcactccggatctgcatagtgaccaaagagggcatcagggaggaaactgtttccttaaggaaggactgatctgtgtgctcttatcaccaatcagttcagacctggttgattttgtactttggaactgtaccttggatggttttgtttattaaaagagaaacctgaagtact

SEQ ID NO: 455527 - DNA, 684 bp, Homo sapiens
aaaaatattccattgtgtcgttataaccaaattagagaaaggtttccatttcacacgggatacgcccaatgtgtcaatttaccaccaacccgctcttgatacacaggttttcattgaactctctctcgctgtccaaagtttttttagcgcaagcctaaagttgtataacctttccattattaggccattctctcgggggccatttctgccattccggtctccatcctggattccaagcgcctctttccaaactatgtttccaacatcctcggttgactttattaagaaagaaagggggctgtatacagctttgatccagtagggtcttaccagagagactccttcaaggctggaggctcagcaagtgccatgctacagcccctgcttgacaaccaggttggttttaagaacatgcagaatgtggagcatgttccgctgtccttggacagagccatgcggctggtgaaagatgtcttcatttctgcggctgagagagatgtgtacactggggacgcactccggatctgcatagtgaccaaagagggcatcagggaggaaactgtttccttaaggaaggactgatctgtgtgctcttatcaccaatcagttcagacctggttgattttgtactttggaactgtaccttggatggttttgtttattaaaagagaaacctgaagtact

SEQ ID NO: 455528 - DNA, 478 bp, Homo sapiens
ttgtcagatttctgatgtgtgtaattcatccaggtctggaagggtctttattcagtctgaaggacattttaattttgtgtagtattttcatcacaaatcctcgtacacatgagggtattggaagaaacttgaacctttcctttgtgctcactgtcacatgacatctcacccaagtttcatgtcccaccaggttggttttaagaacatgcagaatgtggagcatgttccgctgtccttggacagagccatgcggctggtgaaagatgtcttcatttctgcggctgagagagatgtgtacactggggacgcactccggatctgcatagtgaccaaagagggcatcagggaggaaactgtttccttaaggaaggactgatctgtgtgctcttatcaccaatcagttcagacctggttgattttgtactttggaactgtaccttggatggttttgtttattaaaagagaaacctgaagtact

SEQ ID NO: 455529 - DNA, 385 bp, Homo sapiens
ggctgtagcatggcacttgctgagcctccagccttgaaggagtctctctggtaagaccctactggatcaaagctgtatacagcccctgcttgacaacgttggttttaagaacatgcagaatgtggagcatgttccgctgtccttggacagagccatgcggctggtgaaagatgtcttcatttctgcggctgagagagatgtgtacactggggacgcactccggatctgcatagtgaccaaagagggcatcagggaggaaactgtttccttaaggaaggactgatctgtgtgctcttatcaccaatcagttcagacctggttgattttgtactttggaactgtaccttggatggttttgtttattaaaagagaaacctgaagtact

SEQ ID NO: 455530 - DNA, 313 bp, Homo sapiens
gcggccgcctactactactactgctcgaattcaagcttctaacgatgtacggggacatgttccgctgtccttggacagagccatgcggctggtgaaagatgtcttcatttctgcggctgagagagatgtgtacactggggacgcactccggatctgcatagtgaccaaagagggcatcagggaggaaactgtttccttaaggaaggactgatctgtgtgctcttatcaccaatcagttcagacctggttgattttgtactttggaactgtaccttggatggttttgtttattaaaagagaaacctgaagtact

SEQ ID NO: 455531 - DNA, 195 bp, Homo sapiens
tgtgtggtgatctagaggatcccagatatccggatctgcatagtgaccaaagagggcatcagggaggaaactgtttccttaaggaaggactgatctgtgtgctcttatcaccaatcagttcagacctggttgattttgtactttggaactgtaccttggatggttttgtttattaaaagagaaacctgaagtact

SEQ ID NO: 455532 - DNA, 1649 bp, Homo sapiens
tggcgtaacgtccggtcaaggcagccatctcgccgtgagacagcaagtgtcggatccgcaggcgcagccgtgcgatgttgtcctctacagccatgtattcggctcctggcagagacttggggatggaaccgcacagagccgcgggccctttgcagctgcgattttcgccctacgttttcaacggagggtaaaaaccccagagagctgcggctttcactttcgcccttcccccatctgctgaagcctatttaggagtcaccgccgtgatggcgctgccccgggctcctgcaggcctcagaaccctgagctgagggggtccgcacaaggccggtctccctgccgtcctctcatgccctgtgtttccctcttcaggctcgctttgctcaagtttacttggtgattgcgatacagccttggtttttagggtttcccattacagtcatgtcatttgagtttttatgtggaccgccactccgtgctccttgctgctgtaagacagtaaagtagaaattgaaacatagcctctgctctgtggaagaccattaaaactggacctcatgtacacgtttcttatgccagccggcgagggtagagggttagcgtctgaaacttaaaagttagggttgtttggtctgtgttgttagatgcatagctgggttggtagccgagatgtctaattgtagccgcctgatttctgttatttctaattgtagcagtttaatcattttgttttatttcaaatagaaggtgggattggctgagcaaacttagtttcatagataagtgcttttttttttaacgtttagcttaagttcaggaaaacaaaatactcagaagatggaccttttagtatgtgtgttcttgtatgttatgttcaagttttggtttttattttaattaccagctttatcttgagtagtataattttccgtggtggcacgccagagatttagggttatagaaagatgctctgtttaagactcttgacagggaagagctgtaaattgaaacagtggttatagttaccaatcaagccttgtacattaaaatatacacacgcaatttgaacgaaccgatggttcttaaaacagaaaatattggctgggcagtgtggctcgcacctgtaatcccaggactttgggaagccaaggcaggaggatcatcgcttgaggccaggagttgaagaccagcctgcgcagcatagcaagaccccatctctacaaaaataaattttaaaaacaaagcaaaaatgttaattggttcctcataaatttgaaatataaatgcacattttgggagtgtgttagaaagataacgaaagtctgattttagccttggttctgccactaaaggacactttgggtacttctgaacttcttgaacctaaatttccttatcttccttagtagcttcatagtttttggtgagaatcaagagagatgcattttgtaaattgcaagctgtcatcttatttaatcctcatgaaaagtgaatgttagatgatattagcatcctagggttatattagacgttaaactgtcagggtcagagagctggtgtgaagttgagccaggacttaattcatagctatttcaccactgagtttatggatgcttttccattatacaccttaacacttcctgtccaaa

SEQ ID NO: 455533 - DNA, 1034 bp, Homo sapiens
  misc_feature (907)..(907): n is a, c, g, or t
  misc_feature (912)..(912): n is a, c, g, or t
  misc_feature (919)..(920): n is a, c, g, or t
  misc_feature (924)..(925): n is a, c, g, or t
  misc_feature (930)..(930): n is a, c, g, or t
  misc_feature (933)..(933): n is a, c, g, or t
  misc_feature (953)..(953): n is a, c, g, or t
tggcgtaacgtccggtcaaggcagccatctcgccgtgagacagcaagtgtcggatccgcaggcgcagccgtgcgatgttgtcctctacagccatgtattcggctcctggcagagacttggggatggaaccgcacagagccgcgggccctttgcagctgcgattttcgccctacgttttcaacggaggtactatactggcaattgctggagaagattttgcaattgttgcttctgatactcgattgagtgaagggttttcaattcatacgcgggatagccccaaatgttacaaattaacagacaaaacagtcattggatgcagcggttttcatggagactgtcttacgctgacaaagattattgaagcaagactaaagatgtataagcattccaataataaggccatgactacgggggcaattgctgcaatgctgtctacaatcctgtattcaaggcgcttctttccatactatgtttacaacatcatcggtggacttgatgaagaaggaaagggggctgtatacagctttgatccagtagggtcttaccagagagactccttcaaggctggaggctcagcaagtgccatgctacagcccctgcttgacaaccaggttggttttaagaacatgcagaatgtggagcatgttccgctgtccttggacagagccatgcggctggtgaaagatgtcttcatttctgcggctgagagagatgtgtacactggggacgcactccggatctgcatagtgaccaaagagggcatcagggaggaaactgtttccttaaggaaggactgatctgtgtgctcttatcaccaatcagttcagacctggttgattttgtactttggaactgtaccttggatggttttgtttattaaaagagaaacctgaagtactctgantaaanaaaaaanngggnnttttnggngggaggttgaaggctgttanggtccgccgttgcaagggagcggccatggggtatcgaccgtgggctacatataacatttagtgttaaaattatctctcaca

SEQ ID NO: 455534 - DNA, 1020 bp, Homo sapiens
tggcgtaacgtccggtcaaggcagccatctcgccgtgagacagcaagtgtcggatccgcaggcgcagccgtgcgatgttgtcctctacagccatgtattcggctcctggcagagacttggggatggaaccgcacagagccgcgggccctttgcagctgcgattttcgccctacgttttcaacggagggctcgctttgctcaagtttacttggtgattgcgatacagccttggtttttagggtttcccattacagtcatgtcatttgagtttttatgtggaccgccactccgtgctccttgctgcttactatactggcaattgctggagaagattttgcaattgttgcttctgatactcgattgagtgaagggttttcaattcatacgcgggatagccccaaatgttacaaattaacagacaaaacagtcattggatgcagcggttttcatggagactgtcttacgctgacaaagattattgaagcaagactaaagatgtataagcattccaataataaggccatgactacgggggcaattgctgcaatgctgtctacaatcctgtattcaaggcgcttctttccatactatgtttacaacatcatcggtggacttgatgaagaaggaaagggggctgtatacagctttgatccagtagggtcttaccagagagactccttcaaggctggaggctcagcaagtgccatgctacagcccctgcttgacaaccaggttggttttaagaacatgcagaatgtggagcatgttccgctgtccttggacagagccatgcggctggtgaaagatgtcttcatttctgcggctgagagagatgtgtacactggggacgcactccggatctgcatagtgaccaaagagggcatcagggaggaaactgtttccttaaggaaggactgatctgtgtgctcttatcaccaatcagttcagacctggttgattttgtactttggaactgtaccttggatggttttgtttattaaaagagaaacctgaagtact

SEQ ID NO: 455535 - DNA, 1205 bp, Homo sapiens
tggcgtaacgtccggtcaaggcagccatctcgccgtgagacagcaagtgtcggatccgcaggcgcagccgtgcgatgttgtcctctacagccatgtattcggctcctggcagagacttggggatggaaccgcacagagccgcgggccctttgcagctgcgattttcgccctacgttttcaacggagggtaaaaaccccagagagctgcggctttcactttcgcccttcccccatctgctgaagcctatttaggagtcaccgccgtgatggcgctgccccgggctcctgcaggcctcagaaccctgagctgagggggtccgcacaaggccggtctccctgccgtcctctcatgccctgtgtttccctcttcaggctcgctttgctcaagtttacttggtgattgcgatacagccttggtttttagggtttcccattacagtcatgtcatttgagtttttatgtggaccgccactccgtgctccttgctgcttactatactggcaattgctggagaagattttgcaattgttgcttctgatactcgattgagtgaagggttttcaattcatacgcgggatagccccaaatgttacaaattaacagacaaaacagtcattggatgcagcggttttcatggagactgtcttacgctgacaaagattattgaagcaagactaaagatgtataagcattccaataataaggccatgactacgggggcaattgctgcaatgctgtctacaatcctgtattcaaggcgcttctttccatactatgtttacaacatcatcggtggacttgatgaagaaggaaagggggctgtatacagctttgatccagtagggtcttaccagagagactccttcaaggctggaggctcagcaagtgccatgctacagcccctgcttgacaaccaggttggttttaagaacatgcagaatgtggagcatgttccgctgtccttggacagagccatgcggctggtgaaagatgtcttcatttctgcggctgagagagatgtgtacactggggacgcactccggatctgcatagtgaccaaagagggcatcagggaggaaactgtttccttaaggaaggactgatctgtgtgctcttatcaccaatcagttcagacctggttgattttgtactttggaactgtaccttggatggttttgtttattaaaagagaaacctgaagtact

SEQ ID NO: 455536 - DNA, 845 bp, Homo sapiens
tggcgtaacgtccggtcaaggcagccatctcgccgtgagacagcaagtgtcggatccgcaggcgcagccgtgcgatgttgtcctctacagccatgtattcggctcctggcagagacttggggatggaaccgcacagagccgcgggccctttgcagctgcgattttcgccctacgttttcaacggaggtactatactggcaattgctggagaagattttgcaattgttgcttctgatactcgattgagtgaagggttttcaattcatacgcgggatagccccaaatgttacaaattaaagattattgaagcaagactaaagatgtataagcattccaataataaggccatgactacgggggcaattgctgcaatgctgtctacaatcctgtattcaaggcgcttctttccatactatgtttacaacatcatcggtggacttgatgaagaaggaaagggggctgtatacagctttgatccagtagggtcttaccagagagactccttcaaggctggaggctcagcaagtgccatgctacagcccctgcttgacaaccaggttggttttaagaacatgcagaatgtggagcatgttccgctgtccttggacagagccatgcggctggtgaaagatgtcttcatttctgcggctgagagagatgtgtacactggggacgcactccggatctgcatagtgaccaaagagggcatcagggaggaaactgtttccttaaggaaggactgatctgtgtgctcttatcaccaatcagttcagacctggttgattttgtactttggaactgtaccttggatggttttgtttattaaaagagaaacctgaagtact

SEQ ID NO: 455537 - DNA, 838 bp, Homo sapiens
tggcgtaacgtccggtcaaggcagccatctcgccgtgagacagcaagtgtcggatccgcaggcgcagccgtgcgatgttgtcctctacagccatgtattcggctcctggcagagacttggggatggaaccgcacagagccgcgggccctttgcagctgcgattttcgccctacgttttcaacggaggtactatactggcaattgctggagaagattttgcaattgttgcttctgatactcgattgagtgaagggttttcaattcatacgcgggatagccccaaatgttacaaattttttatcaataattgcagatgtataagcattccaataataaggccatgactacgggggcaattgctgcaatgctgtctacaatcctgtattcaaggcgcttctttccatactatgtttacaacatcatcggtggacttgatgaagaaggaaagggggctgtatacagctttgatccagtagggtcttaccagagagactccttcaaggctggaggctcagcaagtgccatgctacagcccctgcttgacaaccaggttggttttaagaacatgcagaatgtggagcatgttccgctgtccttggacagagccatgcggctggtgaaagatgtcttcatttctgcggctgagagagatgtgtacactggggacgcactccggatctgcatagtgaccaaagagggcatcagggaggaaactgtttccttaaggaaggactgatctgtgtgctcttatcaccaatcagttcagacctggttgattttgtactttggaactgtaccttggatggttttgtttattaaaagagaaacctgaagtact

SEQ ID NO: 455538 - DNA, 663 bp, Homo sapiens
  misc_feature (18)..(19): n is a, c, g, or t
  misc_feature (44)..(44): n is a, c, g, or t
tacggcggcgcgccgcgnncgggcggcgggcgcgcccacgcggnagcccgacgtgcaagttcgcggcggacagacgaggacgcgcgggcccatggagacggtctcacgctgacaccgatccgcgaagcaagactaaagatgtataagcattccaataataaggccatgactacgggggcaattgctgcaatgctgtctacaatcctgtattcaaggcgcttctttccatactatgtttacaacatcatcggtggacttgatgaagaaggaaagggggctgtatacagctttgatccagtagggtcttaccagagagactccttcaaggctggaggctcagcaagtgccatgctacagcccctgcttgacaaccaggttggttttaagaacatgcagaatgtggagcatgttccgctgtccttggacagagccatgcggctggtgaaagatgtcttcatttctgcggctgagagagatgtgtacactggggacgcactccggatctgcatagtgaccaaagagggcatcagggaggaaactgtttccttaaggaaggactgatctgtgtgctcttatcaccaatcagttcagacctggttgattttgtactttggaactgtaccttggatggttttgtttattaaaagagaaacctgaagtact

SEQ ID NO: 455539 - DNA, 868 bp, Homo sapiens
tggcgtaacgtccggtcaaggcagccatctcgccgtgagacagcaagtgtcggatccgcaggcgcagccgtgcgatgttgtcctctacagccatgtattcggctcctggcagagacttggggatggaaccgcacagagccgcgggccctttgcagctgcgattttcgccctacgttttcaacggaggtactatactggcaattgctggagaagattttgcaattgttgcttctgatactcgattgagtgaagggttttcaattcatacgcgggatagccccaaatgttacaaattaacagacaaaacagtcattggatgcagcggttttcatggagactgtcttacgctgacaaagattattgaagcaagactaaagatgtataagcattccaataataaggccatgactacgggggcaattgctgcaatgctgtctacaatcctgtattcaaggcgcttctttccatactatgtttacaacatcatcggtggacttgatgaagaaggaaagggggctgtatacagctttgatccagtagggtcttaccagagagactccttcaaggctggaggctcagcaagtgccatgctacagcccctgcttgacaaccaggacacggcaacgcgaccctcgccaaatgctgttgcctggatcttggactccctggcctccgtaatgatctaaggtcacacattgcctccttgcattaaggagaaaacgagaatgctctaatggcctttgagttaaggaaagttggcggatgacaaatgtgattcctctgcactctctgagacccaagtctgctccccggtgcctcacagaggacatgccccagggcccgcggggcctgcatccagcagtgccca

SEQ ID NO: 455540 - DNA, 505 bp, Homo sapiens
  misc_feature (6)..(7): n is a, c, g, or t
  misc_feature (10)..(10): n is a, c, g, or t
  misc_feature (21)..(22): n is a, c, g, or t
tcgacnnttntgagcaggccnnaaccgaagcggcacgagataacttctcccactcatatcttcagttcacctaatgaaatgaatggatagcaagagccttaaagtccaaggaaagggggctgtatacagctttgatccagtagggtcttaccagagagactccttcaaggctggaggctcagcaagtgccatgctacagcccctgcttgacaaccaggttggttttaagaacatgcagaatgtggagcatgttccgctgtccttggacagagccatgcggctggtgaaagatgtcttcatttctgcggctgagagagatgtgtacactggggacgcactccggatctgcatagtgaccaaagagggcatcagggaggaaactgtttccttaaggaaggactgatctgtgtgctcttatcaccaatcagttcagacctggttgattttgtactttggaactgtaccttggatggttttgtttattaaaagagaaacctgaagtact

SEQ ID NO: 455541 - DNA, 1172 bp, Homo sapiens
tggcgtaacgtccggtcaaggcagccatctcgccgtgagacagcaagtgtcggatccgcaggcgcagccgtgcgatgttgtcctctacagccatgtattcggctcctggcagagacttggggatggaaccgcacagagccgcgggccctttgcagctgcgattttcgccctacgttttcaacggaggtactatactggcaattgctggagaagattttgcaattgttgcttctgatactcgattgagtgaagggttttcaattcatacgcgggatagccccaaatgttacaaattaacagacaaaacagtcattggatgcagcggttttcatggagactgtcttacgctgacaaagattattgaagcaagactaaagatgtataagcattccaataataaggccatgactacgggggcaattgctgcaatgctgtctacaatcctgtattcaaggcgcttctttccatactatgtttacaacatcatcggtggacttgatgaagaaggaaagggggctgtatacagctttgatccagtagggtcttaccagagagactccttcaaggctggaggctcagcaagtgccatgctacagcccctgcttgacaaccaggttggttttaagaacatgcagaatgtggagcatgttccgctgtccttggacagagccatgcggctggtgaaagatgtcttcatttctgcggctgagagagatgtgtacactggggacgcactccggatctgcatagtgaccaaagagggcatcagggaggaaactgtttccttaaggaaggactgatctgtgtgctcttatcaccaatcagttcagacctggttgattttgtactttggaactgtaccttggatggttttgtttattaaaagagaaacctgaagtactaaaaaaaaaggagcacaaattcatgcgacagacaaaagcaacagagaaaaaaagaagaggggggggctataaaatttccagggggggccaacttatacgtacgccattttgtaacaggggccactaggagagcataataaagaggaggggccgtttaacacttgggtggcaagtctcttggcttggagaccattcggtgtgaacttggacacctcgataggtcggaaaagtatgtttggtacagtctggtgtaatgcagttaaagcggat

SEQ ID NO: 455542 - DNA, 1294 bp, Homo sapiens
ggagtctggaaagcaggggcagatatgggcaggggacagagcgcaggaagggctctgtgctttggctggactgaggggatgtgcctggccatccacaaggagcgattcaggccattcccaggagggtctgttgtgcaccctgacttgctgggttgttttccccccaagacggagtcttgctctgtcacccaggctggagtgcagcggcgcaatctcggctcactgcaacatccgtctcccaggttcaaatgattatcttttcccagcctcctacgtagctgggactacgggcagcaccaccacactcagcaaattttttgtatttttagtagcaatgaggtttcaccatgttggccaggctggtctcgaacttctggcctcaggtgatccacctgcctcggcctcacaaagtgttgggattacaggcgtgagccactgcgtctggcctggcttgctgttcttatttatgaagctcacagtggcacatccatgtgacagaaaccaagtcatctacacagattctgtagggaacaggttcttctgcgcacagtagcgggcagccatttcatcagcaaacgcagcctcccacagagctgatctggtgtggactgccggtgggtttggaatctgggatgtgggatgtgggctcggggtgtggacatggggtcaggtggaccctgcttccatgcagaccctgccacccacaaactgctcggtgttgggcttggtgtttctcttctgtgagtctccgcttcctcttctgtaaagtgcccacctctcggctgcgtgactgacagttgcgtcagtggtgggtggaatgcaccgtgcggcactcagcacccaccgggcaccgacaggtgcagtgtggcaggggaggctggagccgaggccagccctgggctctgtttggactcgcacttcctctcgtgcccgtccacccaggcccgctcttgccggcacctccgtcctgggcccaggaccctgcttggccccggaatgcggcctgagactccgaggcacggggagcactccatggccacaacgagcaggaagctcattttaaaaatggtgccacctccaccttgtttttttcattttttccacagatctaaggtcacacattgcctccttgcattaaggagaaaacgagaatgctctaatggcctttgagttaaggaaagttggcggatgacaaatgtgattcctctgcactctctgagacccaagtctgctccccggtgcctcacagaggacatgccccagggcccgcggggcctgcatccagcagtgccca

SEQ ID NO: 455543 - DNA, 902 bp, Homo sapiens
  misc_feature (51)..(51): n is a, c, g, or t
  misc_feature (66)..(66): n is a, c, g, or t
  misc_feature (68)..(68): n is a, c, g, or t
  misc_feature (76)..(76): n is a, c, g, or t
  misc_feature (85)..(85): n is a, c, g, or t
  misc_feature (88)..(90): n is a, c, g, or t
  misc_feature (93)..(94): n is a, c, g, or t
  misc_feature (128)..(128): n is a, c, g, or t
  misc_feature (133)..(133): n is a, c, g, or t
  misc_feature (139)..(139): n is a, c, g, or t
  misc_feature (143)..(143): n is a, c, g, or t
  misc_feature (146)..(148): n is a, c, g, or t
  misc_feature (153)..(153): n is a, c, g, or t
  misc_feature (156)..(156): n is a, c, g, or t
  misc_feature (159)..(159): n is a, c, g, or t
  misc_feature (168)..(168): n is a, c, g, or t
  misc_feature (174)..(174): n is a, c, g, or t
cccttctcgcgcccctccgcctatttccgcccccctgcttgtttccggttnggttcctggggtttntnggtttgtntttttgggngcnnntgnnttcatggttggggtttcatatagttttttatttngggtnagatanggtnttnnnctttncanctnctattttcnccctanttttcaacttatttactatactggcaattgctggagaagattttgcaattgttgcttctgatactcgattgagtgaagggttttcaattcatacgcgggatagccccaaatgttacaaattaacagacaaaacagtcattggatgcagcggttttcatggagactgtcttacgctgacaaagattattgaagcaagactaaagatgtataagcattccaataataaggccatgactacgggggcaattgctgcaatgctgtctacaatcctgtattcaaggcgcttctttccatactatgtttacaacatcatcggtggacttgatgaagaaggaaagggggctgtatacagctttgatccagtagggtcttaccagagagactccttcaaggctggaggctcagcaagtgccatgctacagcccctgcttgacaaccaggttggttttaagaacatgcagaatgtggagcatgttccgctgtccttggacagagccatgcggctggtgaaagatgtcttcatttctgcggctgagagagatgtgtacactggggacgcactccggatctgcatagtgaccaaagagggcatcagggaggaaactgtttccttaaggaaggactgatctgtgtgctcttatcaccaatcagttcagacctggttgattttgtactttggaactgtaccttggatggttttgtttattaaaagagaaacctgaagtact

SEQ ID NO: 455544 - DNA, 794 bp, Homo sapiens
tggcgtaacgtccggtcaaggcagccatctcgccgtgagacagcaagtgtcggatccgcaggcgcagccgtgcgatgttgtcctctacagccatgtattcggctcctggcagagacttggggatggaaccgcacagagccgcgggccctttgcagctgcgattttcgccctacgttttcaacggaggaacagacaaaacagtcattggatgcagcggttttcatggagactgtcttacgctgacaaagattattgaagcaagactaaagatgtataagcattccaataataaggccatgactacgggggcaattgctgcaatgctgtctacaatcctgtattcaaggcgcttctttccatactatgtttacaacatcatcggtggacttgatgaagaaggaaagggggctgtatacagctttgatccagtagggtcttaccagagagactccttcaaggctggaggctcagcaagtgccatgctacagcccctgcttgacaaccaggttggttttaagaacatgcagaatgtggagcatgttccgctgtccttggacagagccatgcggctggtgaaagatgtcttcatttctgcggctgagagagatgtgtacactggggacgcactccggatctgcatagtgaccaaagagggcatcagggaggaaactgtttccttaaggaaggactgatctgtgtgctcttatcaccaatcagttcagacctggttgattttgtactttggaactgtaccttggatggttttgtttattaaaagagaaacctgaagtact

SEQ ID NO: 455545 - DNA, 847 bp, Homo sapiens
tggcgtaacgtccggtcaaggcagccatctcgccgtgagacagcaagtgtcggatccgcaggcgcagccgtgcgatgttgtcctctacagccatgtattcggctcctggcagagacttggggatggaaccgcacagagccgcgggccctttgcagctgcgattttcgccctacgttttcaacggaggtactatactggcaattgctggagaagattttgcaattgttgcttctgatactcgattgagtgaagggttttcaattcatacgcgggatagccccaaatgttacaaattaacagacaaaacagtcattggatgcagcggttttcatggagactgtcttacgctgacaaagattattgaagcaagactaaagatgtataagcattccaataataaggccatgactacgggggcaattgctgcaatgctgtctacaatcctgtattcaaggcgcttctttccatactatgtttacaacatcatcggtggacttgatgaagaaggaaagggggctgtatacagctttgatccagtagggtcttaccagagagactccttcaaggctggaggctcagcaagtgccatgctacagcccctgcttgacaaccaggttggttttaagaacatgcagaatgtggagcatgttccgctgtccttggacagagccatgcggctgtccggatctgcatagtgaccaaagagggcatcagggaggaaactgtttccttaaggaaggactgatctgtgtgctcttatcaccaatcagttcagacctggttgattttgtactttggaactgtaccttggatggttttgtttattaaaagagaaacctgaagtact

SEQ ID NO: 455546 - DNA, 1159 bp, Homo sapiens
agcgcctgtgggagccctggagggaactttcccagtccccgaggcggatcgggtgttgcatccatggagcgagctgagagctcgaggtgagcggggctcgcagtcttccggtgtcccctctcgcgcgccctctttgagacccacggcattccaacctccctggaaatggggggaacatggccgaggcgcgtggcgaggcagccccctggaggccccggagtggcgacctcagtgttgcagcgatctcgtgccccttgggtgcgccttgaggccgaggcaagctccttcggggtcctgggctgcgggcaaaggattcggccctgtgaggagttgggttcggcctgtcccagacaggccttgcccacatcccatcacagggccgtggacttgaagcgggagcgtgaaatccccatagactgaatgcatttcctttctacctgttctctctccccttttatttttatttttatagtattttatttttaattttttctcttgtagagacggggatttcgctgcgttgcccagggtggtctcgaacgcctgagctcaagcaatccgcccgccttggcccctcaaagtgctggaattggaggcgtgatgcaccgtgcctggcctttttaaaaaattaaggttattttggggacggtagagcgtccagacacatccttatttgcatagctgcgcagtttttaaaaatgcaatacgtttctacctgttaggatgtgtgatttctggctggtaagctacaccgaatcttggctagcacatttgcattccatgtcagatttgtaaacgcaaatttgctctctgcatttaaatatattagatatatttaggtaactacatttaaatgtattgagacatttaaataaatttggggtctgtgtctaaatgcgctccctcctcaaaataaatatctgaagtgggccgagagcggtgactcacgcctataatcccagcactttgggaggccaaggcgggtggatcatgaagtcaggagttcatgaccagcctggccaacatggtgaaatccgtttctactaaaaatacaaaaattaactgggcatgatggcgggagcctgtaatcctagctactttggaggctgaggcaggagaatcgctggaacccaggaggcggaggttgcagtgagctgag

SEQ ID NO: 455547 - DNA, 725 bp, Homo sapiens
ggtggagctgagggtggaaggggagtgagctgacgctcggaaggtgtcttgagattatcatcggctgagggtggaagcggcccccgcagacgctcggcaggtgtcttgatattatcatctgctgagggtggagctgagggtggaaggggagtgagctgacgctcggaaggtgtcttgagattatcatcggctgagggtggaggcggtgccaccttgaaggagccacaaggagcctgatttcacagaagggtggagggctgagatctagaacctaggcttctctgggggaaggtttttcagggaaggtagtttttgagctgtaatcttgtccagccttattttagagaagaatgcttctgaagagctgccattctgacgtcaaaaaactactaaaacgttgaaccattgtgtctcacactcaggtgatgattgggactgctcttaacacaagcgagatgaagaaactgatcacccacatgggggagatggaccacccctggaactgtccccatggaaggccaaccatgagacacatcgccaacctgggtgtcatttctcagaactgaccgtagtcactgtatggaataattggttttatcgcagatttttatgttttgaaagacagagtcttcactaaccttttttgttttaaaatgaacctgctacttaaaaaaaatacacatcacacccatttaaaagtgatcttgagaaccttttcaaaccag

SEQ ID NO: 455548 - DNA, 2768 bp, Homo sapiens
agcgcctgtgggagccctggagggaactttcccagtccccgaggcggatcgggtgttgcatccatggagcgagctgagagctcgagtacagaacctgctaaggccatcaaacctattgatcggaagtcagtccatcagatttgctctgggcaggtggtactgagtctaagcactgcggtaaaggagttagtagaaaacagtctggatgctggtgccactaatattgatctaaagcttaaggactatggagtggatcttattgaagtttcagacaatggatgtggggtagaagaagaaaacttcgaaggcttaactctgaaacatcacacatctaagattcaagagtttgccgacctaactcaggttgaaacttttggctttcggggggaagctctgagctcactttgtgcactgagcgatgtcaccatttctacctgccacgcatcggcgaaggttggaactcgactgatgtttgatcacaatgggaaaattatccagaaaaccccctacccccgccccagagggaccacagtcagcgtgcagcagttattttccacactacctgtgcgccataaggaatttcaaaggaatattaagaaggagtatgccaaaatggtccaggtcttacatgcatactgtatcatttcagcaggcatccgtgtaagttgcaccaatcagcttggacaaggaaaacgacagcctgtggtatgcacaggtggaagccccagcataaaggaaaatatcggctctgtgtttgggcagaagcagttgcaaagcctcattccttttgttcagctgccccctagtgactccgtgtgtgaagagtacggtttgagctgttcggatgctctgcataatcttttttacatctcaggtttcatttcacaatgcacgcatggagttggaaggagttcaacagacagacagtttttctttatcaaccggcggccttgtgacccagcaaaggtctgcagactcgtgaatgaggtctaccacatgtataatcgacaccagtatccatttgttgttcttaacatttctgttgattcagaatgcgttgatatcaatgttactccagataaaaggcaaattttgctacaagaggaaaagcttttgttggcagttttaaagacctctttgataggaatgtttgatagtgatgtcaacaagctaaatgtcagtcagcagccactgctggatgttgaaggtaacttaataaaaatgcatgcagcggatttggaaaagcccatggtagaaaagcaggatcaatccccttcattaaggactggagaagaaaaaaaagacgtgtccatttccagactgcgagaggccttttctcttcgtcacacaacagagaacaagcctcacagcccaaagactccagaaccaagaaggagccctctaggacagaaaaggggtatgctgtcttctagcacttcaggtgccatctctgacaaaggcgtcctgagacctcagaaagaggcagtgagttccagtcacggacccagtgaccctacggacagagcggaggtggagaaggactcggggcacggcagcacttccgtggattctgaggggttcagcatcccagacacgggcagtcactgcagcagcgagtatgcggccagctccccaggggacaggggctcgcaggaacatgtggactctcaggagaaagcgcctgaaactgacgactctttttcagatgtggactgccattcaaaccaggaagataccggatgtaaatttcgagttttgcctcagccaactaatctcgcaaccccaaacacaaagcgttttaaaaaagaagaaattctttccagttctgacatttgtcaaaagttagtaaatactcaggacatgtcagcctctcaggttgatgtagctgtgaaaattaataagaaagttgtgcccctggacttttctatgagttctttagctaaacgaataaagcagttacatcatgaagcacagcaaagtgaaggggaacagaattacaggaagtttagggcaaagatttgtcctggagaaaatcaagcagccgaagatgaactaagaaaagagataagtaaaacgatgtttgcagaaatggaaatcattggtcagtttaacctgggatttataataaccaaactgaatgaggatatcttcatagtggaccagcatgccacggacgagaagtataacttcgagatgctgcagcagcacaccgtgctccaggggcagaggctcatagcacctcagactctcaacttaactgctgttaatgaagctgttctgatagaaaatctggaaatatttagaaagaatggctttgattttgttatcgatgaaaatgtaaaaactggaccttcggaccccaggacgtcgatgaactgatcttcatgctgagcgacagccctggggtcatgtgccggccttcccgagtcaagcagatgtttgcctccagagcctgccggaagtcggtgatgattgggactgctcttaacacaagcgagatgaagaaactgatcacccacatgggggagatggaccacccctggaactgtccccatggaaggccaaccatgagacacatcgccaacctgggtgtcatttctcagaactgaccgtagtcactgtatggaataattggttttatcgcagatttttatgttttgaaagacagagtcttcactaaccttttttgttttaaaatgaacctgctacttaaaaaaaatacacatcacacccatttaaaagtgatcttgagaaccttttcaaaccag

SEQ ID NO: 455549 - DNA, 2710 bp, Homo sapiens
agcgcctgtgggagccctggagggaactttcccagtccccgaggcggatcgggtgttgcatccatggagcgagctgagagctcgagtacagaacctgctaaggccatcaaacctattgatcggaagtcagtccatcagatttgctctgggcaggtggtactgagtctaagcactgcggtaaaggagttagtagaaaacagtctggatgctggtgccactaatattgatctaaagcttaaggactatggagtggatcttattgaagtttcagacaatggatgtggggtagaagaagaaaacttcgaaggcttaactctgaaacatcacacatctaagattcaagagtttgccgacctaactcaggttgaaacttttggctttcggggggaagctctgagctcactttgtgcactgagcgatgtcaccatttctacctgccacgcatcggcgaaggttggaactcgactgatgtttgatcacaatgggaaaattatccagaaaaccccctacccccgccccagagggaccacagtcagcgtgcagcagttattttccacactacctgtgcgccataaggaatttcaaaggaatattaagaaggagtatgccaaaatggtccaggtcttacatgcatactgtatcatttcagcaggcatccgtgtaagttgcaccaatcagcttggacaaggaaaacgacagcctgtggtatgcacaggtggaagccccagcataaaggaaaatatcggctctgtgtttgggcagaagcagttgcaaagcctcattccttttgttcagctgccccctagtgactccgtgtgtgaagagtacggtttgagctgttcggatgctctgcataatcttttttacatctcaggtttcatttcacaatgcacgcatggagttggaaggagttcaacagacagacagtttttctttatcaaccggcggccttgtgacccagcaaaggtctgcagactcgtgaatgaggtctaccacatgtataatcgacaccagtatccatttgttgttcttaacatttctgttgattcagaatgcgttgatatcaatgttactccagataaaaggcaaattttgctacaagaggaaaagcttttgttggcagttttaaagacctctttgataggaatgtttgatagtgatgtcaacaagctaaatgtcagtcagcagccactgctggatgttgaaggtaacttaataaaaatgcatgcagcggatttggaaaagcccatggtagaaaagcaggatcaatccccttcattaaggactggagaagaaaaaaaagacgtgtccatttccagactgcgagaggccttttctcttcgtcacacaacagagaacaagcctcacagcccaaagactccagaaccaagaaggagccctctaggacagaaaaggggtatgctgtcttctagcacttcaggtgccatctctgacaaaggcgtcctgagacctcagaaagaggcagtgagttccagtcacggacccagtgaccctacggacagagcggaggtggagaaggactcggggcacggcagcacttccgtggattctgaggggttcagcatcccagacacgggcagtcactgcagcagcgagtatgcggccagctccccaggggacaggggctcgcaggaacatgtggactctcaggagaaagcgcctgaaactgacgactctttttcagatgtggactgccattcaaaccaggaagataccggatgtaaatttcgagttttgcctcagccaactaatctcgcaaccccaaacacaaagcgttttaaaaaagaagaaattctttccagttctgacatttgtcaaaagttagtaaatactcaggacatgtcagcctctcaggttgatgtagctgtgaaaattaataagaaagttgtgcccctggacttttctatgagttctttagctaaacgaataaagcagttacatcatgaagcacagcaaagtgaaggggaacagaattacaggaagtttagggcaaagatttgtcctggagaaaatcaagcagccgaagatgaactaagaaaagagataagtaaaacgatgtttgcagaaatggaaatcattggtcagtttaacctgggatttataataaccaaactgaatgaggatatcttcatagtggaccagcatgccacggacgagaagtataacttcgagatgctgcagcagcacaccgtgctccaggggcagaggctcatagcctccagtcactgaaagggctaaactgatttccttgccaactagtaaaaactggaccttcggaccccaggacgtcgatgaactgatcttcatgctgagcgacagccctggggtcatgtgccggccttcccgagtcaagcagatgtttgcctccagagcctgccggaagtcggtgatgattgggactgctcttaacacaagcgagatgaagaaactgatcacccacatgggggagatggaccacccctggaactgtccccatggaaggccaaccatgagacacatcgccaacctgggtgtcatttctcagaactgaccgtagtcactgtatggaataattggttttatcgcagatttttatgttttgaaagacagagtcttcactaaccttttttgttttaaaatgaacctgctacttaaaaaaaatacacatcacacccatttaaaagtgatcttgagaaccttttcaaaccag

SEQ ID NO: 455550 - DNA, 2122 bp, Homo sapiens
agcgcctgtgggagccctggagggaactttcccagtccccgaggcggatcgggtgttgcatccatggagcgagctgagagctcgagtacagaacctgctaaggccatcaaacctattgatcggaagtcagtccatcagatttgctctgggcaggtggtactgagtctaagcactgcggtaaaggagttagtagaaaacagtctggatgctggtgccactaatattgatctaaagcttaaggactatggagtggatcttattgaagtttcagacaatggatgtggggtagaagaagaaaacttcgaaggcttaactctgaaacatcacacatctaagattcaagagtttgccgacctaactcaggttgaaacttttggctttcggggggaagctctgagctcactttgtgcactgagcgatgtcaccatttctacctgccacgcatcggcgaaggttggaactcgactgatgtttgatcacaatgggaaaattatccagaaaaccccctacccccgccccagagggaccacagtcagcgtgcagcagttattttccacactacctgtgcgccataaggaatttcaaaggaatattaagaaggagtatgccaaaatggtccaggtcttacatgcatactgtatcatttcagcaggcatccgtgtaagttgcaccaatcagcttggacaaggaaaacgacagcctgtggtatgcacaggtggaagccccagcataaaggaaaatatcggctctgtgtttgggcagaagcagttgcaaagcctcattccttttgttcagctgccccctagtgactccgtgtgtgaagagtacggtttgagctgttcggatgctctgcataatcttttttacatctcaggtttcatttcacaatgcacgcatggagttggaaggagttcaacagacagacagtttttctttatcaaccggcggccttgtgacccagcaaaggtctgcagactcgtgaatgaggtctaccacatgtataatcgacaccagtatccatttgttgttcttaacatttctgttgattcagaatgcgttgatatcaatgttactccagataaaaggcaaattttgctacaagaggaaaagcttttgttggcagttttaaagacctctttgataggaatgtttgatagtgatgtcaacaagctaaatgtcagtcagcagccactgctggatgttgaaggtaacttaataaaaatgcatgcagcggatttggaaaagcccatggtagaaaagcaggatcaatccccttcattaaggactggagaagaaaaaaaagacgtgtccatttccagactgcgagaggccttttctcttcgtcacacaacagagaacaagcctcacagcccaaagactccagaaccaagaaggagccctctaggacagaaaaggggtatgctgtcttctagcacttcaggtgccatctctgacaaaggcgtcctgagacctcagaaagaggcagtgagttccagtcacggacccagtgaccctacggacagagcggaggtggagaaggactcggggcacggcagcacttccgtggattctgaggggttcagcatcccagacacgggcagtcactgcagcagcgagtatgcggccagctccccaggggacaggggctcgcaggaacatgtggactctcaggagaaagcgcctgaaactgacgactctttttcagatgtggactgccattcaaaccaggaagataccggatgtaaatttcgagttttgcctcagccaactaatctcgcaaccccaaacacaaagcgttttaaaaaagaagaaattctttccagttctgacatttgtcaaaagttagtaaatactcaggacatgtcagcctctcaggttgatgtagctgtgaaaattaataagaaagttgtgcccctggacttttctatgagttctttagctaaacgaataaagcagttacatcatgaagcacagcaaagtgaaggggaacagaattacaggaagtttagggcaaagatttgtcctggagaaaatcaagcagccgaagatgaactaagaaaagagataagtaaaacgatgtttgcaaaatggaaatcattgccttatcgagggtaccgagctg

SEQ ID NO: 455551 - DNA, 2103 bp, Homo sapiens
gtactataagagaccgagataaagaagggaggagaataaaaaggtatataccgattctaatctttctgagacagagtgttgctctgtcacccaggctggagagcagtggtggcatcttggctcactgcaacctctgcctcccgggctaaagggattctcgtgcctcagcctcccaagtagctgggatgacagatatgccaccacacccggctaatttttgtatttttagtagaaacagggttttaccatgttgtccagaccagtcctgaactcctagcctcatgtgatccccctgccttggcctcctaaagtgctgggataacaggcgtaagccaccacacctggcccatattatagttttattttgaacattgaactgtgttcatctgtgtaattagcatgtggatctcctcttttgtgaagtatctgttcacataagcacgtcctctcaccatttcaggatagtccctgaccctcttctccgtccacgtttgcttaggtaacttaataaaaatgcatgcagcggatttggaaaagcccatggtagaaaagcaggatcaatccccttcattaaggactggagaagaaaaaaaagacgtgtccatttccagactgcgagaggccttttctcttcgtcacacaacagagaacaagcctcacagcccaaagactccagaaccaagaaggagccctctaggacagaaaaggggtatgctgtcttctagcacttcaggtgccatctctgacaaaggcgtcctgagacctcagaaagaggcagtgagttccagtcacggacccagtgaccctacggacagagcggaggtggagaaggactcggggcacggcagcacttccgtggattctgaggggttcagcatcccagacacgggcagtcactgcagcagcgagtatgcggccagctccccaggggacaggggctcgcaggaacatgtggactctcaggagaaagcgcctgaaactgacgactctttttcagatgtggactgccattcaaaccaggaagataccggatgtaaatttcgagttttgcctcagccaactaatctcgcaaccccaaacacaaagcgttttaaaaaagaagaaattctttccagttctgacatttgtcaaaagttagtaaatactcaggacatgtcagcctctcaggttgatgtagctgtgaaaattaataagaaagttgtgcccctggacttttctatgagttctttagctaaacgaataaagcagttacatcatgaagcacagcaaagtgaaggggaacagaattacaggaagtttagggcaaagatttgtcctggagaaaatcaagcagccgaagatgaactaagaaaagagataagtaaaacgatgtttgcagaaatggaaatcattggtcagtttaacctgggatttataataaccaaactgaatgaggatatcttcatagtggaccagcatgccacggacgagaagtataacttcgagatgctgcagcagcacaccgtgctccaggggcagaggctcatagcacctcagactctcaacttaactgctgttaatgaagctgttctgatagaaaatctggaaatatttagaaagaatggctttgattttgttatcgatgaaaatgctccagtcactgaaagggctaaactgatttccttgccaactagtaaaaactggaccttcggaccccaggacgtcgatgaactgatcttcatgctgagcgacagccctggggtcatgtgccggccttcccgagtcaagcagatgtttgcctccagagcctgccggaagtcggtgatgattgggactgctcttaacacaagcgagatgaagaaactgatcacccacatgggggagatggaccacccctggaactgtccccatggaaggccaaccatgagacacatcgccaacctgggtgtcatttctcagaactgaccgtagtcactgtatggaataattggttttatcgcagatttttatgttttgaaagacagagtcttcactaaccttttttgttttaaaatgaacctgctacttaaaaaaaatacacatcacacccatttaaaagtgatcttgagaaccttttcaaaccag

SEQ ID NO: 455552 - DNA, 334 bp, Homo sapiens
cacatcagttttggacgcactgcatcacctgtggtgcattggttgactgtaggagctttagaatattccagaaggtttggttctttgatgactcatcaagatttggagcacagatacccgtgaactgcaatagtgatccttatcagcatgtcacctggtgttttgttttcatttcactttaagaatgtgccatgtgatcgtatttctaatccctttcactctggaatcctgcccttaccatattaatgttgaatagcatctcaggtttcatttcacaatgcacgcatggagttggaaggagttcaacagacagacagtttttctttatcaaccg

SEQ ID NO: 455553 - DNA, 2811 bp, Homo sapiens
agcgcctgtgggagccctggagggaactttcccagtccccgaggcggatcgggtgttgcatccatggagcgagctgagagctcgagtacagaacctgctaaggccatcaaacctattgatcggaagtcagtccatcagatttgctctgggcaggtggtactgagtctaagcactgcggtaaaggagttagtagaaaacagtctggatgctggtgccactaatattgatctaaagcttaaggactatggagtggatcttattgaagtttcagacaatggatgtggggtagaagaagaaaacttcgaaggcttaactctgaaacatcacacatctaagattcaagagtttgccgacctaactcaggttgaaacttttggctttcggggggaagctctgagctcactttgtgcactgagcgatgtcaccatttctacctgccacgcatcggcgaaggttggaactcgactgatgtttgatcacaatgggaaaattatccagaaaaccccctacccccgccccagagggaccacagtcagcgtgcagcagttattttccacactacctgtgcgccataaggaatttcaaaggaatattaagaaggagtatgccaaaatggtccaggtcttacatgcatactgtatcatttcagcaggcatccgtgtaagttgcaccaatcagcttggacaaggaaaacgacagcctgtggtatgcacaggtggaagccccagcataaaggaaaatatcggctctgtgtttgggcagaagcagttgcaaagcctcattccttttgttcagctgccccctagtgactccgtgtgtgaagagtacggtttgagctgttcggatgctctgcataatcttttttacatctcaggtttcatttcacaatgcacgcatggagttggaaggagttcaacagacagacagtttttctttatcaaccggcggccttgtgacccagcaaaggtctgcagactcgtgaatgaggtctaccacatgtataatcgacaccagtatccatttgttgttcttaacatttctgttgattcagaatgcgttgatatcaatgttactccagataaaaggcaaattttgctacaagaggaaaagcttttgttggcagttttaaagacctctttgataggaatgtttgatagtgatgtcaacaagctaaatgtcagtcagcagccactgctggatgttgaaggtaacttaataaaaatgcatgcagcggatttggaaaagcccatggtagaaaagcaggatcaatccccttcattaaggactggagaagaaaaaaaagacgtgtccatttccagactgcgagaggccttttctcttcgtcacacaacagagaacaagcctcacagcccaaagactccagaaccaagaaggagccctctaggacagaaaaggggtatgctgtcttctagcacttcaggtgccatctctgacaaaggcgtcctgagacctcagaaagaggcagtgagttccagtcacggacccagtgaccctacggacagagcggaggtggagaaggactcggggcacggcagcacttccgtggattctgaggggttcagcatcccagacacgggcagtcactgcagcagcgagtatgcggccagctccccaggggacaggggctcgcaggaacatgtggactctcaggagaaagcgcctgaaactgacgactctttttcagatgtggactgccattcaaaccaggaagataccggatgtaaatttcgagttttgcctcagccaactaatctcgcaaccccaaacacaaagcgttttaaaaaagaagaaattctttccagttctgacatttgtcaaaagttagtaaatactcaggacatgtcagcctctcaggttgatgtagctgtgaaaattaataagaaagttgtgcccctggacttttctatgagttctttagctaaacgaataaagcagttacatcatgaagcacagcaaagtgaaggggaacagaattacaggaagtttagggcaaagatttgtcctggagaaaatcaagcagccgaagatgaactaagaaaagagataagtaaaacgatgtttgcagaaatggaaatcattggtcagtttaacctgggatttataataaccaaactgaatgaggatatcttcatagtggaccagcatgccacggacgagaagtataacttcgagatgctgcagcagcacaccgtgctccaggggcagaggctcatagcacctcagactctcaacttaactgctgttaatgaagctgttctgatagaaaatctggaaatatttagaaagaatggctttgattttgttatcgatgaaaatgctccagtcactgaaagggctaaactgatttccttgccaactagtaaaaactggaccttcggaccccaggacgtcgatgaactgatcttcatgctgagcgacagccctggggtcatgtgccggccttcccgagtcaagcagatgtttgcctccagagcctgccggaagtcggtgatgattgggactgctcttaacacaagcgagatgaagaaactgatcacccacatgggggagatggaccacccctggaactgtccccatggaaggccaaccatgagacacatcgccaacctgggtgtcatttctcagaactgaccgtagtcactgtatggaataattggttttatcgcagatttttatgttttgaaagacagagtcttcactaaccttttttgttttaaaatgaacctgctacttaaaaaaaatacacatcacacccatttaaaagtgatcttgagaaccttttcaaaccag

SEQ ID NO: 455554 - DNA, 2844 bp, Homo sapiens
agcgcctgtgggagccctggagggaactttcccagtccccgaggcggatcgggtgttgcatccatggagcgagctgagagctcgagtacagaacctgctaaggccatcaaacctattgatcggaagtcagtccatcagatttgctctgggcaggtggtactgagtctaagcactgcggtaaaggagttagtagaaaacagtctggatgctggtgccactaatattgatctaaagcttaaggactatggagtggatcttattgaagtttcagacaatggatgtggggtagaagaagaaaacttcgaaggcttaactctgaaacatcacacatctaagattcaagagtttgccgacctaactcaggttgaaacttttggctttcggggggaagctctgagctcactttgtgcactgagcgatgtcaccatttctacctgccacgcatcggcgaaggttggaactcgactgatgtttgatcacaatgggaaaattatccagaaaaccccctacccccgccccagagggaccacagtcagcgtgcagcagttattttccacactacctgtgcgccataaggaatttcaaaggaatattaagaaggagtatgccaaaatggtccaggtcttacatgcatactgtatcatttcagcaggcatccgtgtaagttgcaccaatcagcttggacaaggaaaacgacagcctgtggtatgcacaggtggaagccccagcataaaggaaaatatcggctctgtgtttgggcagaagcagttgcaaagcctcattccttttgttcagctgccccctagtgactccgtgtgtgaagagtacggtttgagctgttcggatgctctgcataatcttttttacatctcaggtttcatttcacaatgcacgcatggagttggaaggagttcaacagacagacagtttttctttatcaaccggcggccttgtgacccagcaaaggtctgcagactcgtgaatgaggtctaccacatgtataatcgacaccagtatccatttgttgttcttaacatttctgttgattcagaatgcgttgatatcaatgttactccagataaaaggcaaattttgctacaagaggaaaagcttttgttggcagttttaaagacctctttgataggaatgtttgatagtgatgtcaacaagctaaatgtcagtcagcagccactgctggatgttgaaggtaacttaataaaaatgcatgcagcggatttggaaaagcccatggtagaaaagcaggatcaatccccttcattaaggactggagaagaaaaaaaagacgtgtccatttccagactgcgagaggccttttctcttcgtcacacaacagagaacaagcctcacagcccaaagactccagaaccaagaaggagccctctaggacagaaaaggggtatgctgtcttctagcacttcaggtgccatctctgacaaaggcgtcctgagacctcagaaagaggcagtgagttccagtcacggacccagtgaccctacggacagagcggaggtggagaaggactcggggcacggcagcacttccgtggattctgaggggttcagcatcccagacacgggcagtcactgcagcagcgagtatgcggccagctccccaggggacaggggctcgcaggaacatgtggactctcaggagaaagcgcctgaaactgacgactctttttcagatgtggactgccattcaaaccaggaagataccggatgtaaatttcgagttttgcctcagccaactaatctcgcaaccccaaacacaaagcgttttaaaaaagaagaaattctttccagttctgacatttgtcaaaagttagtaaatactcaggacatgtcagcctctcaggttgatgtagctgtgaaaattaataagaaagttgtgcccctggacttttctatgagttctttagctaaacgaataaagcagttacatcatgaagcacagcaaagtgaaggggaacagaattacaggaagtttagggcaaagatttgtcctggagaaaatcaagcagccgaagatgaactaagaaaagagataagtaaaacgatgtttgcagaaatggaaatcattggtcagtttaacctgggatttataataaccaaactgaatgaggatatcttcatagtggaccagcatgccacggacgagaagtataacttcgagatgctgcagcagcacaccgtgctccaggggcagaggctcatagcacctcagactctcaacttaactgctgttaatgaagctgttctgatagaaaatctggaaatatttagaaagaatggctttgattttgttatcgatgaaaatgtcatggatttttctcaaaattgtattcttttagctccagtcactgaaagggctaaactgatttccttgccaactagtaaaaactggaccttcggaccccaggacgtcgatgaactgatcttcatgctgagcgacagccctggggtcatgtgccggccttcccgagtcaagcagatgtttgcctccagagcctgccggaagtcggtgatgattgggactgctcttaacacaagcgagatgaagaaactgatcacccacatgggggagatggaccacccctggaactgtccccatggaaggccaaccatgagacacatcgccaacctgggtgtcatttctcagaactgaccgtagtcactgtatggaataattggttttatcgcagatttttatgttttgaaagacagagtcttcactaaccttttttgttttaaaatgaacctgctacttaaaaaaaatacacatcacacccatttaaaagtgatcttgagaaccttttcaaaccag

SEQ ID NO: 455555 - DNA, 1869 bp, Homo sapiens
ttctactccttgtattttgtgcaggtctgcagactcgtgaatgaggtctaccacatgtataatcgacaccagtatccatttgttgttcttaacatttctgttgattcagaatgcgttgatatcaatgttactccagataaaaggcaaattttgctacaagaggaaaagcttttgttggcagttttaaagacctctttgataggaatgtttgatagtgatgtcaacaagctaaatgtcagtcagcagccactgctggatgttgaaggtaacttaataaaaatgcatgcagcggatttggaaaagcccatggtagaaaagcaggatcaatccccttcattaaggactggagaagaaaaaaaagacgtgtccatttccagactgcgagaggccttttctcttcgtcacacaacagagaacaagcctcacagcccaaagactccagaaccaagaaggagccctctaggacagaaaaggggtatgctgtcttctagcacttcaggtgccatctctgacaaaggcgtcctgagacctcagaaagaggcagtgagttccagtcacggacccagtgaccctacggacagagcggaggtggagaaggactcggggcacggcagcacttccgtggattctgaggggttcagcatcccagacacgggcagtcactgcagcagcgagtatgcggccagctccccaggggacaggggctcgcaggaacatgtggactctcaggagaaagcgcctgaaactgacgactctttttcagatgtggactgccattcaaaccaggaagataccggatgtaaatttcgagttttgcctcagccaactaatctcgcaaccccaaacacaaagcgttttaaaaaagaagaaattctttccagttctgacatttgtcaaaagttagtaaatactcaggacatgtcagcctctcaggttgatgtagctgtgaaaattaataagaaagttgtgcccctggacttttctatgagttctttagctaaacgaataaagcagttacatcatgaagcacagcaaagtgaaggggaacagaattacaggaagtttagggcaaagatttgtcctggagaaaatcaagcagccgaagatgaactaagaaaagagataagtaaaacgatgtttgcagaaatggaaatcattggtcagtttaacctgggatttataataaccaaactgaatgaggatatcttcatagtggaccagcatgccacggacgagaagtataacttcgagatgctgcagcagcacaccgtgctccaggggcagaggctcatagcacctcagactctcaacttaactgctgttaatgaagctgttctgatagaaaatctggaaatatttagaaagaatggctttgattttgttatcgatgaaaatgctccagtcactgaaagggctaaactgatttccttgccaactagtaaaaactggaccttcggaccccaggacgtcgatgaactgatcttcatgctgagcgacagccctggggtcatgtgccggccttcccgagtcaagcagatgtttgcctccagagcctgccggaagtcggtgatgattgggactgctcttaacacaagcgagatgaagaaactgatcacccacatgggggagatggaccacccctggaactgtccccatggaaggccaaccatgagacacatcgccaacctgggtgtcatttctcagaactgaccgtagtcactgtatggaataattggttttatcgcagatttttatgttttgaaagacagagtcttcactaaccttttttgttttaaaatgaacctgctacttaaaaaaaatacacatcacacccatttaaaagtgatcttgagaaccttttcaaaccag

SEQ ID NO: 455556 - DNA, 1139 bp, Homo sapiens
  misc_feature (166)..(167): n is a, c, g, or t
  misc_feature (173)..(173): n is a, c, g, or t
  misc_feature (176)..(177): n is a, c, g, or t
  misc_feature (183)..(183): n is a, c, g, or t
gctctgttatcactgctctgcatcagaaagaactgtgtgccatcacattcgggtatagctggattgtcaagatcgtcccgtcttgccatgactgatttcgatggtgtttgctcactgcggcactcgtgtatgcatcgcgagctctacttcttaattgggccataanngggtgngtnnggtgangacaggggaccaagtgggtgggattcagggtggagcagagtcatgggggtggggacagacacgctgatgcacacgggagtgccacagtcccaaggcaggtgtttgcgtgatgggcctgtgcaagaggaagggagtagcagtgcagctggggtgaggaagggaggcattcgtgcttggaggtgggggtgcaggcacagcccagcgagggccaagtcaggggacagacgggggcttttattcaggtgagggggagagctgtgaagtggaatgaataacctgacagccctttaaaagtaatcactggctgctgagtggagagcggctcggaggggtcgcagtggggcagggaggcctgctgggaggctgctgcacctgccagggtgagagggcagggtggctgctgagacaggtgtggtcggcgtctggagtggaggcggtgccaccttgaaggagccacaaggagcctgatttcacagaagggtggagggctgagatctagaacctaggcttctctgggggaaggtttttcagggaaggtagtttttgagctgtaatcttgtccagccttattttagagaagaatgcttctgaagagctgccattctgacgtcaaaaaactactaaaacgttgaaccattgtgtctcacactcaggtgatgattgggactgctcttaacacaagcgagatgaagaaactgatcacccacatgggggagatggaccacccctggaactgtccccatggaaggccaaccatgagacacatcgccaacctgggtgtcatttctcagaactgaccgtagtcactgtatggaataattggttttatcgcagatttttatgttttgaaagacagagtcttcactaaccttttttgttttaaaatgaacctgctacttaaaaaaaatacacatcacacccatttaaaagtgatcttgagaaccttttcaaaccag

SEQ ID NO: 455557 - DNA, 585 bp, Homo sapiens
aactgtagtcccacaacagtctgaaaataacccagtcaccagatatcttcctcaaatacagagggagaactttctttcacgcctcctttagcctgtcgactccttataataatgcctaaatattccaaattaatactgcctctttaacctgctaattgttttcacaatgttacaagaaaacttggatctgtgcattatcaccatctagtggctaaactcaggcaacacgaacttctaccaaactcaggaaattgctctggaaaaactacaggattttggatttccagaactgccttgaagagacaaagattcttgtaccaagttttggtcaactgcaaatcaaagaacttggttatgcagggaaaacaaatgaggatatctgtacctggaacttttaaacaagattctaatagttatgtgaaaaaagcattcaagatttttgagtaggcacagtggcttacgcctgtaatcctatcactttgcgaaactgaggtggtggaaggatcactgaaggtcgggagttcaagaccagcctggccaatgtggtgaaaccccgtttctcctaaaattaaaaaaaaaaaaaaa

SEQ ID NO: 455558 - DNA, 1682 bp, Homo sapiens
atctgacatcatcatgttaggccaatcaccggacgcgttggtgggaggcctcacggacagcgcgcccggaggaaggaagacaagagagaggaagcttgaagccaatatggagtccgtcagttgctccgctgctgctgtcaggaccggagacatggagtcccagcgggacctgagcctggtgcctgagcggcttcagagacgcgaacaagaacggcagctggaagttgaaaggcggaaacaaaagcggcagaaccaggaggtagagaaggagaacagccactttttcgtcgccacctttgctcgggagcgagcggccgtggaagagcttctggagcgcgcggagtcggtcgagcggctggaggaggcggcctctcggctccaggggctgcagaaactaatcaacgactcagtttttttcctagccgcttacgacctgcggcagggacaagaggcgctggcgcggctgcaggcggccttggccgagcggcgccgggggctgcagcccaagaagcgtttcgctttcaagacccggggaaaggatgctgcttcgtctaccaaagtagacgcggctcctggcatccccccggcagttgaaagcatacaggactccccgctgcccaagaaggcggaaggagacctcggccccagctgggtctgcggtttctccaacctggagtcccaagtcttggagaagagagccagcgagttgcaccagcgcgacgttcttttgaccgaactgagcaactgcacggtcagactgtatggaaatcccaacaccctgcggctaaccaaggcccacagctgcaagctgctctgcggtccggtgtctacctctgttttcctggaggactgcagtgactgcgtgctggcagtggcctgccaacagctccgcatacacagtacgaaagacacccgcatcttcctgcaggtgaccagcagggccatcgtggaggactgcagtgggatccagttcgccccttacacctggagctacccggagatcgacaaggacttcgagagctctggtttagataggagcaaaaataactggaacgatgttgacgattttaactggctggcccgggatatggcctccccaaactggagtattcttcctgaagaggagcgaaatatccagtgggactaagcagttgtcactctgttcttcactcctaccaaatactttccacgttggactttcccccttattgggtctcgaagtttacttattgtcacactgtgtatgttttcagcattttaaggctagagattgtaatgggctcctacttgtaatttccattaaattcgtaacaggtataacactaaagcatttttgctattttcgtcatgcctttgagactgagtcttactccgtcccccagcgtggtggcgcgctgggattacaggcgcgcgccaccacgcgaacttgtatttttagtagagacggggtttcgccatgttgtccgggctgctctcgaactcctgacctcaggtgatccacccgcttcagcttcccaaagtgctggcattacaggcgtgagccaccacgccagggctttatttatttatttttaccacaatagtttgaagcagtaagggggaaggagggtgattatattgctttgtaatggtttgtgatacttgaaacatcacggtgcataataaagtaggtctgcagtaaa

SEQ ID NO: 455559 - DNA, 414 bp, Homo sapiens
acagggctgaggcccaggcccctgacttgcagtgctccctgccccggcggcccctcccctgcccccagtgtggaaaaagcttcatccatcccaaacggctgcagacccatgaggcccagggccgacgaggggccagcggcgcgcgccaccacgcgaacttgtatttttagtagagacggggtttcgccatgttgtccgggctgctctcgaactcctgacctcaggtgatccacccgcttcagcttcccaaagtgctggcattacaggcgtgagccaccacgccagggctttatttatttatttttaccacaatagtttgaagcagtaagggggaaggagggtgattatattgctttgtaatggtttgtgatacttgaaacatcacggtgcataataaagtaggtctgcagtaaa

SEQ ID NO: 455560 - DNA, 409 bp, Homo sapiens
gtactagataactccaaaaactaagggcaatgcgactcaggcaccgtaaactagaacactccatagaatgtggaaaactctcatagttgtcagtgatacaggtcccagagacctgtcccccacaggtagcaaggcgcgcgccaccacgcgaacttgtatttttagtagagacggggtttcgccatgttgtccgggctgctctcgaactcctgacctcaggtgatccacccgcttcagcttcccaaagtgctggcattacaggcgtgagccaccacgccagggctttatttatttatttttaccacaatagtttgaagcagtaagggggaaggagggtgattatattgctttgtaatggtttgtgatacttgaaacatcacggtgcataataaagtaggtctgcagtaaa

SEQ ID NO: 455561 - DNA, 1745 bp, Homo sapiens
atctgacatcatcatgttaggccaatcaccggacgcgttggtgggaggcctcacggacagcgcgcccggaggaaggaagacaagagagaggaagcttgaagccaatatggagtccgtcagttgctccgctgctgctgtcaggaccggagacatggagtcccagcgggacctgagcctggtgcctgagcggcttcagagacgcgaacaagaacggcagctggaagttgaaaggcggaaacaaaagcggcagaaccaggaggtagagaaggagaacagccactttttcgtcgccacctttgctcgggagcgagcggccgtggaagagcttctggagcgcgcggagtcggtcgagcggctggaggaggcggcctctcggctccaggggctgcagaaactaatcaacgactcagtttttttcctagccgcttacgacctgcggcagggacaagaggcgctggcgcggctgcaggcggccttggccgagcggcgccgggggctgcagcccaagaagcgtttcgctttcaagacccggggaaaggatgctgcttcgtctaccaaagtagacgcggctcctggcatccccccggcagttgaaagcatacaggactccccgctgcccaagaaggcggaaggagacctcggccccagctgggtctgcggtttctccaacctggagtcccaagtcttggagaagagagccagcgagttgcaccagcgcgacgttcttttgaccgaactgagcaactgcacggtcagactgtatggaaatcccaacaccctgcggctaaccaaggcccacagctgcaagctgctctgcggtccggtgtctacctctgttttcctggaggactgcagtgactgcgtgctggcagtggcctgccaacagctccgcatacacagtacgaaagacacccgcatcttcctgcaggtgaccagcagggccatcgtggaggactgcagtgggatccagttcgccccttacacctggagctacccggagatcgacaaggacttcgagagctctggtttagataggagcaaaaataactggaacgatgttgacgattttaactggctggcccgggatatggcctccccaaactggagtattcttcctgaagaggagcgaaatatccagtgggactaagcagttgtcactctgttcttcactcctaccaaatactttccacgttggactttcccccttattgggtctcgaagtttacttattgtcacactgtgtatgttttcagcattttaaggctagagattgtaatgggctcctacttgtaatttccattaaattcgtaacaggtataacactaaagcatttttgctattttcgtcatgcctttgagactgagtcttactccgtcccccagcgtggtggcgcgctgggattacaggcgcgcgccaccacgcgaacttgtatttttagtagagacggggtttcgccatgttgtccgggctgctctcgaactcctgacctcaggtgatccacccgcttcagcttcccaaagtgctggcattacaggcgtgagccaccacgccagggctttatttatttatttttaccacaatagtttgaagcagtaagggggaaggagggtgattatattgctttgtaatggtttgtgatacttgaaacatcacggtgcataataaagtaggtctgcagtaaaaaaaaaaaaaaacacaacaccacacaacaattgcgcccggcccagggggggcgggggcccggg

SEQ ID NO: 455562 - DNA, 1092 bp, Homo sapiens
atctgacatcatcatgttaggccaatcaccggacgcgttggtgggaggcctcacggacagcgcgcccggaggaaggaagacaagagagaggaagcttgaagccaatatggagtccgtcagttgctccgctgctgctgtcaggaccggagacatggagtcccagcgggacctgagcctggtgcctgagcggcttcagagacgcgaacaagaacggcagctggaagttgaaaggcggaaacaaaagcggcagaaccaggaggtagagaaggagaacagccactttttcgtcgccacctttgctcgggagcgagcggccgtggaagagcttctggagcgcgcggagtcggtcgagcggctggaggaggcggcctctcggctccaggggctgcagaaactaatcaacgactcagtttttttcctagccgcttacgacctgcggcagggacaagaggcgctggcgcggctgcaggcggccttggccgagcggcgccgggggctgcagcccaagaagcgtttcgctttcaagacccggggaaaggatgctgcttcgtctaccaaagtagacgcggctcctggcatccccccggcagttgaaagcatacaggactccccgctgcccaagaaggcggaaggagacctcggccccagctgggtctgcggtttctccaacctggagtcccaagtcttggagaagagagccagcgagttgcaccagcgcgacgttcttttgaccgaactgagcaactgcacggtcagactgtatggaaatcccaacaccctgcggctaaccaaggcccacagctgcaagctgctctgcggtccggtgtctacctctgttttcctggaggactgcagtgactgcgtgctggcagtggcctgccaacagctccgcatacacagtacgaaagaacccgcttcagcttcccaaagtgctggcattacaggcgtgagccaccacgccagggctttatttatttatttttaccacaatagtttgaagcagtaagggggaaggagggtgattatattgctttgtaatggtttgtgatacttgaaacatcacggtgcataataaagtaggtctgcagtaaa

SEQ ID NO: 455563 - DNA, 1381 bp, Homo sapiens
atctgacatcatcatgttaggccaatcaccggacgcgttggtgggaggcctcacggacagcgcgcccggaggaaggaagacaagagagaggaagcttgaagccaatatggagtccgtcagttgctccgctgctgctgtcaggaccggagacatggagtcccagcgggacctgagcctggtgcctgagcggcttcagagacgcgaacaagaacggcagctggaagttgaaaggcggaaacaaaagcggcagaaccaggaggtagagaaggagaacagccactttttcgtcgccacctttgctcgggagcgagcggccgtggaagagcttctggagcgcgcggagtcggtcgagcggctggaggaggcggcctctcggctccaggggctgcagaaactaatcaacgactcagtttttttcctagccgcttacgacctgcggcagggacaagaggcgctggcgcggctgcaggcggccttggccgagcggcgccgggggctgcagcccaagaagcgtttcgctttcaagacccggggaaaggatgctgcttcgtctaccaaagtagacgcggctcctggcatccccccggcagttgaaagcatacaggactccccgctgcccaagaaggcggaaggagacctcggccccagctgggtctgcggtttctccaacctggagtcccaagtcttggagaagagagccagcgagttgcaccagcgcgacgttcttttgaccgaactgagcaactgcacggtcagactgtatggaaatcccaacaccctgcggctaaccaaggcccacagctgcaagctgctctgcggtccggtgtctacctctgttttcctggaggactgcagtgactgcgtgctggcagtggcctgccaacagctccgcatacacagtacgaaagacacccgcatcttcctgcaggtgaccagcagggccatcgtggaggactgcagtgggatccagttcgccccttacacctggagctacccggagatcgacaaggacttcgagagctctggtttagataggagcaaaaataactggaacgatgttgacgattttaactggctggcccgggatatggcctccccaaactggagtattcttcctgaagaggagcgaaatatccagtgggactaagcagttgtcactctgttcttcactcctaccaaatactttccacgttggactttcccccttattgggtctcgaagtttacttattgtcacactgtgtatgttttcagcattttaaggctagagattgtaatgggctcctacttgtaatttccattaaattcgtaacaggtataacactatagagaagatacctcgagggggggccctgtaccccattggccctatagtgagtcgt

SEQ ID NO: 455564 - DNA, 699 bp, Homo sapiens
agccgttgtcagtgtgacaataagtaaacttcgagagctctggtttagataggagcaaaaataactggaacgatgttgacgattttaactggctggcccgggatatggcctccccaaactggagtattcttcctgaagaggagcgaaatatccagtgggactaagcagttgtcactctgttcttcactcctaccaaatactttccacgttggactttcccccttattgggtctcgaagtttacttattgtcacactgtgtatgttttcagcattttaaggctagagattgtaatgggctcctacttgtaatttccattaaattcgtaacaggtataacactaaagcatttttgctattttcgtcatgcctttgagactgagtcttactccgtcccccagcgtggtggcgcgctgggattacaggcgcgcgccaccacgcgaacttgtatttttagtagagacggggtttcgccatgttgtccgggctgctctcgaactcctgacctcaggtgatccacccgcttcagcttcccaaagtgctggcattacaggcgtgagccaccacgccagggctttatttatttatttttaccacaatagtttgaagcagtaagggggaaggagggtgattatattgctttgtaatggtttgtgatacttgaaacatcacggtgcataataaagtaggtctgcagtaaa

SEQ ID NO: 455565 - DNA, 483 bp, Homo sapiens
agacggggcccctaatccgacatacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctc

SEQ ID NO: 455566 - DNA, 10416 bp, Homo sapiens
tcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtccgggctgcacaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctttgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctc

SEQ ID NO: 455567 - DNA, 10362 bp, Homo sapiens
tcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtccgggctgcacaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctttgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatacatatatatatactaattttcttttatggttcctggattttgtgagtagtttgcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctc

SEQ ID NO: 455568 - DNA, 10362 bp, Homo sapiens
tcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtccgggctgcacaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctttgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcgctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctc

SEQ ID NO: 455569 - DNA, 9468 bp, Homo sapiens
  misc_feature (24)..(24): n is a, c, g, or t
gcctactactactaaattcgcggncgcgtcgattaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtccgggctgcacaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctttgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctc

SEQ ID NO: 455570 - DNA, 10351 bp, Homo sapiens
tcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtccgggctgcacaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctttgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttgctgaggcaggagaatctcgaacccaggaggcggaggttacagtcagctgagaccgcaccattgcactccagcctgggtgacagagcaagattccgtctcaaaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctc

SEQ ID NO: 455571 - DNA, 10384 bp, Homo sapiens
tcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtccgggctgcacaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctttgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctc

SEQ ID NO: 455572 - DNA, 10363 bp, Homo sapiens
tcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtccgggctgcacaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctttgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaatggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctc

SEQ ID NO: 455573 - DNA, 10362 bp, Homo sapiens
tcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtccgggctgcacaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctttgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaatggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctc

SEQ ID NO: 455574 - DNA, 10394 bp, Homo sapiens
tcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtccgggctgcacaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctttgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctc

SEQ ID NO: 455575 - DNA, 8383 bp, Homo sapiens
tcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtccgggctgcacaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctttgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctc

SEQ ID NO: 455576 - DNA, 7127 bp, Homo sapiens
  misc_feature (7047)..(7047): n is a, c, g, or t
tcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtccgggctgcacaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctttgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaatacacgctgactgaaacctgcgtaccactaatcgctgagaatcncttcgcagtgcgatagcgccgacgacgcttcaacagtgcactatgcatgaatgagctaattgtaatccgttgtatagctt

SEQ ID NO: 455577 - DNA, 10362 bp, Homo sapiens
tcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtccgggctgcacaaaggcaaatgctttgctagtttccttccagttaatttcacctatgaatagatgtgtgttcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctttgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctc

SEQ ID NO: 455578 - DNA, 7828 bp, Homo sapiens
cgagctcggtaccctgatatgctgtctccaaaaaaaataccaaaacgaccaaaaaaaaacaaaacagaaaaaataaactaaggcaatgacctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctttgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctc

SEQ ID NO: 455579 - DNA, 7236 bp, Homo sapiens
tgtgctgagccttggcccactttttaattaggcgtttgtctttttattactgattaataataagagctctttacatattaaggaaattaacccttttcaaatacattcctatttctcactaatctttaagttttattgtaatattttgctctttagtttatatatatatgtatatatatatatatgtatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctc

SEQ ID NO: 455580 - DNA, 6201 bp, Homo sapiens
ttgaggggttgggcacagggtcaggtgctggacactagaacaggactccactccgcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctc

SEQ ID NO: 455581 - DNA, 5979 bp, Homo sapiens
tcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtccgggctgcacaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctttgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaaaaaaactcgagggggggcccggttcccaattcgcccctatgtgagtcctattacaatttactggcccgcctttttacaacgtcgtgaactggggaaaaccctggcgttccccaaacttaatcgcctttgcagaacaatcc

SEQ ID NO: 455582 - DNA, 5864 bp, Homo sapiens
ttggcattatgcacatcatctgcatcatctccactgacattactcgataattcgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctc

SEQ ID NO: 455583 - DNA, 5524 bp, Homo sapiens
agaccgtagaggaccctttctctgatcgctcccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctc

SEQ ID NO: 455584 - DNA, 5189 bp, Homo sapiens
aggtaaatcagccggtccgacaccatagaatgcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctc

SEQ ID NO: 455585 - DNA, 5567 bp, Homo sapiens
tcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtccgggctgcacaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctttgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttcaagtgatcctcgtgcctcagcctcctgagaagctggtattacagacgtgcaccaccatgcctgactaattttgtcgacc

SEQ ID NO: 455586 - DNA, 5002 bp, Homo sapiens
aggtgatctagaggttcccactctacactaatacatataaaaaaggtaattaagataatataactttgaaaaactgacttataatgaaatagaaatatttaatagcccagtaaccctggaagaacctgaaaaagttttcaaggctgggcacagtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctc

SEQ ID NO: 455587 - DNA, 4927 bp, Homo sapiens
  misc_feature (211)..(211): n is a, c, g, or t
  misc_feature (229)..(229): n is a, c, g, or t
  misc_feature (302)..(302): n is a, c, g, or t
gatccacccacctcagcctcccacagtgctgggactacaggcatgaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttcctnttatcatctgatgatgancttaatgtttccatttgtattaatgggaatactaagtccctctgtgattttctgaacccaagctatttcctanggcctgagttttatttcagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctc

SEQ ID NO: 455588 - DNA, 4749 bp, Homo sapiens
aaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttccagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctc

SEQ ID NO: 455589 - DNA, 4695 bp, Homo sapiens
aaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttccagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagagtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctc

SEQ ID NO: 455590 - DNA, 4555 bp, Homo sapiens
  misc_feature (130)..(130): n is a, c, g, or t
ttgatgtctacattgaaggacaaggcagccactgggcagctccgggagggcgggaggcgtgactccttcatatcaggccatctggaggagcaccagatttccctcttgtgaaacaaccccccacagtggngatttaatggtcaccacacaagccccaaaaaaccaggccctgcagagccatgacttcacaggggagaaaaccagcccaagaggctgccctcacccaacacttagctctaagtccagactcttaaaggttctgttaaagatctgcggccaggcgcagtggctcacattcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctc

SEQ ID NO: 455591 - DNA, 4683 bp, Homo sapiens
aaacaaaaggggctgggtgaggtggctcatacctgtaatcccagcaataaaagaaaaaaacagataaattggacttggtggaaaatttaaaactttcgtgcacaaaggacattataaataaagtaaaatgacaacctatggaatgggaaaaatattttcaaactgtgtatctgataacaggttgaaatccagaatatacaaataactcttacaatgcaacaaaaacaagcaacaatttttaaatgagcaaacagatattttttcaaaaagtgaaaagatacttaacatcattttcatgatttgcattagagaaatgcaaatcaaaaccacaatgagataccacttcacaactactagaacggctttatgataatcacaaaacaaaagtgggctttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctc

SEQ ID NO: 455592 - DNA, 4291 bp, Homo sapiens
  misc_feature (24)..(24): n is a, c, g, or t
gcctactactactaaattcgcggncgcgtcgatcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctc

SEQ ID NO: 455593 - DNA, 4152 bp, Homo sapiens
tcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtccgggctgcacaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctttgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactacatgccatatggcatgtagtgaggacacagtgggagagacaagccaaggagagaggcctcagaataaaccaggcctacttaacatcttggatcttgtacctccagcatccagaactgtgagacaatacattttggctaagtcactcagactgatatttggttacgatagctctagcaaactagtacattttaaaactttcaaattaccgaatatctttctgttcacatgggatgaacctag

SEQ ID NO: 455594 - DNA, 3837 bp, Homo sapiens
gattaccggattctgagctccgtacccctgatactcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctc

SEQ ID NO: 455595 - DNA, 3441 bp, Homo sapiens
tcagacagccgggcccccctccctttccaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctc

SEQ ID NO: 455596 - DNA, 2941 bp, Homo sapiens
tgtataccatagcactgagtggctgctccccattggaatctagtgaggatcatttcctctccaaagtcacagaagagctgcccaaacaggccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctc

SEQ ID NO: 455597 - DNA, 1233 bp, Homo sapiens
gttagaggatccccgtttgggcttcgtgccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctc

SEQ ID NO: 455598 - DNA, 1230 bp, Homo sapiens
gaggaccccgcgctaagggctacccacatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctc

SEQ ID NO: 455599 - DNA, 2489 bp, Homo sapiens
tcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagatgatgggtcacacagttgtcaccttgacagaagagtaacagggacagcacaccagtcactctaggagctgaggccagaggaactcaggtatttccttctagaggtagtaagtccaccgaggcagatgccaagccgagtgggtaccgagctga

SEQ ID NO: 455600 - DNA, 1111 bp, Homo sapiens
ttaaacgatcgttgaagatttatttaatttagatatgttcgttggtactgcatttcgtatcagtggagctttgaacattcgtgtcctgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctc

SEQ ID NO: 455601 - DNA, 926 bp, Homo sapiens
tgatctgaggatccccgggtgatgatgtgaacaactcgtgtcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctc

SEQ ID NO: 455602 - DNA, 7829 bp, Homo sapiens
tcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtccgggctgcacaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctttgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtttcagatagaaaatgaaaaacaagctaagacaagtattgcccaagtaaagcccatagaaaaatataaagccaaaaatggggatcct

SEQ ID NO: 455603 - DNA, 6300 bp, Homo sapiens
tcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtccgggctgcacaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctttgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatgagactttgtttaaaaaaaaaaaagtgacttgatttaagggaaaaaatgactggctatattcagtcagatatggcataaagtctcaaggtgttaatgtgaatgattaaggtcttggggggggtgtcccctatcagactcaggtggtgtgggggatcctctatagtggtacatgc

SEQ ID NO: 455604 - DNA, 6018 bp, Homo sapiens
tcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtccgggctgcacaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctttgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacaccattgcactccagcctgggcaacagagcaagactcccatcttcaaaaataaaattaaatatataaaaagcatgggtttccggttaagaactacggtcaggtaggttcctatacaggtcttatgttctatatcttaagtggttggtgctaaggaagcttggtctttgtcttctttccacttgtttctttaatcatattagggattgtcc

SEQ ID NO: 455605 - DNA, 1932 bp, Homo sapiens
tacagaggatcccgtaagcaccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctc

SEQ ID NO: 455606 - DNA, 2887 bp, Homo sapiens
gcctgagtcggttaggtagctctaaaaactcgtaactccacaacagctcaatggattttcgagaggtggggtaaagcctgaaggctcagccggtttatccaacgagcaatctgggatttgcagtttccagcgcccgaagtgcgcccgctagcagagagctcttggactctaatcccgccccctccccgagcctcgcgcatcctgatggcgtcacgcggccccgcgaggtctgtgggatacatagtagtcctcaaggcgggtctcactcttggccgctgcaacttgaggactacacttccaaggaggcagcgcggcggcgcgccgagaaccacccgaggccgtgattggctggtgagccggccgcacgcggaggatcctaaggagcagctctgttgcgacataggccgagcagcgaggcccagctccctgaaacaacagtaacctacccctgtgggtcatcatcatgccctccgacctggccaagaagaaggcagccaaaaagaaggaggctgccaaagctcgacagcggcccagaaaaggacatgaagaaaatggagatgttgtcacagaaccacaggtggcagagaagaatgaggccaatggcagagagaccacagaagtagatttgctgaccaaggagctagaggactttgagatgaagaaagctgctgctcgagctgtcactggcgtcctggcctctcaccccaacagtactgatgttcacatcatcaacctctcactcacctttcatggtcaagagctgctcagtgacaccaaactggaattaaactcaggccgtcgttatggcctcattggtttaaatggaattggaaagtccatgctgctctctgctattgggaagcgtgaagtgcccatccctgagcacatcgacatctaccatctgactcgagagatgccccctagtgacaagacacccttgcattgtgtgatggaagtcgacacagagcgggccatgctggagaaagaggcagagcggctggctcatgaggatgcggagtgtgagaagctcatggagctctacgagcgcctggaggagctggatgccgacaaggcagagatgagggcctcgcggatcttgcatggactgggtttcacacctgccatgcagcgcaagaagctaaaagacttcagtgggggctggaggatgagggttgcccttgccagagccctctttattcggcccttcatgctgctcctggatgagcctaccaaccacctggacctagatgcttgcgtgtggttggaagaagaactaaaaacttttaagcgcatcttggtcctcgtctcccattcccaggattttctgaatggtgtctgtaccaatatcattcacatgcacaacaagaaactgaagtattatacgggtaattatgatcagtatgtgaagacgcggctagagctggaggagaaccagatgaagaggtttcactgggagcaagatcagattgcacacatgaagaactacattgcgaggtttggtcatggcagtgccaagctggcccggcaggcccagagcaaggagaagacgctacagaaaatgatggcatcaggactgacagagagggtcgtgagcgataagacactgtcattttatttcccaccatgtggcaagatccctccacctgtcattatggtgcaaaatgtgagcttcaagtatacaaaagatgggccttgcatctacaataatctagaatttggaattgaccttgacacacgagtggctctggtagggcccaatggagcagggaagtcaactcttctgaagctgctaactggagagctactacccacagatggcatgatccgaaaacactctcatgtcaagatagggcgttaccatcagcatttacaagagcagctggacttagatctctcacctttggagtacatgatgaagtgctacccagagatcaaggagaaggaagaaatgaggaagatcattgggcgatacggtctcactgggaaacaacaggtgagcccaatccggaacttgtcagacgggcagaagtgccgagtgtgtctggcctggctggcctggcagaacccccacatgctcttcctggatgaacccaccaatcacctggatatcgagaccatcgacgccctggcagatgccatcaatgagtttgagggtggtatgatgctggtcagccatgacttcagactcattcagcaggttgcacaggaaatttgggtctgtgagaagcagacaatcaccaagtggcctggagacatcctggcttacaaggagcacctcaagtccaagctggtggatgaggagccccagctcaccaagaggacccacaacgtgtgagccctctacctgggttcgggtcaggagctccatctgggaactaacagctgctaacctgaccagccgctcaggacaggaccctggggctacactcctgcattgctgcaatactgctcccccagcctctcccctgcccctcaacctgccttagctgcactctcttacctacagctggacagtacctgtctgtttcctgtcctccttccagttacatctgtccatgtctggactcggctggccgttccctccagccccttgctggttatcttactctgagtgtgatgcagtcagaggcacctgcgggttagcccaggggcccaagccctggatttggcctgcggaggagcttaggatcctcgttttctgggttttggtgatgttggaggagtaccccccagcccaccgccccgattcctttttgcttctggtttggagctccggaccaggaccttcgtcctggtcagtttttaaataattatttagcagtgtaacttttaaacctgcgtgacatctacaaagcgcccaataaagaaagaggaagccacggtccct

SEQ ID NO: 455607 - DNA, 2571 bp, Homo sapiens
ggacgggaggaggaagcccggaaagtgaggcggctagctgagtgcggagcgccaagttgtagggaaaccggagacggagacctccgctgaggggcagaacctggtccccagccggaggccctgaaagaaggagcgtttccaaagtgaggcagtccgtgggggactggtgcctgtgggaagagatgttaagattagaagagccgctgagaatcggcattggtttgggataccctgaccaagttggaacagacgaggcgggggcaggccagggcatcagaggcttgatgttgatacgaagattcctgagagggatggagcagggcccaggcattcttactagtaagtttagggtttgggggtatctgtttgccttccttcaggctccctgaagctccctgaaacaacagtaacctacccctgtgggtcatcatcatgccctccgacctggccaagaagaaggcagccaaaaagaaggaggctgccaaagctcgacagcggcccagaaaaggacatgaagaaaatggagatgttgtcacagaaccacaggtggcagagaagaatgaggccaatggcagagagaccacagaagtagatttgctgaccaaggagctagaggactttgagatgaagaaagctgctgctcgagctgtcactggcgtcctggcctctcaccccaacagtactgatgttcacatcatcaacctctcactcacctttcatggtcaagagctgctcagtgacaccaaactggaattaaactcaggccgtcgttatggcctcattggtttaaatggaattggaaagtccatgctgctctctgctattgggaagcgtgaagtgcccatccctgagcacatcgacatctaccatctgactcgagagatgccccctagtgacaagacacccttgcattgtgtgatggaagtcgacacagagcgggccatgctggagaaagaggcagagcggctggctcatgaggatgcggagtgtgagaagctcatggagctctacgagcgcctggaggagctggatgccgacaaggcagagatgagggcctcgcggatcttgcatggactgggtttcacacctgccatgcagcgcaagaagctaaaagacttcagtgggggctggaggatgagggttgcccttgccagagccctctttattcggcccttcatgctgctcctggatgagcctaccaaccacctggacctagatgcttgcgtgtggttggaagaagaactaaaaacttttaagcgcatcttggtcctcgtctcccattcccaggattttctgaatggtgtctgtaccaatatcattcacatgcacaacaagaaactgaagtattatacgggtaattatgatcagtatgtgaagacgcggctagagctggaggagaaccagatgaagaggtttcactgggagcaagatcagattgcacacatgaagaactacattgcgaggtttggtcatggcagtgccaagctggcccggcaggcccagagcaaggagaagacgctacagaaaatgatggcatcaggactgacagagagggtcgtgagcgataagacactgtcattttatttcccaccatgtggcaagatccctccacctgtcattatggtgcaaaatgtgagcttcaagtatacaaaagatgggccttgcatctacaataatctagaatttggaattgaccttgacacacgagtggctctggtagggcccaatggagcagggaagtcaactcttctgaagctgctaactggagagctactacccacagatggcatgatccgaaaacactctcatgtcaagatagggcgttaccatcagcatttacaagagcagctggacttagatctctcacctttggagtacatgatgaagtgctacccagagatcaaggagaaggaagaaatgaggaagatcattgggcgatacggtctcactgggaaacaacaggtgagcccaatccggaacttgtcagacgggcagaagtgccgagtgtgtctggcctggctggcctggcagaacccccacatgctcttcctggatgaacccaccaatcacctggatatcgagaccatcgacgccctggcagatgccatcaatgagtttgagggtggtatgatgctggtcagccatgacttcagactcattcagcaggttgcacaggaaatttgggtctgtgagaagcagacaatcaccaagtggcctggagacatcctggcttacaaggagcacctcaagtccaagctggtggatgaggagccccagctcaccaagaggacccacaacgtgtgcaccctgacattggcatctctgccaaggccatgagcatcatgaactcgtttgtaaacgacgtgtttgagcagctggcgtgtgaggctgcccggctggcccagtactcgggccggaccaccctgacatcccgagaagtccagacggctgtgcgtctgctgctgcctggggagctggccaagcacgctgtgtctgagggcaccaaggctgtcaccaagtacaccagctccaagtgacccagggcctgacaaaaataaagggtgaactgtt

SEQ ID NO: 455608 - DNA, 2856 bp, Homo sapiens
ggacgggaggaggaagcccggaaagtgaggcggctagctgagtgcggagcgccaagttgtagggaaaccggagacggagacctccgctgaggggcagaacctggtccccagccggaggccctgaaagaaggagcgtttccaaagtgaggcagtccgtgggggactggtgcctgtgggaagagatgttaagattagaagagccgctgagaatcggcattggtttgggataccctgaccaagttggaacagacgaggcgggggcaggccagggcatcagaggcttgatgttgatacgaagattcctgagagggatggagcagggcccaggcattcttactagtaagtttagggtttgggggtatctgtttgccttccttcaggctccctgaagctccctgaaacaacagtaacctacccctgtgggtcatcatcatgccctccgacctggccaagaagaaggcagccaaaaagaaggaggctgccaaagctcgacagcggcccagaaaaggacatgaagaaaatggagatgttgtcacagaaccacaggtggcagagaagaatgaggccaatggcagagagaccacagaagtagatttgctgaccaaggagctagaggactttgagatgaagaaagctgctgctcgagctgtcactggcgtcctggcctctcaccccaacagtactgatgttcacatcatcaacctctcactcacctttcatggtcaagagctgctcagtgacaccaaactggaattaaactcaggccgtcgttatggcctcattggtttaaatggaattggaaagtccatgctgctctctgctattgggaagcgtgaagtgcccatccctgagcacatcgacatctaccatctgactcgagagatgccccctagtgacaagacacccttgcattgtgtgatggaagtcgacacagagcgggccatgctggagaaagaggcagagcggctggctcatgaggatgcggagtgtgagaagctcatggagctctacgagcgcctggaggagctggatgccgacaaggcagagatgagggcctcgcggatcttgcatggactgggtttcacacctgccatgcagcgcaagaagctaaaagacttcagtgggggctggaggatgagggttgcccttgccagagccctctttattcggcccttcatgctgctcctggatgagcctaccaaccacctggacctagatgcttgcgtgtggttggaagaagaactaaaaacttttaagcgcatcttggtcctcgtctcccattcccaggattttctgaatggtgtctgtaccaatatcattcacatgcacaacaagaaactgaagtattatacgggtaattatgatcagtatgtgaagacgcggctagagctggaggagaaccagatgaagaggtttcactgggagcaagatcagattgcacacatgaagaactacattgcgaggtttggtcatggcagtgccaagctggcccggcaggcccagagcaaggagaagacgctacagaaaatgatggcatcaggactgacagagagggtcgtgagcgataagacactgtcattttatttcccaccatgtggcaagatccctccacctgtcattatggtgcaaaatgtgagcttcaagtatacaaaagatgggccttgcatctacaataatctagaatttggaattgaccttgacacacgagtggctctggtagggcccaatggagcagggaagtcaactcttctgaagctgctaactggagagctactacccacagatggcatgatccgaaaacactctcatgtcaagatagggcgttaccatcagcatttacaagagcagctggacttagatctctcacctttggagtacatgatgaagtgctacccagagatcaaggagaaggaagaaatgaggaagatcattgggcgatacggtctcactgggaaacaacaggtgagcccaatccggaacttgtcagacgggcagaagtgccgagtgtgtctggcctggctggcctggcagaacccccacatgctcttcctggatgaacccaccaatcacctggatatcgagaccatcgacgccctggcagatgccatcaatgagtttgagggtggtatgatgctggtcagccatgacttcagactcattcagcaggttgcacaggaaatttgggtctgtgagaagcagacaatcaccaagtggcctggagacatcctggcttacaaggagcacctcaagtccaagctggtggatgaggagccccagctcaccaagaggacccacaacgtgtgagccctctacctgggttcgggtcaggagctccatctgggaactaacagctgctaacctgaccagccgctcaggacaggaccctggggctacactcctgcattgctgcaatactgctcccccagcctctcccctgcccctcaacctgccttagctgcactctcttacctacagctggacagtacctgtctgtttcctgtcctccttccagttacatctgtccatgtctggactcggctggccgttccctccagccccttgctggttatcttactctgagtgtgatgcagtcagaggcacctgcgggttagcccaggggcccaagccctggatttggcctgcggaggagcttaggatcctcgttttctgggttttggtgatgttggaggagtaccccccagcccaccgccccgattcctttttgcttctggtttggagctccggaccaggaccttcgtcctggtcagtttttaaataattatttagcagtgtaacttttaaacctgcgtgacatctacaaagcgcccaataaagaaagaggaagccacggtccct

SEQ ID NO: 455609 - DNA, 2527 bp, Homo sapiens
cgcgaccatccgggcggcgaaaatagggcgagccagggcagagccagggccctgacgcagggctccctgaaacaacagtaacctacccctgtgggtcatcatcatgccctccgacctggccaagaagaaggcagccaaaaagaaggaggctgccaaagctcgacagcggcccagaaaaggacatgaagaaaatggagatgttgtcacagaaccacaggtggcagagaagaatgaggccaatggcagagagaccacagaagtagatttgctgaccaaggagctagaggactttgagatgaagaaagctgctgctcgagctgtcactggcgtcctggcctctcaccccaacagtactgatgttcacatcatcaacctctcactcacctttcatggtcaagagctgctcagtgacaccaaactggaattaaactcaggccgtcgttatggcctcattggtttaaatggaattggaaagtccatgctgctctctgctattgggaagcgtgaagtgcccatccctgagcacatcgacatctaccatctgactcgagagatgccccctagtgacaagacacccttgcattgtgtgatggaagtcgacacagagcgggccatgctggagaaagaggcagagcggctggctcatgaggatgcggagtgtgagaagctcatggagctctacgagcgcctggaggagctggatgccgacaaggcagagatgagggcctcgcggatcttgcatggactgggtttcacacctgccatgcagcgcaagaagctaaaagacttcagtgggggctggaggatgagggttgcccttgccagagccctctttattcggcccttcatgctgctcctggatgagcctaccaaccacctggacctagatgcttgcgtgtggttggaagaagaactaaaaacttttaagcgcatcttggtcctcgtctcccattcccaggattttctgaatggtgtctgtaccaatatcattcacatgcacaacaagaaactgaagtattatacgggtaattatgatcagtatgtgaagacgcggctagagctggaggagaaccagatgaagaggtttcactgggagcaagatcagattgcacacatgaagaactacattgcgaggtttggtcatggcagtgccaagctggcccggcaggcccagagcaaggagaagacgctacagaaaatgatggcatcaggactgacagagagggtcgtgagcgataagacactgtcattttatttcccaccatgtggcaagatccctccacctgtcattatggtgcaaaatgtgagcttcaagtatacaaaagatgggccttgcatctacaataatctagaatttggaattgaccttgacacacgagtggctctggtagggcccaatggagcagggaagtcaactcttctgaagctgctaactggagagctactacccacagatggcatgatccgaaaacactctcatgtcaagatagggcgttaccatcagcatttacaagagcagctggacttagatctctcacctttggagtacatgatgaagtgctacccagagatcaaggagaaggaagaaatgaggaagatcattgggcgatacggtctcactgggaaacaacaggtgagcccaatccggaacttgtcagacgggcagaagtgccgagtgtgtctggcctggctggcctggcagaacccccacatgctcttcctggatgaacccaccaatcacctggatatcgagaccatcgacgccctggcagatgccatcaatgagtttgagggtggtatgatgctggtcagccatgacttcagactcattcagcaggttgcacaggaaatttgggtctgtgagaagcagacaatcaccaagtggcctggagacatcctggcttacaaggagcacctcaagtccaagctggtggatgaggagccccagctcaccaagaggacccacaacgtgtgagccctctacctgggttcgggtcaggagctccatctgggaactaacagctgctaacctgaccagccgctcaggacaggaccctggggctacactcctgcattgctgcaatactgctcccccagcctctcccctgcccctcaacctgccttagctgcactctcttacctacagctggacagtacctgtctgtttcctgtcctccttccagttacatctgtccatgtctggactcggctggccgttccctccagccccttgctggttatcttactctgagtgtgatgcagtcagaggcacctgcgggttagcccaggggcccaagccctggatttggcctgcggaggagcttaggatcctcgttttctgggttttggtgatgttggaggagtaccccccagcccaccgccccgattcctttttgcttctggtttggagctccggaccaggaccttcgtcctggtcagtttttaaataattatttagcagtgtaacttttaaacctgcgtgacatctacaaagcgcccaataaagaaagaggaagccacggtccct

SEQ ID NO: 455610 - DNA, 4886 bp, Homo sapiens
gcctgagtcggttaggtagctctaaaaactcgtaactccacaacagctcaatggattttcgagaggtggggtaaagcctgaaggctcagccggtttatccaacgagcaatctgggatttgcagtttccagcgcccgaagtgcgcccgctagcagagagctcttggactctaatcccgccccctccccgagcctcgcgcatcctgatggcgtcacgcggccccgcgaggtctgtgggatacatagtagtcctcaaggcgggtctcactcttggccgctgcaacttgaggactacacttccaaggaggcagcgcggcggcgcgccgagaaccacccgaggccgtgattggctggtgagccggccgcacgcggaggatcctaaggagcagctctgttgcgacataggccgagcagcgaggcccagctccctgaaacaacagtaacctacccctgtgggtcatcatcatgccctccgacctggccaagaagaaggcagccaaaaagaaggaggctgccaaagctcgacagcggcccagaaaaggacatgaagaaaatggagatgttgtcacagaaccacaggtggcagagaagaatgaggccaatggcagagagaccacagaagtagatttgctgaccaaggagctagaggactttgagatgaagaaagctgctgctcgagctgtcactggcgtcctggcctctcaccccaacagtactgatgttcacatcatcaacctctcactcacctttcatggtcaagagctgctcagtgacaccaaactggaattaaactcaggccgtcgttatggcctcattggtttaaatggaattggaaagtccatgctgctctctgctattgggaagcgtgaagtgcccatccctgagcacatcgacatctaccatctgactcgagagatgccccctagtgacaagacacccttgcattgtgtgatggaagtcgacacagagcgggccatgctggagaaagaggcagagcggctggctcatgaggatgcggagtgtgagaagctcatggagctctacgagcgcctggaggagctggatgccgacaaggcagagatgagggcctcgcggatcttgcatggactgggtttcacacctgccatgcagcgcaagaagctaaaagacttcagtgggggctggaggatgagggttgcccttgccagagccctctttattcggcccttcatgctgctcctggatgagcctaccaaccacctggacctagatgcttgcgtgtggttggaagaagaactaaaaacttttaagcgcatcttggtcctcgtctcccattcccaggattttctgaatggtgtctgtaccaatatcattcacatgcacaacaagaaactgaagtattatacgggtaattatgatcagtatgtgaagacgcggctagagctggaggagaaccagatgaagaggtttcactgggagcaagatcagattgcacacatgaagaactacattgcgaggtttggtcatggcagtgccaagctggcccggcaggcccagagcaaggagaagacgctacagaaaatgatggcatcaggactgacagagagggtcgtgagcgataagacactgtcattttatttcccaccatgtggcaagatccctccacctgtcattatggtgcaaaatgtgagcttcaagtatacaaaagatgggccttgcatctacaataatctagaatttggaattgaccttgacacacgagtggctctggtagggcccaatggagcagggaagtcaactcttctgaagctgctaactggagagctactacccacagatggcatgatccgaaaacactctcatgtcaagatagggcgttaccatcagcatttacaagagcagctggacttagatctctcacctttggagtacatgatgaagtgctacccagagatcaaggagaaggaagaaatgaggaagatcattgggcgatacggtctcactgggaaacaacaggtgagcccaatccggaacttgtcagacgggcagaagtgccgagtgtgtctggcctggctggcctggcagaacccccacatgctcttcctggatgaacccaccaatcacctggatatcgagaccatcgacgccctggcagatgccatcaatgagtttgagggtggtatgatgctggtcagccatgacttcagactcattcagcaggttgcacaggaaatttgggtctgtgagaagcagacaatcaccaagtggcctggagacatcctggcttacaaggagcacctcaagtccaagctggatgccgacaaggcagagatgagggcctcgcggatcttgcatggactgggtttcacacctgccatgcagcgcaagaagctaaaagacttcaggacaggaccctggggctacactcctgcattgctgcaatactgctcccccagcctctcccctgcccctcaacctgccttagctgcactctcttacctacagctggacagtacctgtctgtttcctgtcctccttccagttacatctgtccatgtctggactcggctggccgttccctccagccccttgctggttatcttactctgagtgtgatgcagtcagaggcacctgcgggttagcccaggggcccaagccctggatttggcctgcggaggagcttaggatcctcgttttctgggttttggtgatgttggaggagtaccccccagcccaccgccccgattcctttttgcttctggtttggagctccggaccaggaccttcgtcctggtcagtttttaaataattatttagcagtgtaacttttaaacctgcgtgacatctacaaagcgcccaataaagaaagaggaagccacggtccctaccttccttctcgggtctctggggccttctcctccctgcagtgccaacatgcactgcccacagcaggagctggatccagcgtcagtgtgtcgatgggaactgaagactagtccataggagctggaagaactttgtccctttacttctgatttgaaattgtaccttttctcaggcctgtgattcacagactttaacatgaatcagaatcacctggagggctcatgcaatcagattgccagatctcgcctcagcgtttctggttcaataggttttgggggagaccaagaacgttaacatttctagcaagtttccaggtgatgctgttgttgctggtctagagactattttgagaaccactgtccaggagcgtggttttctgattgtgatctgaggttctgccccaactgcacagcagttgggctgcttgttaaaaatgcaggccaggtgcggtggctcacacctgtaatcccagcgctttgggaggctgaggcaggtggatcacttgagctcaggagttcaagaccagcttgggaaacatggcaaaacccgtctttatgtgcctggaatcccacctgctcaggtggctagggtggatggatcgcttgagcccaggaggtggaggttgcagtgagctgagattgcaccactgcattccagcctggatgacagagcaaaaccctgtctcaaaaaaatgcagactggccaggcacagtggctcacacctgtaatccgactgtaagctcatcaccttgggaggccactgtaggaggatcaattgagcctagaagttcaagaccagcctgggcaaagtagggagaccccttctctacaaatagtaataaaatgaaccgggcatagtagcatgtgcctgcggtcccagctgctctgataagaggaggctcacttgagcccaggaggttgaggctgcagtgagcagagcgtgccgctacactccagcctgatgacagaccgagacactgtctcaaaaaaataaaaaaattcagattgctgagcatcagacctattgattaatcgcatttggtagaatgagagaggtgcagagatggccaggagtttgcattttcacaccaacgtctgtgaacctctcttcctattgggatacaggaaattttgtatttttacctgtccacagccatagttatcatcactgttgaattcacttccagcccagggctctgcataccttatctgggtcttttgaacttcaatagcatttcaccagtggccatccttcctggtgtggattcatcactctgcctctgaaatcagccatccctatgggaagacacagccatgatttttcagtactcataatacagccaggactggcgggagcaactgtcccagatggtgcttaaaccccttaggagctcatgatcttcttggaaagccagtaagacagaaccatacaggacacaaattagatgctaaattgtgatttagataggagacagaagtattcaaaaagggagggaaatttcttgtgagtagctgcccagaaaggtggaattggtgtgctctcacttgaaaaatgagtaggatcttctcagatggccacaaagtccaggagctgccctgggcaacagggacaggagcctcccgtgagacactgcagctgagacagatgggagtcctctgaccccagagggtactggcttgactgctttatgccttaagtggggcctggagcaaaatggcccaggttagtctgtcctgagagtccagagccttggttcaggggagaatggcatctggagagtgggctgctgggataatggggacagtgagggacagagcccttgatacttaaggaagtgctggatattgctaagaattcaggtagtctcgggatctccagagtctccatgctaggacaggagatcttcagaacctggaggaatggaaatagtctagtcagcttatttgtcaagaaaaatgtcaaccttggtaatttaaataatgctttaaaagtccacaaaatacatatttctaaaattaaaaa

SEQ ID NO: 455611 - DNA, 2839 bp, Homo sapiens
gcctgagtcggttaggtagctctaaaaactcgtaactccacaacagctcaatggattttcgagaggtggggtaaagcctgaaggctcagccggtttatccaacgagcaatctgggatttgcagtttccagcgcccgaagtgcgcccgctagcagagagctcttggactctaatcccgccccctccccgagcctcgcgcatcctgatggcgtcacgcggccccgcgaggtctgtgggatacatagtagtcctcaaggcgggtctcactcttggccgctgcaacttgaggactacacttccaaggaggcagcgcggcggcgcgccgagaaccacccgaggccgtgattggctggtgagccggccgcacgcggaggatcctaaggagcagctctgttgcgacataggccgagcagcgaggcccagctccctgaaacaacagtaacctacccctgtgggtcatcatcatgccctccgacctggccaagaagaaggcagccaaaaagaaggaggctgccaaagctcgacagcggcccagaaaaggacatgaagaaaatggagatgttgtcacagaaccacaggtggcagagaagaatgaggccaatggcagagagaccacagaagtagatttgctgaccaaggagctagaggactttgagatgaagaaagctgctgctcgagctgtcactggcgtcctggcctctcaccccaacagtactgatgttcacatcatcaacctctcactcacctttcatggtcaagagctgctcagtgacaccaaactggaattaaactcaggccgtcgttatggcctcattggtttaaatggaattggaaagtccatgctgctctctgctattgggaagcgtgaagtgcccatccctgagcacatcgacatctaccatctgactcgagagatgccccctagtgacaagacacccttgcattgtgtgatggaagtcgacacagagcgggccatgctggagaaagaggcagagcggctggctcatgaggatgcggagtgtgagaagctcatggagctctacgagcgcctggaggagctggatgccgacaaggcagagatgagggcctcgcggatcttgcatggactgggtttcacacctgccatgcagcgcaagaagctaaaagacttcagtgggggctggaggatgagggttgcccttgccagagccctctttattcggcccttcatgctgctcctggatgagcctaccaaccacctggacctagatgcttgcgtgtggttggaagaagaactaaaaacttttaagcgcatcttggtcctcgtctcccattcccaggattttctgaatggtgtctgtaccaatatcattcacatgcacaacaagaaactgaagtattatacgggtaattatgatcagtatgtgaagacgcggctagagctggaggagaaccagatgaagaggtttcactgggagcaagatcagattgcacacatgaagaactacattgcgaggtttggtcatggcagtgccaagctggcccggcaggcccagagcaaggagaagacgctacagaaaatgatggcatcaggactgacagagagggtcgtgagcgataagacactgtcattttatttcccaccatgtggcaagatccctccacctgtcattatggtgcaaaatgtgagcttcaagtatacaaaagatgggccttgcatctacaataatctagaatttggaattgaccttgacacacgagtggctctggtagggcccaatggagcagggaagtcaactcttctgaagctgctaactggagagctactacccacagatggcatgatccgaaaacactctcatgtcaagatagggcgttaccatcagcatttacaagagcagctggacttagatctctcacctttggagtacatgatgaagtgctacccagagatcaaggagaaggaagaaatgaggaagatcattgggcgatacggtctcactgggaaacaacaggtgagcccaatccggaacttgtcagacgggcagaagtgccgagtgtgtctggcctggctggcctggcagaacccccacatgctcttcctggatgaacccaccaatcacctggatatcgagaccatcgacgccctggcagatgccatcaatgagtttgagggtggtatgatgctggtcagccatgacttcagactcattcagcaggttgcacaggaaatttgggtctgtgagaagcagacaatcaccaagtggcctggagacatcctggcttacaaggagcacctcaagtccaagctggtggatgaggagccccagctcaccaagaggacccacaacgtgtgagccctctacctgggttcgggtcaggagcttcattagcaatggttctaagaataacgttcaaaaacttaacatgggctacaatgcctgaaattgctgatctttagttactcctccagcttcattttgctctatatgctctccctcacactctttcaagccacaggggtctaccttcaggagagaaagcatataatttcatcccttctagtatatggggtgcacatgttatctccgtgtatcaaaacactctttgcctctccattgcgactagtttattcttggggattgcagcttaaatgtcaccataagagccttccgtgggcctccatactacgttagaatattatacactcttcataactagtgttttatcttccccttatagcagtgggggtcacttcttatccctaacatagcatacagtagtattcaatacatttgttgaaagaccatatgaatagagtagtgcgggtgagggtcccctattcagaattaagtgccaga

SEQ ID NO: 455612 - DNA, 1816 bp, Homo sapiens
cgtgggtgtatttgtgtacatacacacttctggttactatcactgttactaccgtctccatcccattctgttgaaaattagaacagaagattgaggaaactcaggctgtctcgccacactgaaaggcgtccaaatacccttacagttagattgtcgagtcgtggcttaggtgcttgctaacagccaggaattggacaacacatctaaaagttttaagcgcatcttggtcctcgtctcccattcccaggattttctgaatggtgtctgtaccaatatcattcacatgcacaacaagaaactgaagtattatacgggtaattatgatcagtatgtgaagacgcggctagagctggaggagaaccagatgaagaggtttcactgggagcaagatcagattgcacacatgaagaactacattgcgaggtttggtcatggcagtgccaagctggcccggcaggcccagagcaaggagaagacgctacagaaaatgatggcatcaggactgacagagagggtcgtgagcgataagacactgtcattttatttcccaccatgtggcaagatccctccacctgtcattatggtgcaaaatgtgagcttcaagtatacaaaagatgggccttgcatctacaataatctagaatttggaattgaccttgacacacgagtggctctggtagggcccaatggagcagggaagtcaactcttctgaagctgctaactggagagctactacccacagatggcatgatccgaaaacactctcatgtcaagatagggcgttaccatcagcatttacaagagcagctggacttagatctctcacctttggagtacatgatgaagtgctacccagagatcaaggagaaggaagaaatgaggaagatcattgggcgatacggtctcactgggaaacaacaggtgagcccaatccggaacttgtcagacgggcagaagtgccgagtgtgtctggcctggctggcctggcagaacccccacatgctcttcctggatgaacccaccaatcacctggatatcgagaccatcgacgccctggcagatgccatcaatgagtttgagggtggtatgatgctggtcagccatgacttcagactcattcagcaggttgcacaggaaatttgggtctgtgagaagcagacaatcaccaagtggcctggagacatcctggcttacaaggagcacctcaagtccaagctggtggatgaggagccccagctcaccaagaggacccacaacgtgtgagccctctacctgggttcgggtcaggagctccatctgggaactaacagctgctaacctgaccagccgctcaggacaggaccctggggctacactcctgcattgctgcaatactgctcccccagcctctcccctgcccctcaacctgccttagctgcactctcttacctacagctggacagtacctgtctgtttcctgtcctccttccagttacatctgtccatgtctggactcggctggccgttccctccagccccttgctggttatcttactctgagtgtgatgcagtcagaggcacctgcgggttagcccaggggcccaagccctggatttggcctgcggaggagcttaggatcctcgttttctgggttttggtgatgttggaggagtaccccccagcccaccgccccgattcctttttgcttctggtttggagctccggaccaggaccttcgtcctggtcagtttttaaataattatttagcagtgtaacttttaaacctgcgtgacatctacaaagcgcccaataaagaaagaggaagccacggtccct

SEQ ID NO: 455613 - DNA, 3620 bp, Homo sapiens
gcctgagtcggttaggtagctctaaaaactcgtaactccacaacagctcaatggattttcgagaggtggggtaaagcctgaaggctcagccggtttatccaacgagcaatctgggatttgcagtttccagcgcccgaagtgcgcccgctagcagagagctcttggactctaatcccgccccctccccgagcctcgcgcatcctgatggcgtcacgcggccccgcgaggtctgtgggatacatagtagtcctcaaggcgggtctcactcttggccgctgcaacttgaggactacacttccaaggaggcagcgcggcggcgcgccgagaaccacccgaggccgtgattggctggtgagccggccgcacgcggaggatcctaaggagcagctctgttgcgacataggccgagcagcgaggcccagctccctgaaacaacagtaacctacccctgtgggtcatcatcatgccctccgacctggccaagaagaaggcagccaaaaagaaggaggctgccaaagctcgacagcggcccagaaaaggacatgaagaaaatggagatgttgtcacagaaccacaggtggcagagaagaatgaggccaatggcagagagaccacagaagtagatttgctgaccaaggagctagaggactttgagatgaagaaagctgctgctcgagctgtcactggcgtcctggcctctcacgtgagcccaatccggaacttgtcagacgggcagaagtgccgagtgtgtctggcctggctggcctggcagaacccccacatgctcttcctggatgaacccaccaatcacctggatatcgagaccatcgacgccctggcagatgccatcaatgagtttgagggtggtatgatgctggtcagccatgacttcagactcattcagcaggttgcacaggaaatttgggtctgtgagaagcagacaatcaccaagtggcctggagacatcctggcttacaaggagcacctcaagtccaagctggtggatgaggagccccagctcaccaagaggacccacaacgtgtgagccctctacctgggttcgggtcaggagctccatctgggaactaacagctgctaacctgaccagccgctcaggacaggaccctggggctacactcctgcattgctgcaatactgctcccccagcctctcccctgcccctcaacctgccttagctgcactctcttacctacagctggacagtacctgtctgtttcctgtcctccttccagttacatctgtccatgtctggactcggctggccgttccctccagccccttgctggttatcttactctgagtgtgatgcagtcagaggcacctgcgggttagcccaggggcccaagccctggatttggcctgcggaggagcttaggatcctcgttttctgggttttggtgatgttggaggagtaccccccagcccaccgccccgattcctttttgcttctggtttggagctccggaccaggaccttcgtcctggtcagtttttaaataattatttagcagtgtaacttttaaacctgcgtgacatctacaaagcgcccaataaagaaagaggaagccacggtccctaccttccttctcgggtctctggggccttctcctccctgcagtgccaacatgcactgcccacagcaggagctggatccagcgtcagtgtgtcgatgggaactgaagactagtccataggagctggaagaactttgtccctttacttctgatttgaaattgtaccttttctcaggcctgtgattcacagactttaacatgaatcagaatcacctggagggctcatgcaatcagattgccagatctcgcctcagcgtttctggttcaataggttttgggggagaccaagaacgttaacatttctagcaagtttccaggtgatgctgttgttgctggtctagagactattttgagaaccactgtccaggagcgtggttttctgattgtgatctgaggttctgccccaactgcacagcagttgggctgcttgttaaaaatgcaggccaggtgcggtggctcacacctgtaatcccagcgctttgggaggctgaggcaggtggatcacttgagctcaggagttcaagaccagcttgggaaacatggcaaaacccgtctttatgtgcctggaatcccacctgctcaggtggctagggtggatggatcgcttgagcccaggaggtggaggttgcagtgagctgagattgcaccactgcattccagcctggatgacagagcaaaaccctgtctcaaaaaaatgcagactggccaggcacagtggctcacacctgtaatccgactgtaagctcatcaccttgggaggccactgtaggaggatcaattgagcctagaagttcaagaccagcctgggcaaagtagggagaccccttctctacaaatagtaataaaatgaaccgggcatagtagcatgtgcctgcggtcccagctgctctgataagaggaggctcacttgagcccaggaggttgaggctgcagtgagcagagcgtgccgctacactccagcctgatgacagaccgagacactgtctcaaaaaaataaaaaaattcagattgctgagcatcagacctattgattaatcgcatttggtagaatgagagaggtgcagagatggccaggagtttgcattttcacaccaacgtctgtgaacctctcttcctattgggatacaggaaattttgtatttttacctgtccacagccatagttatcatcactgttgaattcacttccagcccagggctctgcataccttatctgggtcttttgaacttcaatagcatttcaccagtggccatccttcctggtgtggattcatcactctgcctctgaaatcagccatccctatgggaagacacagccatgatttttcagtactcataatacagccaggactggcgggagcaactgtcccagatggtgcttaaaccccttaggagctcatgatcttcttggaaagccagtaagacagaaccatacaggacacaaattagatgctaaattgtgatttagataggagacagaagtattcaaaaagggagggaaatttcttgtgagtagctgcccagaaaggtggaattggtgtgctctcacttgaaaaatgagtaggatcttctcagatggccacaaagtccaggagctgccctgggcaacagggacaggagcctcccgtgagacactgcagctgagacagatgggagtcctctgaccccagagggtactggcttgactgctttatgccttaagtggggcctggagcaaaatggcccaggttagtctgtcctgagagtccagagccttggttcaggggagaatggcatctggagagtgggctgctgggataatggggacagtgagggacagagcccttgatacttaaggaagtgctggatattgctaagaattcaggtagtctcgggatctccagagtctccatgctaggacaggagatcttcagaacctggaggaatggaaatagtctagtcagcttatttgtcaagaaaaatgtcaaccttggtaatttaaataatgctttaaaagtccacaaaatacatatttctaaaattaaaaa

SEQ ID NO: 455614 - DNA, 461 bp, Homo sapiens
ttgatgttgatacgaagattcctgagagggatggagcagggcccaggcattcttactagtaagtttagggtttgggggtatctgtttgccttccttcaggctccctgaagctccctgaaacaacagtaacctacccctgtgggtcatcatcatgccctccgacctggccaagaagaaggcagccaaaaagaaggaggctgccaaagctcgacagcggcccagaaaaggacatgaagaaaatggagatgttgtcacagaaccacaggtggcagagaagaatgaggccaatggcagagagaccacaggtgaattgagggaggggtgagttggggatggttgctaagacttaatgcatgccccagccagagttggaatcttgatgctgggggtagtggagaatgtatctggtgtcatgcaacttttcatgatgaatcaaatcagtagagttggaattcgtgcca

SEQ ID NO: 455615 - DNA, 4910 bp, Homo sapiens
gcctgagtcggttaggtagctctaaaaactcgtaactccacaacagctcaatggattttcgagaggtggggtaaagcctgaaggctcagccggtttatccaacgagcaatctgggatttgcagtttccagcgcccgaagtgcgcccgctagcagagagctcttggactctaatcccgccccctccccgagcctcgcgcatcctgatggcgtcacgcggccccgcgaggtctgtgggatacatagtagtcctcaaggcgggtctcactcttggccgctgcaacttgaggactacacttccaaggaggcagcgcggcggcgcgccgagaaccacccgaggccgtgattggctggtgagccggccgcacgcggaggatcctaaggagcagctctgttgcgacataggccgagcagcgaggcccagctccctgaaacaacagtaacctacccctgtgggtcatcatcatgccctccgacctggccaagaagaaggcagccaaaaagaaggaggctgccaaagctcgacagcggcccagaaaaggacatgaagaaaatggagatgttgtcacagaaccacaggtggcagagaagaatgaggccaatggcagagagaccacagaagtagatttgctgaccaaggagctagaggactttgagatgaagaaagctgctgctcgagctgtcactggcgtcctggcctctcaccccaacagtactgatgttcacatcatcaacctctcactcacctttcatggtcaagagctgctcagtgacaccaaactggaattaaactcaggccgtcgttatggcctcattggtttaaatggaattggaaagtccatgctgctctctgctattgggaagcgtgaagtgcccatccctgagcacatcgacatctaccatctgactcgagagatgccccctagtgacaagacacccttgcattgtgtgatggaagtcgacacagagcgggccatgctggagaaagaggcagagcggctggctcatgaggatgcggagtgtgagaagctcatggagctctacgagcgcctggaggagctggatgccgacaaggcagagatgagggcctcgcggatcttgcatggactgggtttcacacctgccatgcagcgcaagaagctaaaagacttcagtgggggctggaggatgagggttgcccttgccagagccctctttattcggcccttcatgctgctcctggatgagcctaccaaccacctggacctagatgcttgcgtgtggttggaagaagaactaaaaacttttaagcgcatcttggtcctcgtctcccattcccaggattttctgaatggtgtctgtaccaatatcattcacatgcacaacaagaaactgaagtattatacgggtaattatgatcagtatgtgaagacgcggctagagctggaggagaaccagatgaagaggtttcactgggagcaagatcagattgcacacatgaagaactacattgcgaggtttggtcatggcagtgccaagctggcccggcaggcccagagcaaggagaagacgctacagaaaatgatggcatcaggactgacagagagggtcgtgagcgataagacactgtcattttatttcccaccatgtggcaagatccctccacctgtcattatggtgcaaaatgtgagcttcaagtatacaaaagatgggccttgcatctacaataatctagaatttggaattgaccttgacacacgagtggctctggtagggcccaatggagcagggaagtcaactcttctgaagctgctaactggagagctactacccacagatggcatgatccgaaaacactctcatgtcaagatagggcgttaccatcagcatttacaagagcagctggacttagatctctcacctttggagtacatgatgaagtgctacccagagatcaaggagaaggaagaaatgaggaagatcattgggcgatacggtctcactgggaaacaacaggtgagcccaatccggaacttgtcagacgggcagaagtgccgagtgtgtctggcctggctggcctggcagaacccccacatgctcttcctggatgaacccaccaatcacctggatatcgagaccatcgacgccctggcagatgccatcaatgagtttgagggtggtatgatgctggtcagccatgacttcagactcattcagcaggttgcacaggaaatttgggtctgtgagaagcagacaatcaccaagtggcctggagacatcctggcttacaaggagcacctcaagtccaagctggtggatgaggagccccagctcaccaagaggacccacaacgtgtgagccctctacctgggttcgggtcaggagctccatctgggaactaacagctgctaacctgaccagccgctcaggacaggaccctggggctacactcctgcattgctgcaatactgctcccccagcctctcccctgcccctcaacctgccttagctgcactctcttacctacagctggacagtacctgtctgtttcctgtcctccttccagttacatctgtccatgtctggactcggctggccgttccctccagccccttgctggttatcttactctgagtgtgatgcagtcagaggcacctgcgggttagcccaggggcccaagccctggatttggcctgcggaggagcttaggatcctcgttttctgggttttggtgatgttggaggagtaccccccagcccaccgccccgattcctttttgcttctggtttggagctccggaccaggaccttcgtcctggtcagtttttaaataattatttagcagtgtaacttttaaacctgcgtgacatctacaaagcgcccaataaagaaagaggaagccacggtccctaccttccttctcgggtctctggggccttctcctccctgcagtgccaacatgcactgcccacagcaggagctggatccagcgtcagtgtgtcgatgggaactgaagactagtccataggagctggaagaactttgtccctttacttctgatttgaaattgtaccttttctcaggcctgtgattcacagactttaacatgaatcagaatcacctggagggctcatgcaatcagattgccagatctcgcctcagcgtttctggttcaataggttttgggggagaccaagaacgttaacatttctagcaagtttccaggtgatgctgttgttgctggtctagagactattttgagaaccactgtccaggagcgtggttttctgattgtgatctgaggttctgccccaactgcacagcagttgggctgcttgttaaaaatgcaggccaggtgcggtggctcacacctgtaatcccagcgctttgggaggctgaggcaggtggatcacttgagctcaggagttcaagaccagcttgggaaacatggcaaaacccgtctttatgtgcctggaatcccacctgctcaggtggctagggtggatggatcgcttgagcccaggaggtggaggttgcagtgagctgagattgcaccactgcattccagcctggatgacagagcaaaaccctgtctcaaaaaaatgcagactggccaggcacagtggctcacacctgtaatccgactgtaagctcatcaccttgggaggccactgtaggaggatcaattgagcctagaagttcaagaccagcctgggcaaagtagggagaccccttctctacaaatagtaataaaatgaaccgggcatagtagcatgtgcctgcggtcccagctgctctgataagaggaggctcacttgagcccaggaggttgaggctgcagtgagcagagcgtgccgctacactccagcctgatgacagaccgagacactgtctcaaaaaaataaaaaaattcagattgctgagcatcagacctattgattaatcgcatttggtagaatgagagaggtgcagagatggccaggagtttgcattttcacaccaacgtctgtgaacctctcttcctattgggatacaggaaattttgtatttttacctgtccacagccatagttatcatcactgttgaattcacttccagcccagggctctgcataccttatctgggtcttttgaacttcaatagcatttcaccagtggccatccttcctggtgtggattcatcactctgcctctgaaatcagccatccctatgggaagacacagccatgatttttcagtactcataatacagccaggactggcgggagcaactgtcccagatggtgcttaaaccccttaggagctcatgatcttcttggaaagccagtaagacagaaccatacaggacacaaattagatgctaaattgtgatttagataggagacagaagtattcaaaaagggagggaaatttcttgtgagtagctgcccagaaaggtggaattggtgtgctctcacttgaaaaatgagtaggatcttctcagatggccacaaagtccaggagctgccctgggcaacagggacaggagcctcccgtgagacactgcagctgagacagatgggagtcctctgaccccagagggtactggcttgactgctttatgccttaagtggggcctggagcaaaatggcccaggttagtctgtcctgagagtccagagccttggttcaggggagaatggcatctggagagtgggctgctgggataatggggacagtgagggacagagcccttgatacttaaggaagtgctggatattgctaagaattcaggtagtctcgggatctccagagtctccatgctaggacaggagatcttcagaacctggaggaatggaaatagtctagtcagcttatttgtcaagaaaaatgtcaaccttggtaatttaaataatgctttaaaagtccacaaaatacatatttctaaaattaaaaa

SEQ ID NO: 455616 - DNA, 3469 bp, Homo sapiens
gcctgagtcggttaggtagctctaaaaactcgtaactccacaacagctcaatggattttcgagaggtggggtaaagcctgaaggctcagccggtttatccaacgagcaatctgggatttgcagtttccagcgcccgaagtgcgcccgctagcagagagctcttggactctaatcccgccccctccccgagcctcgcgcatcctgatggcgtcacgcggccccgcgaggtctgtgggatacatagtagtcctcaaggcgggtctcactcttggccgctgcaacttgaggactacacttccaaggaggcagcgcggcggcgcgccgagaaccacccgaggccgtgattggctggtgagccggccgcacgcggaggatcctaaggagcagctctgttgcgacataggccgagcagcgaggcccagctccctgaaacaacagtaacctacccctgtgggtcatcatcatgccctccgacctggccaagaagaaggcagccaaaaagaaggaggctgccaaagctcgacagcggcccagaaaaggacatgaagaaaatggagatgttgtcacagaaccacaggtggcagagaagaatgaggccaatggcagagagaccacagaagtagatttgctgaccaaggagctagaggactttgagatgaagaaagctgctgctcgagctgtcactggcgtcctggcctctcaccccaacagtactgatgttcacatcatcaacctctcactcacctttcatggtcaagagctgctcagtgacaccaaactggaattaaactcaggccgtcgttatggcctcattggtttaaatggaattggaaagtccatgctgctctctgctattgggaagcgtgaagtgcccatccctgagcacatcgacatctaccatctgactcgagagatgccccctagtgacaagacacccttgcattgtgtgatggaagtcgacacagagcgggccatgctggagaaagaggcagagcggctggctcatgaggatgcggagtgtgagaagctcatggagctctacgagcgcctggaggagctggatgccgacaaggcagagatgagggcctcgcggatcttgcatggactgggtttcacacctgccatgcagcgcaagaagctaaaagacttcagtgggggctggaggatgagggttgcccttgccagagccctctttattcggcccttcatgctgctcctggatgagcctaccaaccacctggacctagatgcttgcgtgtggttggaagaagaactaaaaacttttaagcgcatcttggtcctcgtctcccattcccaggattttctgaatggtgtctgtaccaatatcattcacatgcacaacaagaaactgaagtattatacgggtaattatgatcagtatgtgaagacgcggctagagctggaggagaaccagatgaagaggtttcactgggagcaagatcagattgcacacatgaagaactacattgcgaggtttggtcatggcagtgccaagctggcccggcaggcccagagcaaggagaagacgctacagaaaatgatggcatcaggactgacagagagggtcgtgagcgataagacactgtcattttatttcccaccatgtggcaagatccctccacctgtcattatggtgcaaaatgtgagcttcaagtatacaaaagatgggccttgcatctacaataatctagaatttggaattgaccttgacacacgagtggctctggtagggcccaatggagcagggaagtcaactcttctgaagctgctaactggagagctactacccacagatggcatgatccgaaaacactctcatgtcaagatagggcgttaccatcagcatttacaagagcagctggacttagatctctcacctttggagtacatgatgaagtgctacccagagatcaaggagaaggaagaaatgaggaagatcattgggcgatacggtctcactgggaaacaacaggtgagcccaatccggaacttgtcagacgggcagaagtgccgagtgtgtctggcctggctggcctggcagaacccccacatgctcttcctggatgaacccaccaatcacctggatatcgagaccatcgacgccctggcagatgccatcaatgagtttgagggtggtatgatgctggtcagccatgacttcagactcattcagcaggttgcacaggaaatttgggtctgtgagaagcagacaatcaccaagtggcctggagacatcctggcttacaaggagcacctcaagtccaagctggtggatgaggagccccagctcaccaagaggacccacaacgtgtgagccctctacctgggttcgggtcaggagctccatctgggaactaacagctgctaacctgaccagccgctcaggacaggaccctggggctacactcctgcattgctgcaatactgctcccccagcctctcccctgcccctcaacctgccttagctgcactctcttacctacagctggacagtacctgtctgtttcctgtcctccttccagttacatctgtccatgtctggactcggctggccgttccctccagccccttgctggttatcttactctgagtgtgatgcagtcagaggcacctgcgggttagcccaggggcccaagccctggatttggcctgcggaggagcttaggatcctcgttttctgggttttggtgatgttggaggagtaccccccagcccaccgccccgattcctttttgcttctggtttggagctccggaccaggaccttcgtcctggtcagtttttaaataattatttagcagtgtaacttttaaacctgcgtgacatctacaaagcgcccaataaagaaagaggaagccacggtccctaccttccttctcgggtctctggggccttctcctccctgcagtgccaacatgcactgcccacagcaggagctggatccagcgtcagtgtgtcgatgggaactgaagactagtccataggagctggaagaactttgtccctttacttctgatttgaaattgtaccttttctcaggcctgtgattcacagactttaacatgaatcagaatcacctggagggctcatgcaatcagatggcttgactgctttatgccttaagtggggcctggagcaaaatggcccaggttagtctgtcctgagagtccagagccttggttcaggggagaatggcatctggagagtgggctgctgggataatggggacagtgagggacagagcccttgatacttaaggaagtgctggatattgctaagaattcaggtagtctcgggatctccagagtctccatgctaggacaggagatcttcagaacctggaggaatggaaatagtctagtcagcttatttgtcaagaaaaatgtcaaccttggtaatttaaataatgctttaaaagtccacaaaatacatatttctaaaattaaaaa

SEQ ID NO: 455617 - DNA, 3173 bp, Homo sapiens
gcctgagtcggttaggtagctctaaaaactcgtaactccacaacagctcaatggattttcgagaggtggggtaaagcctgaaggctcagccggtttatccaacgagcaatctgggatttgcagtttccagcgcccgaagtgcgcccgctagcagagagctcttggactctaatcccgccccctccccgagcctcgcgcatcctgatggcgtcacgcggccccgcgaggtctgtgggatacatagtagtcctcaaggcgggtctcactcttggccgctgcaacttgaggactacacttccaaggaggcagcgcggcggcgcgccgagaaccacccgaggccgtgattggctggtgagccggccgcacgcggaggatcctaaggagcagctctgttgcgacataggccgagcagcgaggcccagctccctgaaacaacagtaacctacccctgtgggtcatcatcatgccctccgacctggccaagaagaaggcagccaaaaagaaggaggctgccaaagctcgacagcggcccagaaaaggacatgaagaaaatggagatgttgtcacagaaccacaggtggcagagaagaatgaggccaatggcagagagaccacagaagtagatttgctgaccaaggagctagaggactttgagatgaagaaagctgctgctcgagctgtcactggcgtcctggcctctcaccccaacagtactgatgttcacatcatcaacctctcactcacctttcatggtcaagagctgctcagtgacaccaaactggaattaaactcaggccgtcgttatggcctcattggtttaaatggaattggaaagtccatgctgctctctgctattgggaagcgtgaagtgcccatccctgagcacatcgacatctaccatctgactcgagagatgccccctagtgacaagacacccttgcattgtgtgatggaagtcgacacagagcgggccatgctggagaaagaggcagagcggctggctcatgaggatgcggagtgtgagaagctcatggagctctacgagcgcctggaggagctggatgccgacaaggcagagatgagggcctcgcggatcttgcatggactgggtttcacacctgccatgcagcgcaagaagctaaaagacttcagtgggggctggaggatgagggttgcccttgccagagccctctttattcggcccttcatgctgctcctggatgagcctaccaaccacctggacctagatgcttgcgtgtggttggaagaagaactaaaaacttttaagcgcatcttggtcctcgtctcccattcccaggattttctgaatggtgtctgtaccaatatcattcacatgcacaacaagaaactgaagtattatacgggtaattatgatcagtatgtgaagacgcggctagagctggaggagaaccagatgaagaggtttcactgggagcaagatcagattgcacacatgaagaactacattgcgaggtttggtcatggcagtgccaagctggcccggcaggcccagagcaaggagaagacgctacagaaaatgatggcatcaggactgacagagagggtcgtgagcgataagacactgtcattttatttcccaccatgtggcaagatccctccacctgtcattatggtgcaaaatgtgagcttcaagtatacaaaagatgggccttgcatctacaataatctagaatttggaattgaccttgacacacgagtggctctggtagggcccaatggagcagggaagtcaactcttctgaagctgctaactggagagctactacccacagatggcatgatccgaaaacactctcatgtcaagatagggcgttaccatcagcatttacaagagcagctggacttagatctctcacctttggagtacatgatgaagtgctacccagagatcaaggagaaggaagaaatgaggaagatcattgggcgatacggtctcactgggaaacaacaggtgagcccaatccggaacttgtcagacgggcagaagtgccgagtgtgtctggcctggctggcctggcagaacccccacatgctcttcctggatgaacccaccaatcacctggatatcgagaccatcgacgccctggcagatgccatcaatgagtttgagggtggtatgatgctggtcagccatgacttcagactcattcagcaggttgcacaggaaatttgggtctgtgagaagcagacaatcaccaagtggcctggagacatcctggcttacaaggagcacctcaagtccaagctggtggatgaggagccccagctcaccaagaggacccacaacgtgtgagccctctacctgggttcgggtcaggagctccatctgggaactaacagctgctaacctgaccagccgctcaggacaggaccctggggctacactcctgcattgctgcaatactgctcccccagcctctcccctgcccctcaacctgccttagctgcactctcttacctacagctggacagtacctgtctgtttcctgtcctccttccagttacatctgtccatgtctggactcggctggccgttccctccagccccttgctggttatcttactctgagtgtgatgcagtcagaggcacctgcgggttagcccaggggcccaagccctggatttggcctgcggaggagcttaggatcctcgttttctgggttttggtgatgttggaggagtaccccccagcccaccgccccgattcctttttgcttctggtttggagctccggaccaggaccttcgtcctggtcagtttttaaataattatttagcagtgtaacttttaaacctgcgtgacatctacgataaacaccggtgtttatcgatgccacataccccatggtatgtaggcttctccctggggtatgtggtaatccacatctgtcatatcttagtgcccaacctgttgttcctagcacccagtttgggtactggtaaagcttggtgactttaggcctaagagagacctaaaatgggtggcctactgacagttccaggtgacagccatggtctgaggatgtgggtgatatgataggaaacaatgtgggcttcacatacaaatgggcataggttcaaatcccagatctacttattctttgacgttgaaaacattacttaattctgagt

SEQ ID NO: 455618 - DNA, 2181 bp, Homo sapiens
ttccaagcgtccccgactccagctataactgagaccctccacttggggctctctacaactgcgacacttcgcgaacacgctccaatgcctagactcctcctgcgctactacgcgcgaaagccgtgaaagatgccccaatccccttgaagccaacaatccgaactatcgtaaccaatcctgaaactcccgaaagcagcaaattgccccccccatataagtgacaagacacccttgcattgtgtgatggaagtcgacacagagcgggccatgctggagaaagaggcagagcggctggctcatgaggatgcggagtgtgagaagctcatggagctctacgagcgcctggaggagctggatgccgacaaggcagagatgagggcctcgcggatcttgcatggactgggtttcacacctgccatgcagcgcaagaagctaaaagacttcagtgggggctggaggatgagggttgcccttgccagagccctctttattcggcccttcatgctgctcctggatgagcctaccaaccacctggacctagatgcttgcgtgtggttggaagaagaactaaaaacttttaagcgcatcttggtcctcgtctcccattcccaggattttctgaatggtgtctgtaccaatatcattcacatgcacaacaagaaactgaagtattatacgggtaattatgatcagtatgtgaagacgcggctagagctggaggagaaccagatgaagaggtttcactgggagcaagatcagattgcacacatgaagaactacattgcgaggtttggtcatggcagtgccaagctggcccggcaggcccagagcaaggagaagacgctacagaaaatgatggcatcaggactgacagagagggtcgtgagcgataagacactgtcattttatttcccaccatgtggcaagatccctccacctgtcattatggtgcaaaatgtgagcttcaagtatacaaaagatgggccttgcatctacaataatctagaatttggaattgaccttgacacacgagtggctctggtagggcccaatggagcagggaagtcaactcttctgaagctgctaactggagagctactacccacagatggcatgatccgaaaacactctcatgtcaagatagggcgttaccatcagcatttacaagagcagctggacttagatctctcacctttggagtacatgatgaagtgctacccagagatcaaggagaaggaagaaatgaggaagatcattgggcgatacggtctcactgggaaacaacaggtgagcccaatccggaacttgtcagacgggcagaagtgccgagtgtgtctggcctggctggcctggcagaacccccacatgctcttcctggatgaacccaccaatcacctggatatcgagaccatcgacgccctggcagatgccatcaatgagtttgagggtggtatgatgctggtcagccatgacttcagactcattcagcaggttgcacaggaaatttgggtctgtgagaagcagacaatcaccaagtggcctggagacatcctggcttacaaggagcacctcaagtccaagctggtggatgaggagccccagctcaccaagaggacccacaacgtgtgagccctctacctgggttcgggtcaggagctccatctgggaactaacagctgctaacctgaccagccgctcaggacaggaccctggggctacactcctgcattgctgcaatactgctcccccagcctctcccctgcccctcaacctgccttagctgcactctcttacctacagctggacagtacctgtctgtttcctgtcctccttccagttacatctgtccatgtctggactcggctggccgttccctccagccccttgctggttatcttactctgagtgtgatgcagtcagaggcacctgcgggttagcccaggggcccaagccctggatttggcctgcggaggagcttaggatcctcgttttctgggttttggtgatgttggaggagtaccccccagcccaccgccccgattcctttttgcttctggtttggagctccggaccaggaccttcgtcctggtcagtttttaaataattatttagcagtgtaacttttaaacctgcgtgacatctacaaagcgcccaataaagaaagaggaagccacggtccct

SEQ ID NO: 455619 - DNA, 1504 bp, Homo sapiens
gcctgagtcggttaggtagctctaaaaactcgtaactccacaacagctcaatggattttcgagaggtggggtaaagcctgaaggctcagccggtttatccaacgagcaatctgggatttgcagtttccagcgcccgaagtgcgcccgctagcagagagctcttggactctaatcccgccccctccccgagcctcgcgcatcctgatggcgtcacgcggccccgcgaggtctgtgggatacatagtagtcctcaaggcgggtctcactcttggccgctgcaacttgaggactacacttccaaggaggcagcgcggcggcgcgccgagaaccacccgaggccgtgattggctggtgagccggccgcacgcggaggatcctaaggagcagctctgttgcgacataggccgagcagcgaggcccagctccctgaaacaacagtaacctacccctgtgggtcatcatcatgccctccgacctggccaagaagaaggcagccaaaaagaaggaggctgccaaagctcgacagcggcccagaaaaggacatgaagaaaatggagatgttgtcacagaaccacaggtggcagagaagaatgaggccaatggcagagagaccacagaagtagatttgctgaccaaggagctagaggactttgagatgaagaaagctgctgctcgagctgtcactggcgtcctggcctctcaccccaacagtactgatgttcacatcatcaacctctcactcacctttcatggtcaagagctgctcagtgacaccaaactggaattaaactcaggccgtcgttatggcctcattggtttaaatggaattggaaagtccatgctgctctctgctattgggaagcgtgaagtgcccatccctgagcacatcgacatctaccatctgactcgagagatgccccctagtgacaagacacccttgcattgtgtgatggaagtcgacacagagcgggccatgctggagaaagaggcagagcggctggctcatgaggatgcggagtgtgagaagctcatggagctctacgagcgcctggaggagctggatgccgacaaggcagagatgagggcctcgcggatcttgcatggactgggtttcacacctgccatgcagcgcaagaagctaaaagacttcagtgggggctggaggatgagggttgcccttgccagagccctctttattcggcccttcatgctgctcctggatgagcctaccaaccacctggacctagatgcttgcgtgtggttggaagaagaactaaaaacgtaagagggtggaatgggggatgtgagcgggcaggtcccaaagggggaatctagaaaatggatgcccagaaactgcactgatgttagagcggtgagaaaggaactgaaggaaggacagagttcactttcttggacaagcagtgagcacctttagggctgttgaaggctggccttttattttgattgtttttctttagtttgaaatttatgagctttttttttt

SEQ ID NO: 455620 - DNA, 3460 bp, Homo sapiens
tgctgaggagcggagcctccgcctggggggccccccatccctggctgtcccccagctgcgcgtccccgccccacccccgcggctgagccaccaccggtgcagtggtctccgcttggcggagcgagccttgagcttcgttccacagcttctttgcatcttggatttcggggcggccccctcccccacctctctctgcctttttgtaccccgctttttttctgcgttctgctcggtttttgtagccgtctgtttttgcaccccatttcgttttgtttctagacggtttgggggggggtgaagctgcattcataccccttcctcttgttattctcccctgctctgacagcaccccttttcatcgcagttggggggcctaggatcggtgcatcttccgccgcgctgccagcaccccgcagcgcgtggtcgtgcaccccggaatctgcagcagctgcatatctgaggggggtctcctttgcccgcgccgccttcgctccccgtgcttttgggtgtgtggagggcttcagcgcgcggcgcccccgcttctccgcaaccccccgccccgcgcccggactcgccccgcgccaccaagatggtcatccagaaagagaagaagagctgcgggcaggtggttgaggagtggaaggagttcgtgtggaacccgaggacgcaccagtttatgggccgcaccgggaccagctgggcctttatcctcctcttctacctcgttttttatgggttcctcaccgccatgttcaccctcaccatgtgggtgatgctgcagactgtctccgaccatacccccaagtaccaggaccgactggccacaccgggcttgatgattcgccccaagactgagaaccttgatgtcattgtcaatgtcagtgacactgaaagctgggaccagcatgttcagaagctcaacaagttcttggagcgtgagtgtgggcctggttatgtgtcagttcaagacttcgggcaggggactggggaccttggaagtggaacatctggcccctgagtctctccctcccacctctttagcttacaacgactctatccaagcccaaaagaatgatgtctgccgccctgggcgctattacgaacagccagataatggagtcctcaactaccccaaacgtgcctgccaattcaaccggacccagctgggcaactgctccggcattggggactccacccactatggttacagcactgggcagccctgtgtcttcatcaagatgaaccgggtcatcaacttctatgcaggagcaaaccagagcatgaatgttacctgtgctgggaagcgagatgaagatgctgagaatctcggcaacttcgtcatgttccccgccaacggcaacatcgacctcatgtacttcccctactatggcaaaaagttccacgtgaactacacacagcccctggtggctgtgaagttcctgaatgtgacccccaacgtggaggtgaatgtagaatgtcgcatcaacgccgccaacatcgccacagacgatgagcgagacaagttcgccggccgcgtggccttcaaactccgcatcaacaaaacctgaggccccttcctcccaccccatctctctcctgtggatgctcctggaatgtccctgaccctgcctgatccctccctcacccaccccaaaggtatttttgataacagagctatgacttgtctgagcctcacatccttttccttgacttctcaacccagcctgaagtccattgcggttccgtcactcgcctttcccaccaacttctcccaacctcagatcagtcagacagggagctgggctaagatggccacagaggagttaggagcctttctagttctggtttagctgtgagagctatccactctcctgcctgcatatcccctgagagttataggaagtgcccactgacccacccacccacctacaccccccgccacacacacacacaaacgtgcacacgcgtctcatttgacccctttgcttccagagatgaatgtggcactccctccttccattcctaagctctagccaccgtcccttgatctctcatactttctccctgtctacacagtcgccatcttggtgactttgaatttatctggctcctgggcaggtcttctcctcctctccatccctattccctcctctgaaatgcacccctttgtaattgaggacaaggtggttctgtggccttttccctctttgctggcacgttctgcttctcaccctctggtgactctgtgagctgggaaatgagggactggaagtgaggcctgtgttgacccttcctgaaaatcctctagcagcccccgacttcagcagtttctttctttgtttttttgagatggagtttcgctcttgttgcccaggctggagtgcaatggtgcaatctcagctcactgcaacttccgcatcccaggttcaagcgattctcccgcctcaggttcccgagtagctgggactacaggcatgtgccaccatgcccggctaatttctttctttctttttttttttttttgcattttttagtagagatgggggtttctccttgttggtcaggctggtctcgaactcccgacctcaggtgatccacctgcctcggcctcccaaagtgttgggattacaggcgtgagccaccgcgcccggccttcagtttcttcctaggccgttctgtcacccaaatagctgctacccagaggggcggggttgacctaggctgaatatccactttgtttttatggatggctcccttcccccattcgccttcccagaatatccttcaagttccacttcccagggagctctgggggaggggcggccattctggctccgtccccagtggccaccttggaaacatcggctggctttgggactattccacctccttcccctgagcccagatctgcccccaccatcctttctctggcttcttttagcaagttatcaactaatcactaactccttccttttcctctgcatgccagcctgaaaattccaaatctagcctctgaatgtcttggctccatctcttcagacccctttgcctttaaaaaaaaaacaaaaacaaaaacaaaaaaacccataatgcccacagaatgtcaaatgaggggcctcctgcctcctgctctgaatattctgtagctgtagaggcattttaaccctttgtcctccagcatcccttcacttcctcatcctctctaacctcctttttctttttttaatgctgcagcctccacactccacccacaggtggacccttccctttttctctagctggatctgtgtttcttcccttcgggcccccatgttttcctgcacccgccctaccatggtctctctctgcagttatttaatgcctgtgtcagatctactgtaaaaagaggattaagtaaaataaaatgagagcaattatatatataaatatatatcatacacagagccctgtgtgtgggttg

SEQ ID NO: 455621 - DNA, 2891 bp, Homo sapiens
tgctgaggagcggagcctccgcctggggggccccccatccctggctgtcccccagctgcgcgtccccgccccacccccgcggctgagccaccaccggtgcagtggtctccgcttggcggagcgagccttgagcttcgttccacagcttctttgcatcttggatttcggggcggccccctcccccacctctctctgcctttttgtaccccgctttttttctgcgttctgctcggtttttgtagccgtctgtttttgcaccccatttcgttttgtttctagacggtttgggggggggtgaagctgcattcataccccttcctcttgttattctcccctgctctgacagcaccccttttcatcgcagttggggggcctaggatcggtgcatcttccgccgcgctgccagcaccccgcagcgcgtggtcgtgcaccccggaatctgcagcagctgcatatctgaggggggtctcctttgcccgcgccgccttcgctccccgtgcttttgggtgtgtggagggcttcagcgcgcggcgcccccgcttctccgcaaccccccgccccgcgcccggactcgccccgcgccaccaagatggtcatccagaaagagaagaagagctgcgggcaggtggttgaggagtggaaggagttcgtgtggaacccgaggacgcaccagtttatgggccgcaccgggaccagctgggcctttatcctcctcttctacctcgttttttatgggttcctcaccgccatgttcaccctcaccatgtgggtgatgctgcagactgtctccgaccatacccccaagtaccaggaccgactggccacaccgggcttgatgattcgccccaagactgagaaccttgatgtcattgtcaatgtcagtgacactgaaagctgggaccagcatgttcagaagctcaacaagttcttggagccttacaacgactctatccaagcccaaaagaatgatgtctgccgccctgggcgctattacgaacagccagataatggagtcctcaactaccccaaacgtgcctgccaattcaaccggacccagctgggcaactgctccggcattggggactccacccactatggttacagcactgggcagccctgtgtcttcatcaagatgaaccgggtcatcaacttctatgcaggagcaaaccagagcatgaatgttacctgtgctgggaagcgagatgaagatgctgagaatctcggcaacttcgtcatgttccccgccaacggcaacatcgacctcatgtacttcccctactatggcaaaaagttccacgtgaactacacacagcccctggtggctgtgaagttcctgaatgtgacccccaacgtggaggtgaatgtagaatgtcgcatcaacgccgccaacatcgccacagacgatgagcgagacaagttcgccggccgcgtggccttcaaactccgcatcaacaaaacctgaggccccttcctcccaccccatctctctcctgtggatgctcctggaatgtccctgaccctgcctgatccctccctcacccaccccaaaggtatttttgataacagagctatgacttgtctgagcctcacatccttttccttgacttctcaacccagcctgaagtccattgcggttccgtcactcgcctttcccaccaacttctcccaacctcagatcagtcagacagggagctgggctaagatggccacagaggagttaggagcctttctagttctggtttagctgtgagagctatccactctcctgcctgcatatcccctgagagttataggaagtgcccactgacccacccacccacctacaccccccgccacacacacacacaaacgtgcacacgcgtctcatttgacccctttgcttccagagatgaatgtggcactccctccttccattcctaagctctagccaccgtcccttgatctctcatactttctccctgtctacacagtcgccatcttggtgactttgaatttatctggctcctgggcaggtcttctcctcctctccatccctattccctcctctgaaatgcacccctttgtaattgaggacaaggtggttctgtggccttttccctctttgctggcacgttctgcttctcaccctctggtgactctgtgagctgggaaatgagggactggaagtgaggcctgtgttgacccttcctgaaaatcctctagcagcccccgacttcagcagtttctttctttgtttttttgagatggagtttcgctcttgttgcccaggctggagtgcaatggtgcaatctcagctcactgcaacttccgcatcccaggttcaagcgattctcccgcctcaggttcccgagtagctgggactacaggcatgtgccaccatgcccggctaatttctttctttctttttttttttttttgcattttttagtagagatgggggtttctccttgttggtcaggctggtctcgaactcccgacctcaggtgatccacctgcctcggcctcccaaagtgttgggattacaggcgtgagccaccgcgcccggccttcagtttcttcctaggccgttctgtcacccaaatagctgctacccagaggggcggggttgacctaggctgaatatccactttgtttttatggatggctcccttcccccattcgccttcccagaatatccttcaagttccacttcccagggagctctgggggaggggcggccattctggctccgtccccagtggccaccttggaaacatcggctggctttgggactattccacctccttcccctgagcccagatctgcccccaccatcctttctctggctccgtccccagtggccaccttggaaggagttagtgatcagcctgatcacgtatgctaaaagaagc

SEQ ID NO: 455622 - DNA, 3354 bp, Homo sapiens
tgctgaggagcggagcctccgcctggggggccccccatccctggctgtcccccagctgcgcgtccccgccccacccccgcggctgagccaccaccggtgcagtggtctccgcttggcggagcgagccttgagcttcgttccacagcttctttgcatcttggatttcggggcggccccctcccccacctctctctgcctttttgtaccccgctttttttctgcgttctgctcggtttttgtagccgtctgtttttgcaccccatttcgttttgtttctagacggtttgggggggggtgaagctgcattcataccccttcctcttgttattctcccctgctctgacagcaccccttttcatcgcagttggggggcctaggatcggtgcatcttccgccgcgctgccagcaccccgcagcgcgtggtcgtgcaccccggaatctgcagcagctgcatatctgaggggggtctcctttgcccgcgccgccttcgctccccgtgcttttgggtgtgtggagggcttcagcgcgcggcgcccccgcttctccgcaaccccccgccccgcgcccggactcgccccgcgccaccaagatggtcatccagaaagagaagaagagctgcgggcaggtggttgaggagtggaaggagttcgtgtggaacccgaggacgcaccagtttatgggccgcaccgggaccagctgggcctttatcctcctcttctacctcgttttttatgggttcctcaccgccatgttcaccctcaccatgtgggtgatgctgcagactgtctccgaccatacccccaagtaccaggaccgactggccacaccgggcttgatgattcgccccaagactgagaaccttgatgtcattgtcaatgtcagtgacactgaaagctgggaccagcatgttcagaagctcaacaagttcttggagccttacaacgactctatccaagcccaaaagaatgatgtctgccgccctgggcgctattacgaacagccagataatggagtcctcaactaccccaaacgtgcctgccaattcaaccggacccagctgggcaactgctccggcattggggactccacccactatggttacagcactgggcagccctgtgtcttcatcaagatgaaccgggtcatcaacttctatgcaggagcaaaccagagcatgaatgttacctgtgctgggaagcgagatgaagatgctgagaatctcggcaacttcgtcatgttccccgccaacggcaacatcgacctcatgtacttcccctactatggcaaaaagttccacgtgaactacacacagcccctggtggctgtgaagttcctgaatgtgacccccaacgtggaggtgaatgtagaatgtcgcatcaacgccgccaacatcgccacagacgatgagcgagacaagttcgccggccgcgtggccttcaaactccgcatcaacaaaacctgaggccccttcctcccaccccatctctctcctgtggatgctcctggaatgtccctgaccctgcctgatccctccctcacccaccccaaaggtatttttgataacagagctatgacttgtctgagcctcacatccttttccttgacttctcaacccagcctgaagtccattgcggttccgtcactcgcctttcccaccaacttctcccaacctcagatcagtcagacagggagctgggctaagatggccacagaggagttaggagcctttctagttctggtttagctgtgagagctatccactctcctgcctgcatatcccctgagagttataggaagtgcccactgacccacccacccacctacaccccccgccacacacacacacaaacgtgcacacgcgtctcatttgacccctttgcttccagagatgaatgtggcactccctccttccattcctaagctctagccaccgtcccttgatctctcatactttctccctgtctacacagtcgccatcttggtgactttgaatttatctggctcctgggcaggtcttctcctcctctccatccctattccctcctctgaaatgcacccctttgtaattgaggacaaggtggttctgtggccttttccctctttgctggcacgttctgcttctcaccctctggtgactctgtgagctgggaaatgagggactggaagtgaggcctgtgttgacccttcctgaaaatcctctagcagcccccgacttcagcagtttctttctttgtttttttgagatggagtttcgctcttgttgcccaggctggagtgcaatggtgcaatctcagctcactgcaacttccgcatcccaggttcaagcgattctcccgcctcaggttcccgagtagctgggactacaggcatgtgccaccatgcccggctaatttctttctttctttttttttttttttgcattttttagtagagatgggggtttctccttgttggtcaggctggtctcgaactcccgacctcaggtgatccacctgcctcggcctcccaaagtgttgggattacaggcgtgagccaccgcgcccggccttcagtttcttcctaggccgttctgtcacccaaatagctgctacccagaggggcggggttgacctaggctgaatatccactttgtttttatggatggctcccttcccccattcgccttcccagaatatccttcaagttccacttcccagggagctctgggggaggggcggccattctggctccgtccccagtggccaccttggaaacatcggctggctttgggactattccacctccttcccctgagcccagatctgcccccaccatcctttctctggcttcttttagcaagttatcaactaatcactaactccttccttttcctctgcatgccagcctgaaaattccaaatctagcctctgaatgtcttggctccatctcttcagacccctttgcctttaaaaaaaaaacaaaaacaaaaacaaaaaaacccataatgcccacagaatgtcaaatgaggggcctcctgcctcctgctctgaatattctgtagctgtagaggcattttaaccctttgtcctccagcatcccttcacttcctcatcctctctaacctcctttttctttttttaatgctgcagcctccacactccacccacaggtggacccttccctttttctctagctggatctgtgtttcttcccttcgggcccccatgttttcctgcacccgccctaccatggtctctctctgcagttatttaatgcctgtgtcagatctactgtaaaaagaggattaagtaaaataaaatgagagcaattatatatataaatatatatcatacacagagccctgtgtgtgggttg

SEQ ID NO: 455623 - DNA, 3955 bp, Homo sapiens
agcggggacccaggcgggcgggcagagcaggcggcaccgcacctcggccagaggcggctgcagcagctgctgcccttgtccctgccgccgcctctccagtcccttctgtgattaccactccagctgctgggaacgggcgagaaagaggaggaggcgagaaactcccaccgacccacagagggagcatgacttcggcaacttcacctatcattctgaaatgggaccccaaaagtttggaaatccggacgctaacagtggaaaggctgttggagccacttgttacacaggtgactacacttgtcaacacaagcaacaaaggcccatctggtaaaaagaaagggaggtcaaagaaagcccatgtactagctgcctctgtagagcaagccactcagaatttcctggaaaagggtgaacagatcgctaaggagagtcaagatctcaaagaagagttggtggctgctgtagaggatgtgcgcaaacaaggtgagacgatgcggatcgcctcctccgagtttgcagatgacccttgctcgtcggtaaagcgcggcaccatggtacgggcggcaagggctttgctctccgcggtgacacgcttactcatcctggcggacatggcagatgtcatgagacttttatcccatctgaaaattgtggaagaggccctggaagctgtcaaaaatgctacaaatgagcaagaccttgcaaaccgttttaaagagtttgggaaaaagatggtgaaacttaactatgtagcagcaagaagacaacaggagctgaaggatcctcactgtcgggatgagatggcagccgcccgaggggctctgaagaagaatgccacaatgctgtacacggcctctcaagcatttctccgccacccagatgtcgccgctacgagagccaaccgagattatgtgttcaaacaagtccaggaggccatcgccggcatctccaatgctgctcaagctacctcgcccactgacgaagccaagggccacacgggcatcggcgagctggctgcggctcttaatgagtttgacaataagattatcctggaccccatgacgttcagcgaggccaggttccggccgtccctggaggagaggctggagagcatcatcagcggcgcagcgctgatggccgactcctcctgcacgcgagacgaccggcgcgagaggatcgtggcggagtgcaacgccgtgcggcaggcgctccaggacctgctcagcgagtacatgaataatactggaaggaaagaaaaaggagatcctctcaacattgcgattgataagatgactaagaaaacaagagatctaaggagacagcttcggaaagcagtgatggatcacatatctgactctttcctggaaaccaatgttcctttgctagttctcattgaggctgcaaagagcggaaatgaaaaggaagtgaaagaatatgcccaagttttccgtgagcatgccaacaaactggtagaggttgccaatttggcctgttccatctccaacaatgaagaaggggtgaaattagttcggatggcagccacccagattgacagcctgtgtccccaggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcagaaaatcacatcttggaggatgtgaacaagtgtgtgatagccctccaagagggcgatgtggacactctggaccggactgcaggggccatcaggggccgggcagctcgagtcatacacatcatcaatgctgagatggagaactatgaagctggggtttatactgagaaggtgttggaagctacaaaattgctttctgaaacagtgatgccacgcttcgctgaacaagtagaggttgccattgaagccctgagtgccaacgttcctcaaccgtttgaggagaatgagttcatcgatgcctctcgcctggtgtatgatggcgttcgggacatcagaaaggctgtgctgatgatcaggaccccagaagaactagaggatgattctgactttgagcaggaagattatgatgtgcgtagcaggacaagtgttcagactgaggatgaccagctcattgcagggcagagcgcacgggccatcatggcgcaactaccgcaggaggagaaggcaaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaagaggcaaaggcccattgaaaaatacatctgatgtcattaatgctgccaagaaaattgccgaagcaggttctcgaatggacaaattagctcgtgctgtggctgatcagtgtcctgattcagcatgtaagcaggatttattagcctaccttcaacgaattgccttgtattgccatcagcttaatatctgcagcaaggtgaaggcagaagtgcagaatctgggaggagagctcattgtgtcagggacaggagttcagagcactttcactaccttttatgaggtagattgtgatgtcatagatgggggcagggctagtcaactttctacccacctcccaacctgtgctgagggagctccgatcgggagtggaagcagtgattcctccatgctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagaaaagcctgaagaattccagacacgagttcgacgaggttctcagaagaaacacatttcgcctgtacaggctttaagtgaattcaaagcaatggattccttctaggacgataggttttaacaagaaagctttttctttcttttctttctttctttttctttttaattccatttttgtatgcatacctgccagctcgtatgcctctggcatggggaaattaagggaacagtgtctgtttgcatgtaagatgagatgagatcaatactactgatccatctgtagcctgggaaggagacaggacattcctgtactaaggtggcacagagctgtcctttgcaacattctcataaaattgggcacagagttcgcattggcgcaatatttatgggagtgggagggatggggaaaataaacttaactctacaaaagcaaactctaatgcatgcaagaatcattaggttggcaggtatatgcataagtgaaaaatctggaagtgtaatggtagaacataaaacttgtattgcttctgtttcagtgcaaaaatgtactagccaatacgcttaagtgtgtggcccatgaattgaacaatttaaccttgaagtctatatccgtgatattatgtcgatttttaactgaggggaaattaactagtccagcctaaaatgcttcttttaatctgcattctgtttcctcttctagttgtgccattactagtgatcatgtttttttcccccctttaatgaaaacaataaacatctatttgagacaattaaaatccttctgggggcactggaagcacaatacggtgaccaatcttgctttcatttttttttctttttaatttgaaccatgattttgctagaaatagaaggcccagtggtggaatattagagggaaggaaactgacaacgtgtgaaagttagaggcaaatacataggtgtagcttggagtgctggtatctaatataccattgtattcactaactaactcaaaataaacacatttaatcttga

SEQ ID NO: 455624 - DNA, 3811 bp, Homo sapiens
agcggggacccaggcgggcgggcagagcaggcggcaccgcacctcggccagaggcggctgcagcagctgctgcccttgtccctgccgccgcctctccagtcccttctgtgattaccactccagctgctgggaacgggcgagaaagaggaggaggcgagaaactcccaccgacccacagagggagcatgacttcggcaacttcacctatcattctgaaatgggaccccaaaagtttggaaatccggacgctaacagtggaaaggctgttggagccacttgttacacaggtgactacacttgtcaacacaagcaacaaaggcccatctggtaaaaagaaagggaggtcaaagaaagcccatgtactagctgcctctgtagagcaagccactcagaatttcctggaaaagggtgaacagatcgctaaggagagtcaagatctcaaagaagagttggtggctgctgtagaggatgtgcgcaaacaaggtgagacgatgcggatcgcctcctccgagtttgcagatgacccttgctcgtcggtaaagcgcggcaccatggtacgggcggcaagggctttgctctccgcggtgacacgcttactcatcctggcggacatggcagatgtcatgagacttttatcccatctgaaaattgtggaagaggccctggaagctgtcaaaaatgctacaaatgagcaagaccttgcaaaccgttttaaagagtttgggaaaaagatggtgaaacttaactatgtagcagcaagaagacaacaggagctgaaggatcctcactgtcgggatgagatggcagccgcccgaggggctctgaagaagaatgccacaatgctgtacacggcctctcaagcatttctccgccacccagatgtcgccgctacgagagccaaccgagattatgtgttcaaacaagtccaggaggccatcgccggcatctccaatgctgctcaagctacctcgcccactgacgaagccaagggccacacgggcatcggcgagctggctgcggctcttaatgagtttgacaataagattatcctggaccccatgacgttcagcgaggccaggttccggccgtccctggaggagaggctggagagcatcatcagcggcgcagcgctgatggccgactcctcctgcacgcgagacgaccggcgcgagaggatcgtggcggagtgcaacgccgtgcggcaggcgctccaggacctgctcagcgagtacatgaataatactggaaggaaagaaaaaggagatcctctcaacattgcgattgataagatgactaagaaaacaagagatctaaggagacagcttcggaaagcagtgatggatcacatatctgactctttcctggaaaccaatgttcctttgctagttctcattgaggctgcaaagagcggaaatgaaaaggaagtgaaagaatatgcccaagttttccgtgagcatgccaacaaactggtagaggttgccaatttggcctgttccatctccaacaatgaagaaggggtgaaattagttcggatggcagccacccagattgacagcctgtgtccccaggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcagaaaatcacatcttggaggatgtgaacaagtgtgtgatagccctccaagagggcgatgtggacactctggaccggactgcaggggccatcaggggccgggcagctcgagtcatacacatcatcaatgctgagatggagaactatgaagctggggtttatactgagaaggtgttggaagctacaaaattgctttctgaaacagtgatgccacgcttcgctgaacaagtagaggttgccattgaagccctgagtgccaacgttcctcaaccgtttgaggagaatgagttcatcgatgcctctcgcctggtgtatgatggcgttcgggacatcagaaaggctgtgctgatgatcaggaccccagaagaactagaggatgattctgactttgagcaggaagattatgatgtgcgtagcaggacaagtgttcagactgaggatgaccagctcattgcagggcagagcgcacgggccatcatggcgcaactaccgcaggaggagaaggcaaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaagaggcaaaggcccattgaaaaatacatctgatgtcattaatgctgccaagaaaattgccgaagcaggttctcgaatggacaaattagctcgtgctgtggctgatcagtgtcctgattcagcatgtaagcaggatttattagcctaccttcaacgaattgccttgtattgccatcagcttaatatctgcagcaaggtgaaggcagaagtgcagaatctgggaggagagctcattgtgtcagggctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagaaaagcctgaagaattccagacacgagttcgacgaggttctcagaagaaacacatttcgcctgtacaggctttaagtgaattcaaagcaatggattccttctaggacgataggttttaacaagaaagctttttctttcttttctttctttctttttctttttaattccatttttgtatgcatacctgccagctcgtatgcctctggcatggggaaattaagggaacagtgtctgtttgcatgtaagatgagatgagatcaatactactgatccatctgtagcctgggaaggagacaggacattcctgtactaaggtggcacagagctgtcctttgcaacattctcataaaattgggcacagagttcgcattggcgcaatatttatgggagtgggagggatggggaaaataaacttaactctacaaaagcaaactctaatgcatgcaagaatcattaggttggcaggtatatgcataagtgaaaaatctggaagtgtaatggtagaacataaaacttgtattgcttctgtttcagtgcaaaaatgtactagccaatacgcttaagtgtgtggcccatgaattgaacaatttaaccttgaagtctatatccgtgatattatgtcgatttttaactgaggggaaattaactagtccagcctaaaatgcttcttttaatctgcattctgtttcctcttctagttgtgccattactagtgatcatgtttttttcccccctttaatgaaaacaataaacatctatttgagacaattaaaatccttctgggggcactggaagcacaatacggtgaccaatcttgctttcatttttttttctttttaatttgaaccatgattttgctagaaatagaaggcccagtggtggaatattagagggaaggaaactgacaacgtgtgaaagttagaggcaaatacataggtgtagcttggagtgctggtatctaatataccattgtattcactaactaactcaaaataaacacatttaatcttga

SEQ ID NO: 455625 - DNA, 2792 bp, Homo sapiens
tttggacctttgctttagaaaagcaacttgagagaagacacaggaaggcaatgatttggggcttggctaagatttttggggttttttccccctcttgcgggtactggaattctgcagtcagccagcccttttttgaggtggagaggggaaatgctttccaaacccacctagtttgggaagccatccaagtcccggtggtgtgagatccagtgtggcaaaaagactggaaggaaagaaaaaggagatcctctcaacattgcgattgataagatgactaagaaaacaagagatctaaggagacagcttcggaaagcagtgatggatcacatatctgactctttcctggaaaccaatgttcctttgctagttctcattgaggctgcaaagagcggaaatgaaaaggaagtgaaagaatatgcccaagttttccgtgagcatgccaacaaactggtagaggttgccaatttggcctgttccatctccaacaatgaagaaggggtgaaattagttcggatggcagccacccagattgacagcctgtgtccccaggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcagaaaatcacatcttggaggatgtgaacaagtgtgtgatagccctccaagagggcgatgtggacactctggaccggactgcaggggccatcaggggccgggcagctcgagtcatacacatcatcaatgctgagatggagaactatgaagctggggtttatactgagaaggtgttggaagctacaaaattgctttctgaaacagtgatgccacgcttcgctgaacaagtagaggttgccattgaagccctgagtgccaacgttcctcaaccgtttgaggagaatgagttcatcgatgcctctcgcctggtgtatgatggcgttcgggacatcagaaaggctgtgctgatgatcaggaccccagaagaactagaggatgattctgactttgagcaggaagattatgatgtgcgtagcaggacaagtgttcagactgaggatgaccagctcattgcagggcagagcgcacgggccatcatggcgcaactaccgcaggaggagaaggcaaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaagaggcaaaggcccattgaaaaatacatctgatgtcattaatgctgccaagaaaattgccgaagcaggttctcgaatggacaaattagctcgtgctgtggctgatcagtgtcctgattcagcatgtaagcaggatttattagcctaccttcaacgaattgccttgtattgccatcagcttaatatctgcagcaaggtgaaggcagaagtgcagaatctgggaggagagctcattgtgtcagggctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagaaaagcctgaagaattccagacacgagttcgacgaggttctcagaagaaacacatttcgcctgtacaggctttaagtgaattcaaagcaatggattccttctaggacgataggttttaacaagaaagctttttctttcttttctttctttctttttctttttaattccatttttgtatgcatacctgccagctcgtatgcctctggcatggggaaattaagggaacagtgtctgtttgcatgtaagatgagatgagatcaatactactgatccatctgtagcctgggaaggagacaggacattcctgtactaaggtggcacagagctgtcctttgcaacattctcataaaattgggcacagagttcgcattggcgcaatatttatgggagtgggagggatggggaaaataaacttaactctacaaaagcaaactctaatgcatgcaagaatcattaggttggcaggtatatgcataagtgaaaaatctggaagtgtaatggtagaacataaaacttgtattgcttctgtttcagtgcaaaaatgtactagccaatacgcttaagtgtgtggcccatgaattgaacaatttaaccttgaagtctatatccgtgatattatgtcgatttttaactgaggggaaattaactagtccagcctaaaatgcttcttttaatctgcattctgtttcctcttctagttgtgccattactagtgatcatgtttttttcccccctttaatgaaaacaataaacatctatttgagacaattaaaatccttctgggggcactggaagcacaatacggtgaccaatcttgctttcatttttttttctttttaatttgaaccatgattttgctagaaatagaaggcccagtggtggaatattagagggaaggaaactgacaacgtgtgaaagttagaggcaaatacataggtgtagcttggagtgctggtatctaatataccattgtattcactaactaactcaaaataaacacatttaatcttga

SEQ ID NO: 455626 - DNA, 4077 bp, Homo sapiens
agatttaagtctcagagccagcactcaggatgagtgccaatggaagcctgtccttggagtccagaatgaacgtcagaagcaacccagccacagcaggagactgtccatgaatgtcatctggctgaacctaaagtttccttagacacatgaatgaacacagtcatgctgtcaggaagaggaaaaggaagactgataaataaacgttcaatttaagccaatccagtatctatactgtagacctcagtgaaggctggaagactaatccaacacaatctgacatcctgattctttccaatcacctttatgttccaccctctcacctctggatttagatgcactccttcaaggaccatgggttctgcaacagtaccccctctccattgttccagctctgactcagatgggccctccttgatggcactcccagcagcacagccttagcactgggagcatgacttcggcaacttcacctatcattctgaaatgggaccccaaaagtttggaaatccggacgctaacagtggaaaggctgttggagccacttgttacacaggtgactacacttgtcaacacaagcaacaaaggcccatctggtaaaaagaaagggaggtcaaagaaagcccatgtactagctgcctctgtagagcaagccactcagaatttcctggaaaagggtgaacagatcgctaaggagagtcaagatctcaaagaagagttggtggctgctgtagaggatgtgcgcaaacaaggtgagacgatgcggatcgcctcctccgagtttgcagatgacccttgctcgtcggtaaagcgcggcaccatggtacgggcggcaagggctttgctctccgcggtgacacgcttactcatcctggcggacatggcagatgtcatgagacttttatcccatctgaaaattgtggaagaggccctggaagctgtcaaaaatgctacaaatgagcaagaccttgcaaaccgttttaaagagtttgggaaaaagatggtgaaacttaactatgtagcagcaagaagacaacaggagctgaaggatcctcactgtcgggatgagatggcagccgcccgaggggctctgaagaagaatgccacaatgctgtacacggcctctcaagcatttctccgccacccagatgtcgccgctacgagagccaaccgagattatgtgttcaaacaagtccaggaggccatcgccggcatctccaatgctgctcaagctacctcgcccactgacgaagccaagggccacacgggcatcggcgagctggctgcggctcttaatgagtttgacaataagattatcctggaccccatgacgttcagcgaggccaggttccggccgtccctggaggagaggctggagagcatcatcagcggcgcagcgctgatggccgactcctcctgcacgcgagacgaccggcgcgagaggatcgtggcggagtgcaacgccgtgcggcaggcgctccaggacctgctcagcgagtacatgaataatactggaaggaaagaaaaaggagatcctctcaacattgcgattgataagatgactaagaaaacaagagatctaaggagacagcttcggaaagcagtgatggatcacatatctgactctttcctggaaaccaatgttcctttgctagttctcattgaggctgcaaagagcggaaatgaaaaggaagtgaaagaatatgcccaagttttccgtgagcatgccaacaaactggtagaggttgccaatttggcctgttccatctccaacaatgaagaaggggtgaaattagttcggatggcagccacccagattgacagcctgtgtccccaggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcagaaaatcacatcttggaggatgtgaacaagtgtgtgatagccctccaagagggcgatgtggacactctggaccggactgcaggggccatcaggggccgggcagctcgagtcatacacatcatcaatgctgagatggagaactatgaagctggggtttatactgagaaggtgttggaagctacaaaattgctttctgaaacagtgatgccacgcttcgctgaacaagtagaggttgccattgaagccctgagtgccaacgttcctcaaccgtttgaggagaatgagttcatcgatgcctctcgcctggtgtatgatggcgttcgggacatcagaaaggctgtgctgatgatcaggaccccagaagaactagaggatgattctgactttgagcaggaagattatgatgtgcgtagcaggacaagtgttcagactgaggatgaccagctcattgcagggcagagcgcacgggccatcatggcgcaactaccgcaggaggagaaggcaaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaagaggcaaaggcccattgaaaaatacatctgatgtcattaatgctgccaagaaaattgccgaagcaggttctcgaatggacaaattagctcgtgctgtggctgatcagtgtcctgattcagcatgtaagcaggatttattagcctaccttcaacgaattgccttgtattgccatcagcttaatatctgcagcaaggtgaaggcagaagtgcagaatctgggaggagagctcattgtgtcagggctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagaaaagcctgaagaattccagacacgagttcgacgaggttctcagaagaaacacatttcgcctgtacaggctttaagtgaattcaaagcaatggattccttctaggacgataggttttaacaagaaagctttttctttcttttctttctttctttttctttttaattccatttttgtatgcatacctgccagctcgtatgcctctggcatggggaaattaagggaacagtgtctgtttgcatgtaagatgagatgagatcaatactactgatccatctgtagcctgggaaggagacaggacattcctgtactaaggtggcacagagctgtcctttgcaacattctcataaaattgggcacagagttcgcattggcgcaatatttatgggagtgggagggatggggaaaataaacttaactctacaaaagcaaactctaatgcatgcaagaatcattaggttggcaggtatatgcataagtgaaaaatctggaagtgtaatggtagaacataaaacttgtattgcttctgtttcagtgcaaaaatgtactagccaatacgcttaagtgtgtggcccatgaattgaacaatttaaccttgaagtctatatccgtgatattatgtcgatttttaactgaggggaaattaactagtccagcctaaaatgcttcttttaatctgcattctgtttcctcttctagttgtgccattactagtgatcatgtttttttcccccctttaatgaaaacaataaacatctatttgagacaattaaaatccttctgggggcactggaagcacaatacggtgaccaatcttgctttcatttttttttctttttaatttgaaccatgattttgctagaaatagaaggcccagtggtggaatattagagggaaggaaactgacaacgtgtgaaagttagaggcaaatacataggtgtagcttggagtgctggtatctaatataccattgtattcactaactaactcaaaataaacacatttaatcttga

SEQ ID NO: 455627 - DNA, 1775 bp, Homo sapiens
agcggatgggagtgggacggggactttggggagcttatcagcctgtgctcgtggcctccctggaatggagaaagacgtgctttccggaatggcagggtagctcataagcctttgcagggtctggctctgccatccgcagaaggcagagtcaacatacggtctgtacttcctttgtcaccgtcactcacgctttttctgtaacccacgcaggccatcatggcgcaactaccgcaggaggagaaggcaaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaagaggcaaaggcccattgaaaaatacatctgatgtcattaatgctgccaagaaaattgccgaagcaggttctcgaatggacaaattagctcgtgctgtggctgatcagtgtcctgattcagcatgtaagcaggatttattagcctaccttcaacgaattgccttgtattgccatcagcttaatatctgcagcaaggtgaaggcagaagtgcagaatctgggaggagagctcattgtgtcagggctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagtttcgcctgtacaggctttaagtgaattcaaagcaatggattccttctaggacgataggttttaacaagaaagctttttctttcttttctttctttctttttctttttaattccatttttgtatgcatacctgccagctcgtatgcctctggcatggggaaattaagggaacagtgtctgtttgcatgtaagatgagatgagatcaatactactgatccatctgtagcctgggaaggagacaggacattcctgtactaaggtggcacagagctgtcctttgcaacattctcataaaattgggcacagagttcgcattggcgcaatatttatgggagtgggagggatggggaaaataaacttaactctacaaaagcaaactctaatgcatgcaagaatcattaggttggcaggtatatgcataagtgaaaaatctggaagtgtaatggtagaacataaaacttgtattgcttctgtttcagtgcaaaaatgtactagccaatacgcttaagtgtgtggcccatgaattgaacaatttaaccttgaagtctatatccgtgatattatgtcgatttttaactgaggggaaattaactagtccagcctaaaatgcttcttttaatctgcattctgtttcctcttctagttgtgccattactagtgatcatgtttttttcccccctttaatgaaaacaataaacatctatttgagacaattaaaatccttctgggggcactggaagcacaatacggtgaccaatcttgctttcatttttttttctttttaatttgaaccatgattttgctagaaatagaaggcccagtggtggaatattagagggaaggaaactgacaacgtgtgaaagttagaggcaaatacataggtgtagcttggagtgctggtatctaatataccattgtattcactaactaactcaaaataaacacatttaatcttga

SEQ ID NO: 455628 - DNA, 326 bp, Homo sapiens
gttcggatggcagccacccagattgacagcctgtgtccccaggtaagcctcattcactttgtttcaaaagcctgtcagtgaccttctccactccagcccttgtgcccctccttttccttctctatttcctcttgctgaaaaaggctactcatcatttatgagctgtttcaagttctacctttctcagaaagaataaaccataccagtctcttcagaattaccatggcagcttggccaggcatggtggctcacacctataatcccagtgctctgggaggctgaagtgggaggattgattgaggccaggggttcaaggccagcctggg

SEQ ID NO: 455629 - DNA, 1829 bp, Homo sapiens
agcggatgggagtgggacggggactttggggagcttatcagcctgtgctcgtggcctccctggaatggagaaagacgtgctttccggaatggcagggtagctcataagcctttgcagggtctggctctgccatccgcagaaggcagagtcaacatacggtctgtacttcctttgtcaccgtcactcacgctttttctgtaacccacgcaggccatcatggcgcaactaccgcaggaggagaaggcaaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaagaggcaaaggcccattgaaaaatacatctgatgtcattaatgctgccaagaaaattgccgaagcaggttctcgaatggacaaattagctcgtgctgtggctgatcagtgtcctgattcagcatgtaagcaggatttattagcctaccttcaacgaattgccttgtattgccatcagcttaatatctgcagcaaggtgaaggcagaagtgcagaatctgggaggagagctcattgtgtcagggctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagaaaagcctgaagaattccagacacgagttcgacgaggttctcagaagaaacacatttcgcctgtacaggctttaagtgaattcaaagcaatggattccttctaggacgataggttttaacaagaaagctttttctttcttttctttctttctttttctttttaattccatttttgtatgcatacctgccagctcgtatgcctctggcatggggaaattaagggaacagtgtctgtttgcatgtaagatgagatgagatcaatactactgatccatctgtagcctgggaaggagacaggacattcctgtactaaggtggcacagagctgtcctttgcaacattctcataaaattgggcacagagttcgcattggcgcaatatttatgggagtgggagggatggggaaaataaacttaactctacaaaagcaaactctaatgcatgcaagaatcattaggttggcaggtatatgcataagtgaaaaatctggaagtgtaatggtagaacataaaacttgtattgcttctgtttcagtgcaaaaatgtactagccaatacgcttaagtgtgtggcccatgaattgaacaatttaaccttgaagtctatatccgtgatattatgtcgatttttaactgaggggaaattaactagtccagcctaaaatgcttcttttaatctgcattctgtttcctcttctagttgtgccattactagtgatcatgtttttttcccccctttaatgaaaacaataaacatctatttgagacaattaaaatccttctgggggcactggaagcacaatacggtgaccaatcttgctttcatttttttttctttttaatttgaaccatgattttgctagaaatagaaggcccagtggtggaatattagagggaaggaaactgacaacgtgtgaaagttagaggcaaatacataggtgtagcttggagtgctggtatctaatataccattgtattcactaactaactcaaaataaacacatttaatcttga

SEQ ID NO: 455630 - DNA, 3757 bp, Homo sapiens
agcggggacccaggcgggcgggcagagcaggcggcaccgcacctcggccagaggcggctgcagcagctgctgcccttgtccctgccgccgcctctccagtcccttctgtgattaccactccagctgctgggaacgggcgagaaagaggaggaggcgagaaactcccaccgacccacagagggagcatgacttcggcaacttcacctatcattctgaaatgggaccccaaaagtttggaaatccggacgctaacagtggaaaggctgttggagccacttgttacacaggtgactacacttgtcaacacaagcaacaaaggcccatctggtaaaaagaaagggaggtcaaagaaagcccatgtactagctgcctctgtagagcaagccactcagaatttcctggaaaagggtgaacagatcgctaaggagagtcaagatctcaaagaagagttggtggctgctgtagaggatgtgcgcaaacaaggtgagacgatgcggatcgcctcctccgagtttgcagatgacccttgctcgtcggtaaagcgcggcaccatggtacgggcggcaagggctttgctctccgcggtgacacgcttactcatcctggcggacatggcagatgtcatgagacttttatcccatctgaaaattgtggaagaggccctggaagctgtcaaaaatgctacaaatgagcaagaccttgcaaaccgttttaaagagtttgggaaaaagatggtgaaacttaactatgtagcagcaagaagacaacaggagctgaaggatcctcactgtcgggatgagatggcagccgcccgaggggctctgaagaagaatgccacaatgctgtacacggcctctcaagcatttctccgccacccagatgtcgccgctacgagagccaaccgagattatgtgttcaaacaagtccaggaggccatcgccggcatctccaatgctgctcaagctacctcgcccactgacgaagccaagggccacacgggcatcggcgagctggctgcggctcttaatgagtttgacaataagattatcctggaccccatgacgttcagcgaggccaggttccggccgtccctggaggagaggctggagagcatcatcagcggcgcagcgctgatggccgactcctcctgcacgcgagacgaccggcgcgagaggatcgtggcggagtgcaacgccgtgcggcaggcgctccaggacctgctcagcgagtacatgaataatactggaaggaaagaaaaaggagatcctctcaacattgcgattgataagatgactaagaaaacaagagatctaaggagacagcttcggaaagcagtgatggatcacatatctgactctttcctggaaaccaatgttcctttgctagttctcattgaggctgcaaagagcggaaatgaaaaggaagtgaaagaatatgcccaagttttccgtgagcatgccaacaaactggtagaggttgccaatttggcctgttccatctccaacaatgaagaaggggtgaaattagttcggatggcagccacccagattgacagcctgtgtccccaggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcagaaaatcacatcttggaggatgtgaacaagtgtgtgatagccctccaagagggcgatgtggacactctggaccggactgcaggggccatcaggggccgggcagctcgagtcatacacatcatcaatgctgagatggagaactatgaagctggggtttatactgagaaggtgttggaagctacaaaattgctttctgaaacagtgatgccacgcttcgctgaacaagtagaggttgccattgaagccctgagtgccaacgttcctcaaccgtttgaggagaatgagttcatcgatgcctctcgcctggtgtatgatggcgttcgggacatcagaaaggctgtgctgatgatcaggaccccagaagaactagaggatgattctgactttgagcaggaagattatgatgtgcgtagcaggacaagtgttcagactgaggatgaccagctcattgcagggcagagcgcacgggccatcatggcgcaactaccgcaggaggagaaggcaaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaagaggcaaaggcccattgaaaaatacatctgatgtcattaatgctgccaagaaaattgccgaagcaggttctcgaatggacaaattagctcgtgctgtggctgatcagtgtcctgattcagcatgtaagcaggatttattagcctaccttcaacgaattgccttgtattgccatcagcttaatatctgcagcaaggtgaaggcagaagtgcagaatctgggaggagagctcattgtgtcagggctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagtttcgcctgtacaggctttaagtgaattcaaagcaatggattccttctaggacgataggttttaacaagaaagctttttctttcttttctttctttctttttctttttaattccatttttgtatgcatacctgccagctcgtatgcctctggcatggggaaattaagggaacagtgtctgtttgcatgtaagatgagatgagatcaatactactgatccatctgtagcctgggaaggagacaggacattcctgtactaaggtggcacagagctgtcctttgcaacattctcataaaattgggcacagagttcgcattggcgcaatatttatgggagtgggagggatggggaaaataaacttaactctacaaaagcaaactctaatgcatgcaagaatcattaggttggcaggtatatgcataagtgaaaaatctggaagtgtaatggtagaacataaaacttgtattgcttctgtttcagtgcaaaaatgtactagccaatacgcttaagtgtgtggcccatgaattgaacaatttaaccttgaagtctatatccgtgatattatgtcgatttttaactgaggggaaattaactagtccagcctaaaatgcttcttttaatctgcattctgtttcctcttctagttgtgccattactagtgatcatgtttttttcccccctttaatgaaaacaataaacatctatttgagacaattaaaatccttctgggggcactggaagcacaatacggtgaccaatcttgctttcatttttttttctttttaatttgaaccatgattttgctagaaatagaaggcccagtggtggaatattagagggaaggaaactgacaacgtgtgaaagttagaggcaaatacataggtgtagcttggagtgctggtatctaatataccattgtattcactaactaactcaaaataaacacatttaatcttga

SEQ ID NO: 455631 - DNA, 2196 bp, Homo sapiens
agcggggacccaggcgggcgggcagagcaggcggcaccgcacctcggccagaggcggctgcagcagctgctgcccttgtccctgccgccgcctctccagtcccttctgtgattaccactccagctgctgggaacgggcgagaaagaggaggaggcgagaaactcccaccgacccacagagggagcatgacttcggcaacttcacctatcattctgaaatgggaccccaaaagtttggaaatccggacgctaacagtggaaaggctgttggagccacttgttacacaggtgactacacttgtcaacacaagcaacaaaggcccatctggtaaaaagaaagggaggtcaaagaaagcccatgtactagctgcctctgtagagcaagccactcagaatttcctggaaaagggtgaacagatcgctaaggagagtcaagatctcaaagaagagttggtggctgctgtagaggatgtgcgcaaacaaggtgagacgatgcggatcgcctcctccgagtttgcagatgacccttgctcgtcggtaaagcgcggcaccatggtacgggcggcaagggctttgctctccgcggtgacacgcttactcatcctggcggacatggcagatgtcatgagacttttatcccatctgaaaattgtggaagaggccctggaagctgtcaaaaatgctacaaatgagcaagaccttgcaaaccgttttaaagagtttgggaaaaagatggtgaaacttaactatgtagcagcaagaagacaacaggagctgaaggatcctcactgtcgggatgagatggcagccgcccgaggggctctgaagaagaatgccacaatgctgtacacggcctctcaagcatttctccgccacccagatgtcgccgctacgagagccaaccgagattatgtgttcaaacaagtccaggaggccatcgccggcatctccaatgctgctcaagctacctcgcccactgacgaagccaagggccacacgggcatcggcgagctggctgcggctcttaatgagtttgacaataagattatcctggaccccatgacgttcagcgaggccaggttccggccgtccctggaggagaggctggagagcatcatcagcggcgcagcgctgatggccgactcctcctgcacgcgagacgaccggcgcgagaggatcgtggcggagtgcaacgccgtgcggcaggcgctccaggacctgctcagcgagtacatgaataatactggaaggaaagaaaaaggagatcctctcaacattgcgattgataagatgactaagaaaacaagagatctaaggagacagcttcggaaagcagtgatggatcacatatctgactctttcctggaaaccaatgttcctttgctagttctcattgaggctgcaaagagcggaaatgaaaaggaagtgaaagaatatgcccaagttttccgtgagcatgccaacaaactggtagaggttgccaatttggcctgttccatctccaacaatgaagaaggggtgaaattagttcggatggcagccacccagattgacagcctgtgtccccaggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcagaaaatcacatcttggaggatgtgaacaagtgtgtgatagccctccaagagggcgatgtggacactctggaccggactgcaggggccatcaggggccgggcagctcgagtcatacacatcatcaatgctgagatggagaactatgaagctggggtttatactgagaaggtgttggaagctacaaaattgctttctgaaacagtgatgccacgcttcgctgaacaagtagaggttgccattgaagccctgagtgccaacgttcctcaaccgtttgaggagaatgagttcatcgatgcctctcgcctggtgtatgatggcgttcgggacatcagaaaggctgtgctgatgatcaggaccccagaagaactagaggataacatggacgtcttcaaagaccagtgggagaagcaggtccgagtgttgacagaggccgtggatgacatcacctcagtggatgacttcctctctgtct

SEQ ID NO: 455632 - DNA, 550 bp, Homo sapiens
cactgagattgaggaaggtttcttgtctccgagccttctcccagtagagctataaatccaggctggctcctccctccccacacagctgctcctgctctccctcctccaggtgaccccagccatgaggaccctcgccatccttgctgccattctcctggtggccctgcaggcccaggctgagccactccaggcaagagctgatgaggttgctgcagccccggagcagattgcagcggacatcccagaagtggttgtttcccttgcatgggacgaaagcttggctccaaagcatccaggtgagagaggcaggcatgcagagctgctaagtctagagggaaggacgggagagaggttccagagttgggtctcagcagtctatgtcactgaggtggcttcacttagaatctctgggcattgattttctcatctagaaattgaacagagagccaaataaacctgagaaactttatttctccaaagacttgattccaagaaacatctgtgaaattcactaagtttaagatatgaagagacagactagttatttctg

SEQ ID NO: 455633 - DNA, 469 bp, Homo sapiens
ttgttaattgttactcaagtctaagtagaggtggaaataataaactttcttttttttacttaaaccactctgtgtcactgagctgatttcacctttagcctgataaaatcattgtcctctccaccctgattcctacaggagactactcaccccataacctcaaaaacctcttcatgaggatggtaagtcacctgaatcctgaagtgaattactcgctattccattggaactcatataggacaccagaatctagacctccagagaacagcaggacccatcttcagaaaataagaagcatttgttccctgagcctgttgaatcaaagtgcaatttctattctttttggaatgttaaaaagtgaatcataatatttaagcaggtgaacccacgagtaacatagcagggtctttcttgtcattattagctccaacctagcacagacattagaggtacagatgtatactagcat

SEQ ID NO: 455634 - DNA, 236 bp, Homo sapiens
agctggtgggaaatgcatgcccaagaacccttctagacacccaggggcaccaggagaccagggaaaggacccagtgcacagtggggaggccttgctcgcaataattgctatagaagacctgggacagaggactgctgtctgccctctctggtcaccctgcctagctagaggatctgacccctagccacggtctacccactagccacggtcgacccactagccacggtcaacccacg

SEQ ID NO: 455635 - DNA, 230 bp, Homo sapiens
aaaactctcatgaggatggtagtcactcgatagaatctagactcagaacgaagaagcatttgttccctgagcctgttgaatcaaagtgcaatttctattctttttggaatgttaaaaagtgaatcataatatttaagcaggtgaacccacgagtaacatagcagggtctttcttgtcattattagctccaacctagcacagacattagaggtacagatgtatactagcat

SEQ ID NO: 455636 - DNA, 514 bp, Homo sapiens
aagtccacttgtgcacggctgctccttgctatagaagacctgggacagaggactgctgtctgccctctctggtcaccctgcctagctagaggatctgtgaccccagccatgaggaccctcgccatccttgctgccattctcctggtggccctgcaggcccaggctgagccactccaggcaagagctgatgaggttgctgcagccccggagcagattgcagcggacatcccagaagtggttgtttcccttgcatgggacgaaagcttggctccaaagcatccaggctcaaggaaaaacatggcctgctattgcagaataccagcgtgcattgcaggagaacgtcgctatggaacctgcatctaccagggaagactctgggcattctgctgctgagcttgcagaaaaagaaaaatgagctcaaaatttgctttgagagctacagggaattgctattactcctgtaccttctgctcaatttcctttcctcatcccaaataaatgccttgttacaaga

SEQ ID NO: 455637 - DNA, 592 bp, Homo sapiens
aaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaagcctagctagaggatctgtgaccccagccatgaggaccctcgccatccttgctgccattctcctggtggccctgcaggcccaggctgagccactccaggcaagagctgatgaggttgctgcagccccggagcagattgcagcggacatcccagaagtggttgtttcccttgcatgggacgaaagcttggctccaaagcatccaggctcaaggaaaaacatggcctgctattgcagaataccagcgtgcattgcaggagaacgtcgctatggaacctgcatctaccagggaagactctgggcattctgctgctgagcttgcagaaaaagaaaaatgagctcaaaatttgctttgagagctacagggaattgctattactcctgtaccttctgctcaatttcctttcctcatcccaaataaatgccttgttacaaga

SEQ ID NO: 455638 - DNA, 524 bp, Homo sapiens
  misc_feature (501)..(501): n is a, c, g, or t
tgctcggtaccagcggggaacaatcacttttgctatagaagacctgggacagaggactgctgtctgccctctctggtcaccctgcctagctagaggatctgtgaccccagccatgaggaccctcgccatccttgctgccattctcctggtggccctgcaggcccaggctgagccactccaggcaagagctgatgaggttgctgcagccccggagcagattgcagcggacatcccagaagtggttgtttcccttgcatgggacgaaagcttggctccaaagcatccaggctcaaggaaaaacatggcctgctattgcagaataccagcgtgcattgcaggagaacgtcgctatggaacctgcatctaccagggaagactctgggcattctgctgctgagcttgcagaaaaagaaaaatgagctcaaaatttgctttgagagctacagggaattgctattactcctgtaccttctgctcaatttcctttcctcagcctggtcncctaagctcggtagatcgaccca

SEQ ID NO: 455639 - DNA, 452 bp, Homo sapiens
ctacacggtgaatacctgtctctactaaaaatacaaaaaattagccgggcgttgtggcgtggcgcccgtaatcccagctactcctggggctgttatggaatcctaacagtccccgataaagggagaattattccaaacagccccggagcagattgcagcggacatcccagaagtggttgtttcccttgcatgggacgaaagcttggctccaaagcatccaggctcaaggaaaaacatggcctgctattgcagaataccagcgtgcattgcaggagaacgtcgctatggaacctgcatctaccagggaagactctgggcattctgctgctgagcttgcagaaaaagaaaaatgagctcaaaatttgctttgagagctacagggaattgctattactcctgtaccttctgctcaatttcctttcctcatcccaaataaatgccttgttacaaga

SEQ ID NO: 455640 - DNA, 576 bp, Homo sapiens
tcaagaagttaaccagttccgttccagcttcttgatcaggggtgtcagctgctcctttgacttttcaaagtaagacttggcctcggcctgaagctctgggctcttgaccttctccatcaggttgctatagaagacctgggacagaggactgctgtctgccctctctggtcaccctgcctagctagaggatctgtaagtactacaaaacttaaactttacactgagttttcatcattgaagctatgcctccaatctgacctctgactgtggggccgccccagagggacccagcgggtgaatccctgctaggaacgtctgtccggacctctggtgactgctggggacgatggcttccagctaacttaatagagaaactcaagcagtttccttctaaatacacatgtcacatgtcctggttgacatgtccagtagagactatcacaggtctttggaacattcttttgagagaaacctatttaggtccttggtctgtttttcaatcaggttgtttgatttttgctattgagttgttggaattccttatgtattcagatatttgccccttctgccatgtag

SEQ ID NO: 455641 - DNA, 523 bp, Homo sapiens
tcaagaagttaaccagttccgttccagcttcttgatcaggggtgtcagctgctcctttgacttttcaaagtaagacttggcctcggcctgaagctctgggctcttgaccttctccatcaggttgctatagaagacctgggacagaggactgctgtctgccctctctggtcaccctgcctagctagaggatctgagactactcaccccataacctcaaaaacctcttcatgaggatggtaagtcacctgaatcctgaagtgaattactcgctattccattggaactcatataggacaccagaatctagacctccagagaacagcaggacccatcttcagaaaataagaagcatttgttccctgagcctgttgaatcaaagtgcaatttctattctttttggaatgttaaaaagtgaatcataatatttaagcaggtgaacccacgagtaacatagcagggtctttcttgtcattattagctccaacctagcacagacattagaggtacagatgtatactagcat

SEQ ID NO: 455642 - DNA, 610 bp, Homo sapiens
tcaagaagttaaccagttccgttccagcttcttgatcaggggtgtcagctgctcctttgacttttcaaagtaagacttggcctcggcctgaagctctgggctcttgaccttctccatcaggttgctatagaagacctgggacagaggactgctgtctgccctctctggtcaccctgcctagctagaggatctgtgaccccagccatgaggaccctcgccatccttgctgccattctcctggtggccctgcaggcccaggctgagccactccaggcaagagctgatgaggttgctgcagccccggagcagattgcagcggacatcccagaagtggttgtttcccttgcatgggacgaaagcttggctccaaagcatccaggctcaaggaaaaacatggcctgctattgcagaataccagcgtgcattgcaggagaacgtcgctatggaacctgcatctaccagggaagactctgggcattctgctgctgagcttgcagaaaaagaaaaatgagctcaaaatttgctttgagagctacagggaattgctattactcctgtaccttctgctcaatttcctttcctcatcccaaataaatgccttgttacaaga

SEQ ID NO: 455643 - DNA, 518 bp, Homo sapiens
tgctcggtaccagcggggaacaatcacttttgctatagaagacctgggacagaggactgctgtctgccctctctggtcaccctgcctagctagaggatctgtgaccccagccatgaggaccctcgccatccttgctgccattctcctggtggccctgcaggcccaggctgagccactccaggcaagagctgatgaggttgctgcagccccggagcagattgcagcggacatcccagaagtggttgtttcccttgcatgggacgaaagcttggctccaaagcatccaggctcaaggaaaaacatggcctgctattgcagaataccagcgtgcattgcaggagaacgtcgctatggaacctgcatctaccagggaagactctgggcattctgctgctgagcttgcagaaaaagaaaaatgagctcaaaatttgctttgagagctacagggaattgctattactcctgtaccttctgctcaatttcctttcctcatcccaaataaatgccttgttacaaga

SEQ ID NO: 455644 - DNA, 735 bp, Homo sapiens
tgctcggtaccagcggggaacaatcacttttgctatagaagacctgggacagaggactgctgtctgccctctctggtcaccctgcctagctagaggatctgtgaccccagccatgaggaccctcgccatccttgctgccattctcctggtggccctgcaggcccaggctgagccactccaggcaagagctgatgaggttgctgcagccccggagcagattgcagcggacatcccagaagtggttgtttcccttgcatgggacgaaagcttggctccaaagcatccaggctcaaggaaaaacatggcctgctattgcagaataccagcgtgcattgcaggagaacgtcgctatggaacctgcatctaccagggaagactctgggcattctgctgctgagcttgcagaaaaagaaaaatgagctcaaaatttgctttgagagctacagggaattgctattactcctgtaccttctgctcaatttcctttcctcatcccaaataaatgccttgttacaagaaaaaaaaaaaaaaaaagaaaaaaaaaaaaaaaaagccaaaaagccgaaaaaaaaaacacaaacacaaaactagagaaaaagaaaagggaggggggcgagcgggcacacaaaaataccgaccggaggggccgccacaaatagcagagcagcacacccacggtaatagagtgtaaacaggtgcgggcgacccacacacggaggcggcccagcaaagaaa

SEQ ID NO: 455645 - DNA, 827 bp, Homo sapiens
  misc_feature (381)..(381): n is a, c, g, or t
tcaagaagttaaccagttccgttccagcttcttgatcaggggtgtcagctgctcctttgacttttcaaagtaagacttggcctcggcctgaagctctgggctcttgaccttctccatcaggttgctatagaagacctgggacagaggactgctgtctgccctctctggtcaccctgcctagctagaggatctgtgaccccagccatgaggaccctcgccatccttgctgccattctcctggtggccctgcaggcccaggctgagccactccaggcaagagctgatgaggttgctgcagccccggagcagattgcagcggacatcccagaagtggttgtttcccttgcatgggacgaaagcttggctccaaagcatccagcncaaggcaacacggtttttgcagttgcggcattgtagcgctgccgtgcagtagcaagtttgtatggctgctgcttgtctctagagagtctcctgtctgtagcctgctgagcttgcagaaaaagaaaaatgagctcaaaatttgctttgagagctacagggaattgctattactcctgtaccttctgctcaatttcctttcctcatcccaaataaatgccttgttacaagaaaaaaaaaaaaaaaaagaaaaaaaaaaaaaaaaagccaaaaagccgaaaaaaaaaacacaaacacaaaactagagaaaaagaaaagggaggggggcgagcgggcacacaaaaataccgaccggaggggccgccacaaatagcagagcagcacacccacggtaatagagtgtaaacaggtgcgggcgacccacacacggaggcggcccagcaaagaaa

SEQ ID NO: 455646 - DNA, 580 bp, Homo sapiens
cgggggcggggcctgagtcagtctcgccagctgccggtctttcgggggctccgtaactttctatccgtccgcgtcagcgccttgccaccctcatctccaatatgcctggtccgacccccagtggcactaacgtgggatcctcagggcgctctcccagcaaagcagtggccgcccgggcggcgggatccactgtccggcagaggaaaaatgccagctgtgggacaaggagtgcaggccgcacaacctcggcaggcaccggggggatgtggcgattctacacagaagattcacctgggctcaaagttggccctgttccagtattggttatgagtcttctgttcatcgcttctgtatttatgttgcacatttggggcaagtacactcgttcgtagattcagttacatccatctgtcatctgaagaaggaggaaaaaacccaacatttcttggaccaaaagtatagtgactatctgttcatgagagaaattttctgtaagcttgctgttttacaggggatttatcaataattgattttgaggaatcagtttttttctatggctaataaactttttaattcactt

SEQ ID NO: 455647 - DNA, 862 bp, Homo sapiens
cgggggcggggcctgagtcagtctcgccagctgccggtctttcgggggctccgtaactttctatccgtccgcgtcagcgccttgccaccctcatctccaatatgcctggtccgacccccagtggcactaacgtgggatcctcagggcgctctcccagcaaagcagtggccgcccgggcggcgggatccactgtccggcagaggaaaaatgccagctgtgggacaaggagtgcaggccgcacaacctcggcaggcaccggggggatgtggcgattctacacagaagattcacctgggctcaaagttggccctgttccagtattggttatgagtcttctgttcatcgcttctgtatttatgttgcacatttggggcaagtacactcgttcgtagattcagttacatccatctgtcatctgaagaaggaggaaaaaacccaacatttcttggaccaaaagtatagtgactatctgttcatgagagaaattttctgtaagcttgctgttttacaggggatttatcaataattgattttgaggaatcagtttttttctatggctaataaactttttaattcacttcaaaaaaaaaaaaaaaaaaaaaaaaaaatttttggggggccggggacctagaaaggtttttaaacacatgtgtgggggcgggggccagtggtaatgtgaccttgccgtacgtgtccaaggaaacctggcatgaaatgggtggtttccaaaaaaaaagcgggggacgggggtctaaaacagcgggttgggctttggcttcaggctcgagtgctcccccttcggcgcggtgtgggtgaaagagagagagatagaaagtaggggaaacaatagtaaaagtgagta

SEQ ID NO: 455648 - DNA, 491 bp, Homo sapiens
aagaaagttttttttttttgattccttaactgtgtaataatggtagcatatgttataatgctattctaataatttccagaaaaggccatttgtaacattttcctctctttcaggaaaaatgccagctgtgggacaaggagtgcaggccgcacaacctcggcaggcaccggggggatgtggcgattctacacagaagattcacctgggctcaaagttggccctgttccagtattggttatgagtcttctgttcatcgcttctgtatttatgttgcacatttggggcaagtacactcgttcgtagattcagttacatccatctgtcatctgaagaaggaggaaaaaacccaacatttcttggaccaaaagtatagtgactatctgttcatgagagaaattttctgtaagcttgctgttttacaggggatttatcaataattgattttgaggaatcagtttttttctatggctaataaactttttaattcactt

SEQ ID NO: 455649 - DNA, 659 bp, Homo sapiens
cgggggcggggcctgagtcagtctcgccagctgccggtctttcgggggctccgtaactttctatccgtccgcgtcagcgccttgccaccctcatctccaatatgcctggtccgacccccagtggcactaacgtgggatcctcagggcgctctcccagcaaagcagtggccgcccgggcggcgggatccactgtccggcagagggaggaaaaaatcttgaacacatgcatggaaacttctgaaggatgtgaagagggatgtgacattttctggctgcaacaggaaaaatgccagctgtgggacaaggagtgcaggccgcacaacctcggcaggcaccggggggatgtggcgattctacacagaagattcacctgggctcaaagttggccctgttccagtattggttatgagtcttctgttcatcgcttctgtatttatgttgcacatttggggcaagtacactcgttcgtagattcagttacatccatctgtcatctgaagaaggaggaaaaaacccaacatttcttggaccaaaagtatagtgactatctgttcatgagagaaattttctgtaagcttgctgttttacaggggatttatcaataattgattttgaggaatcagtttttttctatggctaataaactttttaattcactt

SEQ ID NO: 455650 - DNA, 752 bp, Homo sapiens
  misc_feature (661)..(661): n is a, c, g, or t
  misc_feature (666)..(666): n is a, c, g, or t
cgggggcggggcctgagtcagtctcgccagctgccggtctttcgggggctccgtaactttctatccgtccgcgtcagcgccttgccaccctcatctccaatatgcctggtccgacccccagtggcactaacgtgggatcctcagggcgctctcccagcaaagcagtggccgcccgggcggcgggatccactgtccggcagagggaggaaaaaatcttgaacacatgcatggaaacttctgaaggatgtgaagagggatgtgacattttctggctgcaacaggaaaaatgccagctgtgggacaaggagtgcaggccgcacaacctcggcaggcaccggggggatgtggcgattctacacagaagattcacctgggctcaaagttggccctgttccagtattggttatgagtcttctgttcatcgcttctgtatttatgttgcacatttggggcaagtacactcgttcgtagattcagttacatccatctgtcatctgaagaaggaggaaaaaacccaacatttcttggaccaaaagtatagtgactatctgttcatgagagaaattttctgtaagcttgctgttttacaggggatttatcaataattgattttgaggaatcagtttttttctatggctaataaactttttaattcacttanaaaanaaaaaattcgggttttatatttttaaggtggggggggagcgggcatggacggggtggggcactatttaagaaggggggcgggggat

SEQ ID NO: 455651 - DNA, 690 bp, Homo sapiens
aagaaagttttttttttttgattccttaactgtgtaataatggtagcatatgttataatgctattctaataatttccagaaaaggccatttgtaacattttcctctctttcaggaaaaatgccagctgtgggacaaggagtgcaggccgcacaacctcggcaggcaccggggggatgtggcgattctacacagaagattcacctgggctcaaagttggccctgttccagtattggttatgagtcttctgttcatcgcttctgtatttatgttgcacatttggggcaagtacactcgttcgtagattcagttacatccatctgtcatctgaagaaggaggaaaaaacccaacatttcttggaccaaaagtatagtgactatctgttcatgagagaaattttctgtaagcttgctgttttacaggggatttatcaataattgattttgaggaatcagtttttttctatggctaataaactttttaattcacttatactgagtctgatcgttgatgcctcactgctagggcccttagtctttctgcctttagatttgtaagtaaatatgtagcaaatatgtctggtgaatattgagttttttgttggattgacagttcctcacatgaccatgtggttattcaagtccaagattctgtaattgcccttggcttgttttcttctaggtatttctg

SEQ ID NO: 455652 - DNA, 831 bp, Homo sapiens
cgggggcggggcctgagtcagtctcgccagctgccggtctttcgggggctccgtaactttctatccgtccgcgtcagcgccttgccaccctcatctccaatatgcctggtccgacccccagtggcactaacgtgggatcctcagggcgctctcccagcaaagcagtggccgcccgggcggcgggatccactgtccggcagaggaaaaatgccagctgtgggacaaggagtgcaggccgcacaacctcggcaggcaccggggggatgtggcgattctacacagaagattcacctgggctcaaagttggccctgttccagtattgcgttacttggacgcttctttccgtgctttccaagtcgggctttttccctttgggttaacttttttgtaacgttggttgtgccaccattattgcgggggcaaaagggtacactcgttcgtagattcagttacatccatctgtcatctgaagaaggaggaaaaaacccaacatttcttggaccaaaagtatagtgactatctgttcatgagagaaattttctgtaagcttgctgttttacaggggatttatcaataattgattttgaggaatcagtttttttctatggctaataaactttttaattcacttatactgagtctgatcgttgatgcctcactgctagggcccttagtctttctgcctttagatttgtaagtaaatatgtagcaaatatgtctggtgaatattgagttttttgttggattgacagttcctcacatgaccatgtggttattcaagtccaagattctgtaattgcccttggcttgttttcttctaggtatttctg

SEQ ID NO: 455653 - DNA, 779 bp, Homo sapiens
cgggggcggggcctgagtcagtctcgccagctgccggtctttcgggggctccgtaactttctatccgtccgcgtcagcgccttgccaccctcatctccaatatgcctggtccgacccccagtggcactaacgtgggatcctcagggcgctctcccagcaaagcagtggccgcccgggcggcgggatccactgtccggcagaggaaaaatgccagctgtgggacaaggagtgcaggccgcacaacctcggcaggcaccggggggatgtggcgattctacacagaagattcacctgggctcaaagttggccctgttccagtattggttatgagtcttctgttcatcgcttctgtatttatgttgcacatttggggcaagtacactcgttcgtagattcagttacatccatctgtcatctgaagaaggaggaaaaaacccaacatttcttggaccaaaagtatagtgactatctgttcatgagagaaattttctgtaagcttgctgttttacaggggatttatcaataattgattttgaggaatcagtttttttctatggctaataaactttttaattcacttatactgagtctgatcgttgatgcctcactgctagggcccttagtctttctgcctttagatttgtaagtaaatatgtagcaaatatgtctggtgaatattgagttttttgttggattgacagttcctcacatgaccatgtggttattcaagtccaagattctgtaattgcccttggcttgttttcttctaggtatttctg

SEQ ID NO: 455654 - DNA, 688 bp, Homo sapiens
cgggggcggggcctgagtcagtctcgccagctgccggtctttcgggggctccgtaactttctatccgtccgcgtcagcgccttgccaccctcatctccaatatgcctggtccgacccccagtggcactaacgtgggatcctcagggcgctctcccagcaaagcagtggccgcccgggcggcgggatccactgtccggcagaggaaaaatgccagctgtgggacaaggagtgcaggccgcacaacctcggcaggcaccggggggatgtggcgattctacacagaagattcacctgggctcaaagttggccctgttccagtattggttatgagtcttctgttcatcgcttctgtatttatgttgcacatttggggcaagtacactcgttcgtagattcagttacatccatctgtcatctgaagaaggaggaaaaaacccaacatttcttggaccaaaagtatagtgactatctgttcatgagagaaattttctgtaagcttgctgttttacaggggatttatcaataattgattttgaggaatcagtttttttctatggctaataaactttttaattcacttaaaaaaaaacactcatcactctcctttctctaaccagaaattaactcagttccgtacctacaggtagccacatcctttttacggcccagccctcatcatccctgagtg

SEQ ID NO: 455655 - DNA, 584 bp, Homo sapiens
atcttgtctgaccccggttatatttttccttcggtagggattggactttctgaaggacgttgtgatccaaaggaaggaggccggaggtctctacttcccatacagcagcctggtccgacccccagtggcactaacgtgggatcctcagggcgctctcccagcaaagcagtggccgcccgggcggcgggatccactgtccggcagaggaaaaatgccagctgtgggacaaggagtgcaggccgcacaacctcggcaggcaccggggggatgtggcgattctacacagaagattcacctgggctcaaagttggccctgttccagtattggttatgagtcttctgttcatcgcttctgtatttatgttgcacatttggggcaagtacactcgttcgtagattcagttacatccatctgtcatctgaagaaggaggaaaaaacccaacatttcttggaccaaaagtatagtgactatctgttcatgagagaaattttctgtaagcttgctgttttacaggggatttatcaataattgattttgaggaatcagtttttttctatggctaataaactttttaattcactt

SEQ ID NO: 455656 - DNA, 898 bp, Homo sapiens
cgggggcggggcctgagtcagtctcgccagctgccggtctttcgggggctccgtaactttctatccgtccgcgtcagcgccttgccaccctcatctccaatatgcctggtccgacccccagtggcactaacgtgggatcctcagggcgctctcccagcaaagcagtggccgcccgggcggcgggatccactgtccggcagaggtaaggaaccctgcagttcgttcgcttccagactcggagataggacccagaacctcgctgattctggggtggagaccctagcatgtgaagattgacaaaggcaaaatgagcttctagtgacgtggccgtgggagtagttaaaggccttttgggaggaaggcgacattttttttctcgttgctcagtttagggcactactcttaaaaaaggaaagttaacaaactggaatagagtcagagataactttgagaaaaccgatgtcattaaactggtgtctctggacctgaggtttgcactcacatttccatctggcggccccataagcaatctgtcctacagataactcgtcctacacaaaacttagtctcttttcagctcagctctctcactctcaattatatctccttacttccatatggcactgttgtacactcatttactcagagccagaaacgtcagcgtcatcttggatttttcttatgctctttctctctctagtcatatgccagactttaaactctgcttgaaagctttctcataagctctttccttttccctttctactgctttgcatttgctacttaacccttttcttcaggctgtttgctttccagtccatcgttcgctctgctgttactcttctgcgtagtttctgttacttgttgctgaactaaaaaaaacaaacaaacaaaaaaa

SEQ ID NO: 455657 - DNA, 597 bp, Homo sapiens
atcttgtctgaccccggttatatttttccttcggtagggattggactttctgaaggacgttgtgatccaaaggaaggaggccggaggtctctacttcccatacagcagcctggtccgacccccagtggcactaacgtgggatcctcagggcgctctcccagcaaagcagtggccgcccgggcggcgggatccactgtccggcagagggaggaaaaaatcttgaacacatgcatggaaacttctgaaggatgtgaagagggatgtgacattttctggctgcaacaggtaaatctaaaactgatgatttgaacttacatgaaatatttcacatcagaacaaagacattctaatagaactggcagaaatgtaaaattatcctgaatgattttgagttccctgtcattgggatgttcatgaggagtgtatcaggctgtggtttaacttatatgggctttgagtgctgtccccttcccaccctgggttttagagatttttcgtgcaggaatggaaaacatgtcctgtgggtgcggttccttgggaatggttctgcttaatgagaattggtaatactgtggcagggaagtttggccatccgag

SEQ ID NO: 455658 - DNA, 6112 bp, Homo sapiens
gtcagatcagggatcattttttttccttcctctactccctcccccctacccgcccctccctccctgtttcccttccctccctccctcccctctctgctgggtctgtgcgctggggcgcccgatcccctccgcagctgggacgctccgaactcgaggcaggagtcggctctccggagcctcgtccctcccttccccttccctgcccccttcccccacccccgactcgggcttggcgcggcggccagaggaaccccgagtcccggcccaggcccctgagctggagggatggaaaactcctctgcagcatcagcctcctcggaggcagggagcagccgctcccaggagatcgaggagctggagcgcttcatcgacagctacgtgctggagtaccaggtgcaggggctgctggctgacaagacggagggtgatggcgagagcgagaggacccagtcccacatctcccagtggacagcggactgcagcgaaccgctggacagcagctgttccttctcccgagggcgagcccccccacagcagaatggcagcaaagacaactctctggacatgctgggcacggacatctgggcggccaacaccttcgattccttcagtggtgccacctgggacctgcagccggaaaagctggacttcacccagttccaccgcaaagtccgacacacgcccaagcagcccctgccacacatcgaccgcgaagggtgtggcaaagggaagctggaagatggggatggcatcaacctgaatgacatcgagaaggtccttccagcctggcagggctaccacccgatgccccatgaagtggagatcgcacacaccaagaagctgttccgcaggaggagaaatgatcgaaggcggcagcagagacctccggggggcaacaagccccaacagcatggtgaccaccagccaggcagtgccaaacacaacagggaccaccagaaatcctaccaggggggctcagcaccccacccctcagggaggcccactcaccatggctacagccagaaccggcgctggcaccatggcaacatgaagcacccaccaggcgacaagggggaggcaggcgcacaccgcaatgccaaagagaccatgaccatcgagaacccaaaactggaggacactgcaggggacaccgggcacagcagcctcgaggccccccgcagccctgacaccctggccccggtggcttctgagcggctgcccccacagcagtcaggggggccagaggttgagacaaaacgtaaagacagtattcttcccgagcgcatcggggagcggcccaaaattaccctgctccagtcttccaaagacagactgcggcgaaggctaaaggaaaaggatgaagtggccgtggagacgaccactccccagcagaacaagatggacaagctgatcgagatcctgaacagcatgcggaacaacagcagcgacgtggacaccaagctcaccaccttcatggaggaggcccagaactccaccaactccgaggagatgctgggcgagatcgtgcgcacaatctaccagaaggctgtgtccgaccgcagcttcgccttcaccgctgccaagctctgcgacaagatggcgctctttatggtggaggggaccaagttccggagcctgctcctcaacatgctgcagaaggacttcacggtgcgcgaggagctgcagcagcaggacgtggagcgctggctgggcttcatcaccttcctgtgcgaggtcttcggcaccatgcgcagcagcacaggcgagcccttccgtgtgctcgtgtgccccatctacacctgcctcagggagctcttgcaatctcaggatgtgaaggaagatgctgtcctttgctgctctatggagctgcagagtacaggccggctgctggaggaacagctgcctgagatgatgacagagctcctggccagcgcacgggacaagatgctgtgcccctcggagtccatgctgacccggtcgctgctcctagaggtcatcgagctccacgctaacagctggaaccctctgacgccccccatcacgcagtactacaacagaaccatccagaaactgacagcctgacagccagggggcctggcaggcggcccacgggcagctggggccctggtgcacagggccagatggacaggcgggaggacaggggtggccctggcgggagaaagaaatggggaggagggcaggcagagtcggtggccagtctggagccagacggggaagggagcaaatccctgagaggagtgcccccgcacaagccccccagcccgagcatgcaagctcacaccaataagggaagcatgtttctttttcctggtggccctggccctccccttcctcactcccgcctctcccctccccatcagacccatcccccacggagctttgtgtgagggatctcatcgctgtgactcctcggagaccttggcagcctcgcacgccggggcaccgcttgggtcagaaaggacctcggaaggctgaaaaagtgggtcggagacgggctcgcattgttcccgcatgctgtcagccgcagtcgccaactggcagcaggcgacgtgtagcagatgtccgggaggacaaaggcaggcacggtccccaccagccgcccgtaattgacggcctttgtcagccatggcagagctgacgctccacctcccacctccaagtcctcctcactgcagcccccacagcctcaggcctagggggtcaggcgcagcgggggagatggagtttgcagttccacttgcactcttttgtttattgtgttttatttttcaaaagtcggttgctttgaagtctctttggccaatgaaaatgcccgtgatgtgatcacacagtcagcactgttgaggacccccggattagtgggagatcaaacccagctcccctctagaagaaggattcgagccacagacagcttgccagtagccaattagggtaattggaaacttctgccccggcggggggtccccgctggaatcctgtgttcctcgccactggcttccagcgcctctgttttctcaaagggctgatactgtcaccactgggaccaagttaaacctggtcctggccccaggggccttgtggcaaacagggcacagaacgagactggcaaattaaaaccaaaattctagatggtgtcttgcgctccacacgcaggtcttactggggaaaaggatgggagtgggggctccccaggactcgattttagctaatgcgctgtgtcactgccccagctcggacgtagaagcccagccctccgtgagctcttgggaaaggggtgaattcactgggtcatggaagggacagtcaggtgaccagcggggtcgccagatgaagcttcccagccgggaaacaagacggggtttcttggcaggccctggtcctggggagcaggccctgttgttggctggagaggaaggtgtggggtggaacaggtgtccacatagctccatctctgggggctggagcacacactttgatgagcccccccggaaatgatgtcagagcctagccgcttccttatttgctcttttattgaggccgggcaggccctgggtcactttggaggcccctcttggtccacactggactggccgggaggtgatgggcggggaaggttctcgtgattgattgattctgagtctgagagtggcgagtggggagaggcttccccagttctctccagctttccctgcagctgcaacctgccctctggtcccaggtgtggagcctttgcctgtctctaaaaagagcctgttggcgacaaggtgtagggggcacaagtttacctgaaacaggtcagtggtctctcccaagaagcgcacgccacctctggtccctggccctgaaccctgccttcttcctccctccacggtttcttcccagactttctcaagctcctcctcactgcccttcctccccagcccagcctgggaacacagatgccccgcgggtaggaggcctcgagggaggagccgggctgatgcggggctgctcagggcaggccccagggcgagcttgccatcgtggccaggcagcctccacctgtgcttcagtggcccctgcccccctgaagcatgtggggtttgtccgctaggaggaggcaaggcccccgaagagaggagagacctgggagtgggagctcaggtcagggaggaggcaggggagtggggtctcccagacccaacggtgagctcagagcaagcttcacgcaggacgctccgaaacactgtgtggagggggctgtgttgtgggcaccttggggcctgattctccttcctccgaacgggctccttgatggcctggccacaggggcagctccccattggctgttaggaccagagtgtgaagaagaagtgaaatataaatatgtatacatatataaatatatttttaattacatgtcgtgtcacggtggctccagacatactgtttgcctagtttattccactgcttgaaagcgcttcctagccaatctgaacaacaacactttaagctgtttttctaaatgcaggttgctgctcctttttcagatatggaaggaaaacgttaagactattttttttttaaagaaacaacagtcaagcctaaaatttgagaccccgaggcagcttcccgagggagactgctcagacaggaactgcaggacagaagtggatgccccacagaccctggccccctccccaagtccatcccctctctgtggcatgaggaaggccgcgtccgagttgacctctgaatgtatgtgatgagaggcagagctggatattgcatttctaaggcttgcattgctttcccctcgcccgcggttcttggcgcatggaagaggcggtccagccatctgatgttgatcctgtctcagtctccccactgcctgtcaggatgagttagtcattgtttttctccgaggcggcctgcttgccacagccctgctccccaaggcctggtggctttgccgaagctctgggaccgcagccccagcgaggcccccaacctcacccagacgaggccaggagccccgccaccctccacgggatgtgcaccctcagaccccattctctctgttcgtccttccttgaccagtctgtaaaccttcactgtttggggatcgtcctgtccatccatgtaaatgtaaatgttggccgagtcggtatttattctgattgatttttattttattctattattttctccgagggatgagggtggggggtgtgggaagggtaccacagatcaggccggggcagctgtaggggcgggggcccagacagccaggccgccaccagagcagccccatggggtgccccagacgcgggcctccaagaagccaagtcccagtctgttttctggcatcagacaccggcccgtgttccttgtcagacagacagactctcaggcctgcctggggagtcgtgtccctcagctgcagggcactgtgttgggaaaccattggctgggcctttgaggacacagatcagaagaaagaaagacaactttcctctgcgcggaacactcacacggaagggctggccgcctccctgagccggctgggagtggacgacaggacctacctccccagagcaagggcctggggcttcccgccaaagctgccgcggaaccccgctagtgcgaccaccctccctccgtcggtatgtcctgctttccagctgaacccaaactacaagtgggtttaaaaaaataaacaaacaccaatcagctaaaatacaaatattcactatctactctaccgcccgcagatcttctcaccactctctcttctccttctctcctctctcactccgttgccactccacaccacacatcatcacaccacaccgttataccaccccaccttgccccaccatcacccgccctctctccccaccaccatcttcaagtcaacactcactcctccgcgcccctcaccccgcctcgtcatcaaacatacccagccaacaccctcgctccaccctccctctctcacccacatcaccacgaaacactcagtctccctctcaccctcttccccccctcctcctaacactatccaacacccttcttcctcccctcctcctcctcctcctacctctatctc

SEQ ID NO: 455659 - DNA, 6174 bp, Homo sapiens
gtcagatcagggatcattttttttccttcctctactccctcccccctacccgcccctccctccctgtttcccttccctccctccctcccctctctgctgggtctgtgcgctggggcgcccgatcccctccgcagctgggacgctccgaactcgaggcaggagtcggctctccggagcctcgtccctcccttccccttccctgcccccttcccccacccccgactcgggcttggcgcggcggccagaggaaccccgagcccgcatttgctgcatcgagcagttggtttagtatcagccaaacttgcagctgttttctctgtcctctttcccaccagtcccggcccaggcccctgagctggagggatggaaaactcctctgcagcatcagcctcctcggaggcagggagcagccgctcccaggagatcgaggagctggagcgcttcatcgacagctacgtgctggagtaccaggtgcaggggctgctggctgacaagacggagggtgatggcgagagcgagaggacccagtcccacatctcccagtggacagcggactgcagcgaaccgctggacagcagctgttccttctcccgagggcgagcccccccacagcagaatggcagcaaagacaactctctggacatgctgggcacggacatctgggcggccaacaccttcgattccttcagtggtgccacctgggacctgcagccggaaaagctggacttcacccagttccaccgcaaagtccgacacacgcccaagcagcccctgccacacatcgaccgcgaagggtgtggcaaagggaagctggaagatggggatggcatcaacctgaatgacatcgagaaggtccttccagcctggcagggctaccacccgatgccccatgaagtggagatcgcacacaccaagaagctgttccgcaggaggagaaatgatcgaaggcggcagcagagacctccggggggcaacaagccccaacagcatggtgaccaccagccaggcagtgccaaacacaacagggaccaccagaaatcctaccaggggggctcagcaccccacccctcagggaggcccactcaccatggctacagccagaaccggcgctggcaccatggcaacatgaagcacccaccaggcgacaagggggaggcaggcgcacaccgcaatgccaaagagaccatgaccatcgagaacccaaaactggaggacactgcaggggacaccgggcacagcagcctcgaggccccccgcagccctgacaccctggccccggtggcttctgagcggctgcccccacagcagtcaggggggccagaggttgagacaaaacgtaaagacagtattcttcccgagcgcatcggggagcggcccaaaattaccctgctccagtcttccaaagacagactgcggcgaaggctaaaggaaaaggatgaagtggccgtggagacgaccactccccagcagaacaagatggacaagctgatcgagatcctgaacagcatgcggaacaacagcagcgacgtggacaccaagctcaccaccttcatggaggaggcccagaactccaccaactccgaggagatgctgggcgagatcgtgcgcacaatctaccagaaggctgtgtccgaccgcagcttcgccttcaccgctgccaagctctgcgacaagatggcgctctttatggtggaggggaccaagttccggagcctgctcctcaacatgctgcagaaggacttcacggtgcgcgaggagctgcagcagcaggacgtggagcgctggctgggcttcatcaccttcctgtgcgaggtcttcggcaccatgcgcagcagcacaggcgagcccttccgtgtgctcgtgtgccccatctacacctgcctcagggagctcttgcaatctcaggatgtgaaggaagatgctgtcctttgctgctctatggagctgcagagtacaggccggctgctggaggaacagctgcctgagatgatgacagagctcctggccagcgcacgggacaagatgctgtgcccctcggagtccatgctgacccggtcgctgctcctagaggtcatcgagctccacgctaacagctggaaccctctgacgccccccatcacgcagtactacaacagaaccatccagaaactgacagcctgacagccagggggcctggcaggcggcccacgggcagctggggccctggtgcacagggccagatggacaggcgggaggacaggggtggccctggcgggagaaagaaatggggaggagggcaggcagagtcggtggccagtctggagccagacggggaagggagcaaatccctgagaggagtgcccccgcacaagccccccagcccgagcatgcaagctcacaccaataagggaagcatgtttctttttcctggtggccctggccctccccttcctcactcccgcctctcccctccccatcagacccatcccccacggagctttgtgtgagggatctcatcgctgtgactcctcggagaccttggcagcctcgcacgccggggcaccgcttgggtcagaaaggacctcggaaggctgaaaaagtgggtcggagacgggctcgcattgttcccgcatgctgtcagccgcagtcgccaactggcagcaggcgacgtgtagcagatgtccgggaggacaaaggcaggcacggtccccaccagccgcccgtaattgacggcctttgtcagccatggcagagctgacgctccacctcccacctccaagtcctcctcactgcagcccccacagcctcaggcctagggggtcaggcgcagcgggggagatggagtttgcagttccacttgcactcttttgtttattgtgttttatttttcaaaagtcggttgctttgaagtctctttggccaatgaaaatgcccgtgatgtgatcacacagtcagcactgttgaggacccccggattagtgggagatcaaacccagctcccctctagaagaaggattcgagccacagacagcttgccagtagccaattagggtaattggaaacttctgccccggcggggggtccccgctggaatcctgtgttcctcgccactggcttccagcgcctctgttttctcaaagggctgatactgtcaccactgggaccaagttaaacctggtcctggccccaggggccttgtggcaaacagggcacagaacgagactggcaaattaaaaccaaaattctagatggtgtcttgcgctccacacgcaggtcttactggggaaaaggatgggagtgggggctccccaggactcgattttagctaatgcgctgtgtcactgccccagctcggacgtagaagcccagccctccgtgagctcttgggaaaggggtgaattcactgggtcatggaagggacagtcaggtgaccagcggggtcgccagatgaagcttcccagccgggaaacaagacggggtttcttggcaggccctggtcctggggagcaggccctgttgttggctggagaggaaggtgtggggtggaacaggtgtccacatagctccatctctgggggctggagcacacactttgatgagcccccccggaaatgatgtcagagcctagccgcttccttatttgctcttttattgaggccgggcaggccctgggtcactttggaggcccctcttggtccacactggactggccgggaggtgatgggcggggaaggttctcgtgattgattgattctgagtctgagagtggcgagtggggagaggcttccccagttctctccagctttccctgcagctgcaacctgccctctggtcccaggtgtggagcctttgcctgtctctaaaaagagcctgttggcgacaaggtgtagggggcacaagtttacctgaaacaggtcagtggtctctcccaagaagcgcacgccacctctggtccctggccctgaaccctgccttcttcctccctccacggtttcttcccagactttctcaagctcctcctcactgcccttcctccccagcccagcctgggaacacagatgccccgcgggtagagccgggctgatgcggggctgctcagggcaggccccagggcgagcttgccatcgtggccaggcagcctccacctgtgcttcagtggcccctgcccccctgaagcatgtggggtttgtccgctaggaggaggcaaggcccccgaagagaggagagacctgggagtgggagctcaggtcagggaggaggcaggggagtggggtctcccagacccaacggtgagctcagagcaagcttcacgcaggacgctccgaaacactgtgtggagggggctgtgttgtgggcaccttggggcctgattctccttcctccgaacgggctccttgatggcctggccacaggggcagctccccattggctgttaggaccagagtgtgaagaagaagtgaaatataaatatgtatacatatataaatatatttttaattacatgtcgtgtcacggtggctccagacatactgtttgcctagtttattccactgcttgaaagcgcttcctagccaatctgaacaacaacactttaagctgtttttctaaatgcaggttgctgctcctttttcagatatggaaggaaaacgttaagactattttttttttaaagaaacaacagtcaagcctaaaatttgagaccccgaggcagcttcccgagggagactgctcagacaggaactgcaggacagaagtggatgccccacagaccctggccccctccccaagtccatcccctctctgtggcatgaggaaggccgcgtccgagttgacctctgaatgtatgtgatgagaggcagagctggatattgcatttctaaggcttgcattgctttcccctcgcccgcggttcttggcgcatggaagaggcggtccagccatctgatgttgatcctgtctcagtctccccactgcctgtcaggatgagttagtcattgtttttctccgaggcggcctgcttgccacagccctgctccccaaggcctggtggctttgccgaagctctgggaccgcagccccagcgaggcccccaacctcacccagacgaggccaggagccccgccaccctccacgggatgtgcaccctcagaccccattctctctgttcgtccttccttgaccagtctgtaaaccttcactgtttggggatcgtcctgtccatccatgtaaatgtaaatgttggccgagtcggtatttattctgattgatttttattttattctattattttctccgagggatgagggtggggggtgtgggaagggtaccacagatcaggccggggcagctgtaggggcgggggcccagacagccaggccgccaccagagcagccccatggggtgccccagacgcgggcctccaagaagccaagtcccagtctgttttctggcatcagacaccggcccgtgttccttgtcagacagacagactctcaggcctgcctggggagtcgtgtccctcagctgcagggcactgtgttgggaaaccattggctgggcctttgaggacacagatcagaagaaagaaagacaactttcctctgcgcggaacactcacacggaagggctggccgcctccctgagccggctgggagtggacgacaggacctacctccccagagcaagggcctggggcttcccgccaaagctgccgcggaaccccgctagtgcgaccaccctccctccgtcggtatgtcctgctttccagctgaacccaaactacaagtgggtttaaaaaaataaacaaacaccaatcagctaaaatacaaatattcactatctactctaccgcccgcagatcttctcaccactctctcttctccttctctcctctctcactccgttgccactccacaccacacatcatcacaccacaccgttataccaccccaccttgccccaccatcacccgccctctctccccaccaccatcttcaagtcaacactcactcctccgcgcccctcaccccgcctcgtcatcaaacatacccagccaacaccctcgctccaccctccctctctcacccacatcaccacgaaacactcagtctccctctcaccctcttccccccctcctcctaacactatccaacacccttcttcctcccctcctcctcctcctcctacctctatctc

SEQ ID NO: 455660 - DNA, 5998 bp, Homo sapiens
gtcagatcagggatcattttttttccttcctctactccctcccccctacccgcccctccctccctgtttcccttccctccctccctcccctctctgctgggtctgtgcgctggggcgcccgatcccctccgcagctgggacgctccgaactcgaggcaggagtcggctctccggagcctcgtccctcccttccccttccctgcccccttcccccacccccgactcgggcttggcgcggcggccagaggaaccccgagcccgcatttgctgcatcgagcagttggtttagtatcagccaaacttgcagctgttttctctgtcctctttcccaccagtcccggcccaggcccctgagctggagggatggaaaactcctctgcagcatcagcctcctcggaggcagggagcagccgctcccaggagatcgaggagctggagcgcttcatcgacagctacgtgctggagtaccaggtgcaggggctgctggctgacaagacggagggtgatggcgagagcgagaggacccagtcccacatctcccagtggacagcggactgcagcgaaccgctggacagcagctgttccttctcccgagggcgagcccccccacagcagaatggcagcaaagacaactctctggacatgctgggcacggacatctgggcggccaacaccttcgattccttcagtggtgccacctgggacctgcagccggaaaagctggacttcacccagttccaccgcaaagtccgacacacgcccaagcagcccctgccacacatcgaccgcgaagggtgtggcaaagggaagctggaagatggggatggcatcaacctgaatgacatcgagaaggtccttccagcctggcagggctaccacccgatgccccatgaagtggagatcgcacacaccaagaagctgttccgcaggaggagaaatgatcgaaggcggcagcagagacctccggggggcaacaagccccaacagcatggtgaccaccagccaggcagtgccaaacacaacagggaccaccagaaatcctaccaggggggctcagcaccccacccctcagggaggcccactcaccatggctacagccagaaccggcgctggcaccatggcaacatgaagcacccaccaggcgacaagggggaggcaggcgcacaccgcaatgccaaagagaccatgaccatcgagaacccaaaactggaggacactgcaggggacaccgggcacagcagcctcgaggccccccgcagccctgacaccctggccccggtggcttctgagcggctgcccccacagcagtcaggggggccagaggttgagacaaaacgtaaagacagtattcttcccgagcgcatcggggagcggcccaaaattaccctgctccagtcttccaaagacagactgcggcgaaggctaaaggaaaaggatgaagtggccgtggagacgaccactccccagcagaacaagatggacaagctgatcgagatcctgaacagcatgcggaacaacagcagcgacgtggacaccaagctcaccaccttcatggaggaggcccagaactccaccaactccgaggagatgctgggcgagatcgtgcgcacaatctaccagaaggctgtgtccgaccgcagcttcgccttcaccgctgccaagctctgcgacaagatggcgctctttatggtggaggggaccaagttccggagcctgctcctcaacatgctgcagaaggacttcacggtgcgcgaggagctgcagcagcaggacgtggagcgctggctgggcttcatcaccttcctgtgcgaggtcttcggcaccatgcgcagcagcacaggcgagcccttccgtgtgctcgtgtgccccatctacacctgcctcagggagctcttgcaatctcaggatgtgaaggaagatgctgtcctttgctgctctatggagctgcagagtacaggccggctgctggaggaacagctgcctgagatgatgacagagctcctggccagcgcacgggacaagatgctgtgcccctcggagtccatgctgacccggtcgctgctcctagaggtcatcgagctccacgctaacagctggaaccctctgacgccccccatcacgcagtactacaacagaaccatccagaaactgacagcctgacagccagggggcctggcaggcggcccacgggcagctggggccctggtgcacagggccagatggacaggcgggaggacaggggtggccctggcgggagaaagaaatggggaggagggcaggcagagtcggtggccagtctggagccagacggggaagggagcaaatccctgagaggagtgcccccgcacaagccccccagcccgagcatgcaagctcacaccaataagggaagcatgtttctttttcctggtggccctggccctccccttcctcactcccgcctctcccctccccatcagacccatcccccacggagctttgtgtgagggatctcatcgctgtgactcctcggagaccttggcagcctcgcacgccggggcaccgcttgggtcagaaaggacctcggaaggctgaaaaagtgggtcggagacgggctcgcattgttcccgcatgctgtcagccgcagtcgccaactggcagcaggcgacgtgtagcagatgtccgggaggacaaaggcaggcacggtccccaccagccgcccgtaattgacggcctttgtcagccatggcagagctgacgctccacctcccacctccaagtcctcctcactgcagcccccacagcctcaggcctagggggtcaggcgcagcgggggagatggagtttgcagttccacttgcactcttttgtttattgtgttttatttttcaaaagtcggttgctttgaagtctctttggccaatgaaaatgcccgtgatgtgatcacacagtcagcactgttgaggacccccggattagtgggagatcaaacccagctcccctctagaagaaggattcgagccacagacagcttgccagtagccaattagggtaattggaaacttctgccccggcggggggtccccgctggaatcctgtgttcctcgccactggcttccagcgcctctgttttctcaaagggctgatactgtcaccactgggaccaagttaaacctggtcctggccccaggggccttgtggcaaacagggcacagaacgagactggcaaattaaaaccaaaattctagatggtgtcttgcgctccacacgcaggtcttactggggaaaaggatgggagtgggggctccccaggactcgattttagctaatgcgctgtgtcactgccccagctcggacgtagaagcccagccctccgtgagctcttgggaaaggggtgaattcactgggtcatggaagggacagtcaggtgaccagcggggtcgccagatgaagcttcccagccgggaaacaagacggggtttcttggcaggccctggtcctggggagcaggccctgttgttggctggagaggaaggtgtggggtggaacaggtgtccacatagctccatctctgggggctggagcacacactttgatgagcccccccggaaatgatgtcagagcctagccgcttccttatttgctcttttattgaggccgggcaggccctgggtcactttggaggcccctcttggtccacactggactggccgggaggtgatgggcggggaaggttctcgtgattgattgattctgagtctgagagtggcgagtggggagaggcttccccagttctctccagctttccctgcagctgcaacctgccctctggtcccaggtgtggagcctttgcctgtctctaaaaagagcctgttggcgacaaggtgtagggggcacaagtttacctgaaacaggtcagtggtctctcccaagaagcgcacgccacctctggtccctggccctgaaccctgccttcttcctccctccacggtttcttcccagactttctcaagctcctcctcactgcccttcctccccagcccagcctgggaacacagatgccccgcgggtaggaggcctcgagggaggagccgggctgatgcggggctgctcagggcaggccccagggcgagcttgccatcgtggccaggcagcctccacctgtgcttcagtggcccctgcccccctgaagcatgtggggtttgtccgctaggaggaggcaaggcccccgaagagaggagagacctgggagtgggagctcaggtcagggaggaggcaggggagtggggtctcccagacccaacggtgagctcagagcaagcttcacgcaggacgctccgaaacactgtgtggagggggctgtgttgtgggcaccttggggcctgattctccttcctccgaacgggctccttgatggcctggccacaggggcagctccccattggctgttaggaccagagtgtgaagaagaagtgaaatataaatatgtatacatatataaatatatttttaattacatgtcgtgtcacggtggctccagacatactgtttgcctagtttattccactgcttgaaagcgcttcctagccaatctgaacaacaacactttaagctgtttttctaaatgcaggttgctgctcctttttcagatatggaaggaaaacgttaagactattttttttttaaagaaacaacagtcaagcctaaaatttgagaccccgaggcagcttcccgagggagactgctcagacaggaactgcaggacagaagtggatgccccacagaccctggccccctccccaagtccatcccctctctgtggcatgaggaaggccgcgtccgagttgacctctgaatgtatgtgatgagaggcagagctggatattgcatttctaaggcttgcattgctttcccctcgcccgcggttcttggcgcatggaagaggcggtccagccatctgatgttgatcctgtctcagtctccccactgcctgtcaggatgagttagtcattgtttttctccgaggcggcctgcttgccacagccctgctccccaaggcctggtggctttgccgaagctctgggaccgcagccccagcgaggcccccaacctcacccagacgaggccaggagccccgccaccctccacgggatgtgcaccctcagaccccattctctctgttcgtccttccttgaccagtctgtaaaccttcactgtttggggatcgtcctgtccatccatgtaaatgtaaatgttggccgagtcggtatttattctgattgatttttattttattctattattttctccgagggatgagggtggggggtgtgggaagggtaccacagatcagggcactgtgttgggaaaccattggctgggcctttgaggacacagatcagaagaaagaaagacaactttcctctgcgcggaacactcacacggaagggctggccgcctccctgagccggctgggagtggacgacaggacctacctccccagagcaagggcctggggcttcccgccaaagctgccgcggaaccccgctagtgcgaccaccctccctccgtcggtatgtcctgctttccagctgaacccaaactacaagtgggtttaaaaaaataaacaaacaccaatcagctaaaatacaaatattcactatctactctaccgcccgcagatcttctcaccactctctcttctccttctctcctctctcactccgttgccactccacaccacacatcatcacaccacaccgttataccaccccaccttgccccaccatcacccgccctctctccccaccaccatcttcaagtcaacactcactcctccgcgcccctcaccccgcctcgtcatcaaacatacccagccaacaccctcgctccaccctccctctctcacccacatcaccacgaaacactcagtctccctctcaccctcttccccccctcctcctaacactatccaacacccttcttcctcccctcctcctcctcctcctacctctatctc

SEQ ID NO: 455661 - DNA, 4668 bp, Homo sapiens
gtcagatcagggatcattttttttccttcctctactccctcccccctacccgcccctccctccctgtttcccttccctccctccctcccctctctgctgggtctgtgcgctggggcgcccgatcccctccgcagctgggacgctccgaactcgaggcaggagtcggctctccggagcctcgtccctcccttccccttccctgcccccttcccccacccccgactcgggcttggcgcggcggccagaggaaccccgagcccgcatttgctgcatcgagcagttggtttagtatcagccaaacttgcagctgttttctctgtcctctttcccaccagtcccggcccaggcccctgagctggagggatggaaaactcctctgcagcatcagcctcctcggaggcagggagcagccgctcccaggagatcgaggagctggagcgcttcatcgacagctacgtgctggagtaccaggtgcaggggctgctggctgacaagacggagggtgatggcgagagcgagaggacccagtcccacatctcccagtggacagcggactgcagcgaaccgctggacagcagctgttccttctcccgagggcgagcccccccacagcagaatggcagcaaagacaactctctggacatgctgggcacggacatctgggcggccaacaccttcgattccttcagtggtgccacctgggacctgcagccggaaaagctggacttcacccagttccaccgcaaagtccgacacacgcccaagcagcccctgccacacatcgaccgcgaagggtgtggcaaagggaagctggaagatggggatggcatcaacctgaatgacatcgagaaggtccttccagcctggcagggctaccacccgatgccccatgaagtggagatcgcacacaccaagaagctgttccgcaggaggagaaatgatcgaaggcggcagcagagacctccggggggcaacaagccccaacagcatggtgaccaccagccaggcagtgccaaacacaacagggaccaccagaaatcctaccaggggggctcagcaccccacccctcagggaggcccactcaccatggctacagccagaaccggcgctggcaccatggcaacatgaagcacccaccaggcgacaagggggaggcaggcgcacaccgcaatgccaaagagaccatgaccatcgagaacccaaaactggaggacactgcaggggacaccgggcacagcagcctcgaggccccccgcagccctgacaccctggccccggtggcttctgagcggctgcccccacagcagtcaggggggccagaggttgagacaaaacgtaaagacagtattcttcccgagcgcatcggggagcggcccaaaattaccctgctccagtcttccaaagacagactgcggcgaaggctaaaggaaaaggatgaagtggccgtggagacgaccactccccagcagaacaagatggacaagctgatcgagatcctgaacagcatgcggaacaacagcagcgacgtggacaccaagctcaccaccttcatggaggaggcccagaactccaccaactccgaggagatgctgggcgagatcgtgcgcacaatctaccagaaggctgtgtccgaccgcagcttcgccttcaccgctgccaagctctgcgacaagatggcgctctttatggtggaggggaccaagttccggagcctgctcctcaacatgctgcagaaggacttcacggtgcgcgaggagctgcagcagcaggacgtggagcgctggctgggcttcatcaccttcctgtgcgaggtcttcggcaccatgcgcagcagcacaggcgagcccttccgtgtgctcgtgtgccccatctacacctgcctcagggagctcttgcaatctcaggatgtgaaggaagatgctgtcctttgctgctctatggagctgcagagtacaggccggctgctggaggaacagctgcctgagatgatgacagagctcctggccagcgcacgggacaagatgctgtgcccctcggagtccatgctgacccggtcgctgctcctagaggtcatcgagctccacgctaacagctggaaccctctgacgccccccatcacgcagtactacaacagaaccatccagaaactgacagcctgacagccagggggcctggcaggcggcccacgggcagctggggccctggtgcacagggccagatggacaggcgggaggacaggggtggccctggcgggagaaagaaatggggaggagggcaggcagagtcggtggccagtctggagccagacggggaagggagcaaatccctgagaggagtgcccccgcacaagccccccagcccgagcatgcaagctcacaccaataagggaagcatgtttctttttcctggtggccctggccctccccttcctcactcccgcctctcccctccccatcagacccatcccccacggagctttgtgtgagggatctcatcgctgtgactcctcggagaccttggcagcctcgcacgccggggcaccgcttgggtcagaaaggacctcggaaggctgaaaaagtgggtcggagacgggctcgcattgttcccgcatgctgtcagccgcagtcgccaactggcagcaggcgacgtgtagcagatgtccgggaggacaaaggcaggcacggtccccaccagccgcccgtaattgacggcctttgtcagccatggcagagctgacgctccacctcccacctccaagtcctcctcactgcagcccccacagcctcaggcctagggggtcaggcgcagcgggggagatggagtttgcagttccacttgcactcttttgtttattgtgttttatttttcaaaagtcggttgctttgaagtctctttggccaatgaaaatgcccgtgatgtgatcacacagtcagcactgttgaggacccccggattagtgggagatcaaacccagctcccctctagaagaaggattcgagccacagacagcttgccagtagccaattagggtgtggagcctttgcctgtctctaaaaagagcctgttggcgacaaggtgtagggggcacaagtttacctgaaacagatatggaaggaaaacgttaagactattttttttttaaagaaacaacagtcaagcctaaaatttgagaccccgaggcagcttcccgagggagactgctcagacaggaactgcaggacagaagtggatgccccacagaccctggccccctccccaagtccatcccctctctgtggcatgaggaaggccgcgtccgagttgacctctgaatgtatgtgatgagaggcagagctggatattgcatttctaaggcttgcattgctttcccctcgcccgcggttcttggcgcatggaagaggcggtccagccatctgatgttgatcctgtctcagtctccccactgcctgtcaggatgagttagtcattgtttttctccgaggcggcctgcttgccacagccctgctccccaaggcctggtggctttgccgaagctctgggaccgcagccccagcgaggcccccaacctcacccagacgaggccaggagccccgccaccctccacgggatgtgcaccctcagaccccattctctctgttcgtccttccttgaccagtctgtaaaccttcactgtttggggatcgtcctgtccatccatgtaaatgtaaatgttggccgagtcggtatttattctgattgatttttattttattctattattttctccgagggatgagggtggggggtgtgggaagggtaccacagatcaggccggggcagctgtaggggcgggggcccagacagccaggccgccaccagagcagccccatggggtgccccagacgcgggcctccaagaagccaagtcccagtctgttttctggcatcagacaccggcccgtgttccttgtcagacagacagactctcaggcctgcctggggagtcgtgtccctcagctgcagggcactgtgttgggaaaccattggctgggcctttgaggacacagatcagaagaaagaaagacaactttcctctgcgcggaacactcacacggaagggctggccgcctccctgagccggctgggagtggacgacaggacctacctccccagagcaagggcctggggcttcccgccaaagctgccgcggaaccccgctagtgcgaccaccctccctccgtcggtatgtcctgctttccagctgaacccaaactacaagtgggtttaaaaaaataaacaaacaccaatcagctaaaatacaaatattcactatctactctaccgcccgcagatcttctcaccactctctcttctccttctctcctctctcactccgttgccactccacaccacacatcatcacaccacaccgttataccaccccaccttgccccaccatcacccgccctctctccccaccaccatcttcaagtcaacactcactcctccgcgcccctcaccccgcctcgtcatcaaacatacccagccaacaccctcgctccaccctccctctctcacccacatcaccacgaaacactcagtctccctctcaccctcttccccccctcctcctaacactatccaacacccttcttcctcccctcctcctcctcctcctacctctatctc

SEQ ID NO: 455662 - DNA, 5459 bp, Homo sapiens
gtcagatcagggatcattttttttccttcctctactccctcccccctacccgcccctccctccctgtttcccttccctccctccctcccctctctgctgggtctgtgcgctggggcgcccgatcccctccgcagctgggacgctccgaactcgaggcaggagtcggctctccggagcctcgtccctcccttccccttccctgcccccttcccccacccccgactcgggcttggcgcggcggccagaggaaccccgagcccgcatttgctgcatcgagcagttggtttagtatcagccaaacttgcagctgttttctctgtcctctttcccaccagtcccggcccaggcccctgagctggagggatggaaaactcctctgcagcatcagcctcctcggaggcagggagcagccgctcccaggagatcgaggagctggagcgcttcatcgacagctacgtgctggagtaccaggtgcaggggctgctggctgacaagacggagggtgatggcgagagcgagaggacccagtcccacatctcccagtggacagcggactgcagcgaaccgctggacagcagctgttccttctcccgagggcgagcccccccacagcagaatggcagcaaagacaactctctggacatgctgggcacggacatctgggcggccaacaccttcgattccttcagtggtgccacctgggacctgcagccggaaaagctggacttcacccagttccaccgcaaagtccgacacacgcccaagcagcccctgccacacatcgaccgcgaagggtgtggcaaagggaagctggaagatggggatggcatcaacctgaatgacatcgagaaggtccttccagcctggcagggctaccacccgatgccccatgaagtggagatcgcacacaccaagaagctgttccgcaggaggagaaatgatcgaaggcggcagcagagacctccggggggcaacaagccccaacagcatggtgaccaccagccaggcagtgccaaacacaacagggaccaccagaaatcctaccaggggggctcagcaccccacccctcagggaggcccactcaccatggctacagccagaaccggcgctggcaccatggcaacatgaagcacccaccaggcgacaagggggaggcaggcgcacaccgcaatgccaaagagaccatgaccatcgagaacccaaaactggaggacactgcaggggacaccgggcacagcagcctcgaggccccccgcagccctgacaccctggccccggtggcttctgagcggctgcccccacagcagtcaggggggccagaggttgagacaaaacgtaaagacagtattcttcccgagcgcatcggggagcggcccaaaattaccctgctccagtcttccaaagacagactgcggcgaaggctaaaggaaaaggatgaagtggccgtggagacgaccactccccagcagaacaagatggacaagctgatcgagatcctgaacagcatgcggaacaacagcagcgacgtggacaccaagctcaccaccttcatggaggaggcccagaactccaccaactccgaggagatgctgggcgagatcgtgcgcacaatctaccagaaggctgtgtccgaccgcagcttcgccttcaccgctgccaagctctgcgacaagatggcgctctttatggtggaggggaccaagttccggagcctgctcctcaacatgctgcagaaggacttcacggtgcgcgaggagctgcagcagcaggacgtggagcgctggctgggcttcatcaccttcctgtgcgaggtcttcggcaccatgcgcagcagcacaggcgagcccttccgtgtgctcgtgtgccccatctacacctgcctcagggagctcttgcaatctcaggatgtgaaggaagatgctgtcctttgctgctctatggagctgcagagtacaggccggctgctggaggaacagctgcctgagatgatgacagagctcctggccagcgcacgggacaagatgctgtgcccctcggagtccatgctgacccggtcgctgctcctagaggtcatcgagctccacgctaacagctggaaccctctgacgccccccatcacgcagtactacaacagaaccatccagaaactgacagcctgacagccagggggcctggcaggcggcccacgggcagctggggccctggtgcacagggccagatggacaggcgggaggacaggggtggccctggcgggagaaagaaatggggaggagggcaggcagagtcggtggccagtctggagccagacggggaagggagcaaatccctgagaggagtgcccccgcacaagccccccagcccgagcatgcaagctcacaccaataagggaagcatgtttctttttcctggtggccctggccctccccttcctcactcccgcctctcccctccccatcagacccatcccccacggagctttgtgtgagggatctcatcgctgtgactcctcggagaccttggcagcctcgcacgccggggcaccgcttgggtcagaaaggacctcggaaggctgaaaaagtgggtcggagacgggctcgcattgttcccgcatgctgtcagccgcagtcgccaactggcagcaggcgacgtgtagcagatgtccgggaggacaaaggcaggcacggtccccaccagccgcccgtaattgacggcctttgtcagccatggcagagctgacgctccacctcccacctccaagtcctcctcactgcagcccccacagcctcaggcctagggggtcaggcgcagcgggggagatggagtttgcagttccacttgcactcttttgtttattgtgttttatttttcaaaagtcggttgctttgaagtctctttggccaatgaaaatgcccgtgatgtgatcacacagtcagcactgttgaggacccccggattagtgggagatcaaacccagctcccctctagaagaaggattcgagccacagacagcttgccagtagccaattagggtaattggaaacttctgccccggcggggggtccccgctggaatcctgtgttcctcgccactggcttccagcgcctctgttttctcaaagggctgatactgtcaccactgggaccaagttaaacctggtcctggccccaggggccttgtggcaaacagggcacagaacgagactggcaaattaaaaccaaaattctagatggtgtcttgcgctccacacgcaggtcttactggggaaaaggatgggagtgggggctccccaggactcgattttagctaatgcgctgtgtcactgccccagctcggacgtagaagcccagccctccgtgagctcttgggaaaggggtgaattcactgggtcatggaagggacagtcaggtgaccagcggggtcgccagatgaagcttcccagccgggaaacaagacggggtttcttggcaggccctggtcctggggagcaggccctgttgttggctggagaggaaggtgtggggtggaacaggtgtccacatagctccatctctgggggctggagcacacactttgatgagcccccccggaaatgatgtcagagcctagccgcttccttatttgctcttttattgaggccgggcaggccctgggtcactttggaggcccctcttggtccacactggactggccgggaggtgatgggcggggaaggttctcgtgattgattgattctgagtctgagagtggcgagtggggagaggcttccccagttctctccagctttccctgcagctgcaacctgccctctggtcccaggtgtggagcctttgcctgtctctaaaaagagcctgttggcgacaaggtgtagggggcacaagtttacctgaaacaggtcagtggtctctcccaagaagcgcacgccacctctggtccctggccctgaaccctgccttcttcctccctccacggtttcttcccagactttctcaagctcctcctcactgcccttcctccccagcccagcctgggaacacagatgccccgcgggtaggaggcctcgagggaggagccgggctgatgcggggctgctcagggcaggccccagggcgagcttgccatcgtggccaggcagcctccacctgtgcttcagtggcccctgcccccctgaagcatgtggggtttgtccgctaggaggaggcaaggcccccgaagagaggagagacctgggagtgggagctcaggtcagggaggaggcaggggagtggggtctcccagacccaacggtgagctcagagcaagcttcacgcaggacgctccgaaacactgtgtggagggggctgtgttgtgggcaccttggggcctgattctccttcctccgaacgggctccttgatggcctggccacaggggcagctccccattggctgttaggaccagagtgtgaagaagaagtgaaatataaatatgtatacatatataaatatatttttaattacatgtcgtgtcacggtggctccagacatactgtttgcctagtttattccactgcttgaaagcgcttcctagccaatctgaacaacaacactttaagctgtttttctaaatgcaggttgctgctcctttttcagatatggaaggaaaacgttaagactattttttttttaaagaaacaacagtcaagcctaaaatttgagaccccgaggcagcttcccgagggagactgctcagacaggaactgcaggacagaagtggatgccccacagaccctggccccctccccaagtccatcccctctctgtggcatgaggaaggccgcgtccgagttgacctctgaatgtatgtgatgagaggcagagctggatattgcatttctaaggcttgcattgctttcccctcgcctccctgagccggctgggagtggacgacaggacctacctccccagagcaagggcctggggcttcccgccaaagctgccgcggaaccccgctagtgcgaccaccctccctccgtcggtatgtcctgctttccagctgaacccaaactacaagtgggtttaaaaaaataaacaaacaccaatcagctaaaatacaaatattcactatctactctaccgcccgcagatcttctcaccactctctcttctccttctctcctctctcactccgttgccactccacaccacacatcatcacaccacaccgttataccaccccaccttgccccaccatcacccgccctctctccccaccaccatcttcaagtcaacactcactcctccgcgcccctcaccccgcctcgtcatcaaacatacccagccaacaccctcgctccaccctccctctctcacccacatcaccacgaaacactcagtctccctctcaccctcttccccccctcctcctaacactatccaacacccttcttcctcccctcctcctcctcctcctacctctatctc

SEQ ID NO: 455663 - DNA, 2542 bp, Homo sapiens
gtcagatcagggatcattttttttccttcctctactccctcccccctacccgcccctccctccctgtttcccttccctccctccctcccctctctgctgggtctgtgcgctggggcgcccgatcccctccgcagctgggacgctccgaactcgaggcaggagtcggctctccggagcctcgtccctcccttccccttccctgcccccttcccccacccccgactcgggcttggcgcggcggccagaggaaccccgagcccgcatttgctgcatcgagcagttggtttagtatcagccaaacttgcagctgttttctctgtcctctttcccaccagtcccggcccaggcccctgagctggagggatggaaaactcctctgcagcatcagcctcctcggaggcagggagcagccgctcccaggagatcgaggagctggagcgcttcatcgacagctacgtgctggagtaccaggtgcaggggctgctggctgacaagacggagggtgatggcgagagcgagaggacccagtcccacatctcccagtggacagcggactgcagcgaaccgctggacagcagctgttccttctcccgagggcgagcccccccacagcagaatggcagcaaagacaactctctggacatgctgggcacggacatctgggcggccaacaccttcgattccttcagtggtgccacctgggacctgcagccggaaaagctggacttcacccagttccaccgcaaagtccgacacacgcccaagcagcccctgccacacatcgaccgcgaagggtgtggcaaagggaagctggaagatggggatggcatcaacctgaatgacatcgagaaggtccttccagcctggcagggctaccacccgatgccccatgaagtggagatcgcacacaccaagaagctgttccgcaggaggagaaatgatcgaaggcggcagcagagacctccggggggcaacaagccccaacagcatggtgaccaccagccaggcagtgccaaacacaacagggaccaccagaaatcctaccaggggggctcagcaccccacccctcagggaggcccactcaccatggctacagccagaaccggcgctggcaccatggcaacatgaagcacccaccaggcgacaagggggaggcaggcgcacaccgcaatgccaaagagaccatgaccatcgagaacccaaaactggaggacactgcaggggacaccgggcacagcagcctcgaggccccccgcagccctgacaccctggccccggtggcttctgagcggctgcccccacagcagtcaggggggccagaggttgagacaaaacgtaaagacagtattcttcccgagcgcatcggggagcggcccaaaattaccctgctccagtcttccaaagacagactgcggcgaaggctaaaggaaaaggatgaagtggccgtggagacgaccactccccagcagaacaagatggacaagctgatcgagatcctgaacagcatgcggaacaacagcagcgacgtggacaccaagctcaccaccttcatggaggaggcccagaactccaccaactccgaggagatgctgggcgagatcgtgcgcacaatctaccagaaggctgtgtccgaccgcagcttcgccttcaccgctgccaagctctgcgacaagatggcgctctttatggtggaggggaccaagttccggagcctgctcctcaacatgctgcagaaggacttcacggtgcgcgaggagctgcagcagcaggacgtggagcgctggctgggcttcatcaccttcctgtgcgaggtcttcggcaccatgcgcagcagcacaggcgagcccttccgtgtgtcgtgtccctcagctgcagggcactgtgttgggaaaccattggctgggcctttgaggacacagatcagaagaaagaaagacaactttcctctgcgcggaacactcacacggaagggctggccgcctccctgagccggctgggagtggacgacaggacctacctccccagagcaagggcctggggcttcccgccaaagctgccgcggaaccccgctagtgcgaccaccctccctccgtcggtatgtcctgctttccagctgaacccaaactacaagtgggtttaaaaaaataaacaaacaccaatcagctaaaatacaaatattcactatctactctaccgcccgcagatcttctcaccactctctcttctccttctctcctctctcactccgttgccactccacaccacacatcatcacaccacaccgttataccaccccaccttgccccaccatcacccgccctctctccccaccaccatcttcaagtcaacactcactcctccgcgcccctcaccccgcctcgtcatcaaacatacccagccaacaccctcgctccaccctccctctctcacccacatcaccacgaaacactcagtctccctctcaccctcttccccccctcctcctaacactatccaacacccttcttcctcccctcctcctcctcctcctacctctatctc

SEQ ID NO: 455664 - DNA, 639 bp, Homo sapiens
ctccgtgtgagtgttccgcgcagaggaggcggcagcccttccgtgtgagtgttccgcgcagaggaaagggctggccgcctccctgagccggctgggagtggacgacaggacctacctccccagagcaagggcctggggcttcccgccaaagctgccgcggaaccccgctagtgcgaccaccctccctccgtcggtatgtcctgctttccagctgaacccaaactacaagtgggtttaaaaaaataaacaaacaccaatcagctaaaatacaaatattcactatctactctaccgcccgcagatcttctcaccactctctcttctccttctctcctctctcactccgttgccactccacaccacacatcatcacaccacaccgttataccaccccaccttgccccaccatcacccgccctctctccccaccaccatcttcaagtcaacactcactcctccgcgcccctcaccccgcctcgtcatcaaacatacccagccaacaccctcgctccaccctccctctctcacccacatcaccacgaaacactcagtctccctctcaccctcttccccccctcctcctaacactatccaacacccttcttcctcccctcctcctcctcctcctacctctatctc

SEQ ID NO: 455665 - DNA, 574 bp, Homo sapiens
gtcagatcagggatcattttttttccttcctctactccctcccccctacccgcccctccctccctgtttcccttccctccctccctcccctctctgctgggtctgtgcgctggggcgcccgatcccctccgcagctgggacgctccgaactcgaggcaggagtcggctctccggagcctcgtccctcccttccccttccctgcccccttcccccacccccgactcgggcttggcgcggcggccagaggaaccccgagtcccggcccaggcccctgagctggagggatggaaaactcctctgcagcatcagcctcctcggaggcagggagcagccgctcccaggagatcgaggagctggagcgcttcatcgacagctacgtgctggagtaccaggtgcaggggctgctggctgacaagacggagggtgatggcgagagcgagaggacccagtcccacatctcccagtggacagcggactgcagcgaaccgctggacagcagctgttccttctcccgagggcgagcccccccacagcagaatacagcaccacgaatgggatcctctagacgccacc

SEQ ID NO: 455666 - DNA, 6190 bp, Homo sapiens
gtcagatcagggatcattttttttccttcctctactccctcccccctacccgcccctccctccctgtttcccttccctccctccctcccctctctgctgggtctgtgcgctggggcgcccgatcccctccgcagctgggacgctccgaactcgaggcaggagtcggctctccggagcctcgtccctcccttccccttccctgcccccttcccccacccccgactcgggcttggcgcggcggccagaggaaccccgagcccgcatttgctgcatcgagcagttggtttagtatcagccaaacttgcagctgttttctctgtcctctttcccaccagtcccggcccaggcccctgagctggagggatggaaaactcctctgcagcatcagcctcctcggaggcagggagcagccgctcccaggagatcgaggagctggagcgcttcatcgacagctacgtgctggagtaccaggtgcaggggctgctggctgacaagacggagggtgatggcgagagcgagaggacccagtcccacatctcccagtggacagcggactgcagcgaaccgctggacagcagctgttccttctcccgagggcgagcccccccacagcagaatggcagcaaagacaactctctggacatgctgggcacggacatctgggcggccaacaccttcgattccttcagtggtgccacctgggacctgcagccggaaaagctggacttcacccagttccaccgcaaagtccgacacacgcccaagcagcccctgccacacatcgaccgcgaagggtgtggcaaagggaagctggaagatggggatggcatcaacctgaatgacatcgagaaggtccttccagcctggcagggctaccacccgatgccccatgaagtggagatcgcacacaccaagaagctgttccgcaggaggagaaatgatcgaaggcggcagcagagacctccggggggcaacaagccccaacagcatggtgaccaccagccaggcagtgccaaacacaacagggaccaccagaaatcctaccaggggggctcagcaccccacccctcagggaggcccactcaccatggctacagccagaaccggcgctggcaccatggcaacatgaagcacccaccaggcgacaagggggaggcaggcgcacaccgcaatgccaaagagaccatgaccatcgagaacccaaaactggaggacactgcaggggacaccgggcacagcagcctcgaggccccccgcagccctgacaccctggccccggtggcttctgagcggctgcccccacagcagtcaggggggccagaggttgagacaaaacgtaaagacagtattcttcccgagcgcatcggggagcggcccaaaattaccctgctccagtcttccaaagacagactgcggcgaaggctaaaggaaaaggatgaagtggccgtggagacgaccactccccagcagaacaagatggacaagctgatcgagatcctgaacagcatgcggaacaacagcagcgacgtggacaccaagctcaccaccttcatggaggaggcccagaactccaccaactccgaggagatgctgggcgagatcgtgcgcacaatctaccagaaggctgtgtccgaccgcagcttcgccttcaccgctgccaagctctgcgacaagatggcgctctttatggtggaggggaccaagttccggagcctgctcctcaacatgctgcagaaggacttcacggtgcgcgaggagctgcagcagcaggacgtggagcgctggctgggcttcatcaccttcctgtgcgaggtcttcggcaccatgcgcagcagcacaggcgagcccttccgtgtgctcgtgtgccccatctacacctgcctcagggagctcttgcaatctcaggatgtgaaggaagatgctgtcctttgctgctctatggagctgcagagtacaggccggctgctggaggaacagctgcctgagatgatgacagagctcctggccagcgcacgggacaagatgctgtgcccctcggagtccatgctgacccggtcgctgctcctagaggtcatcgagctccacgctaacagctggaaccctctgacgccccccatcacgcagtactacaacagaaccatccagaaactgacagcctgacagccagggggcctggcaggcggcccacgggcagctggggccctggtgcacagggccagatggacaggcgggaggacaggggtggccctggcgggagaaagaaatggggaggagggcaggcagagtcggtggccagtctggagccagacggggaagggagcaaatccctgagaggagtgcccccgcacaagccccccagcccgagcatgcaagctcacaccaataagggaagcatgtttctttttcctggtggccctggccctccccttcctcactcccgcctctcccctccccatcagacccatcccccacggagctttgtgtgagggatctcatcgctgtgactcctcggagaccttggcagcctcgcacgccggggcaccgcttgggtcagaaaggacctcggaaggctgaaaaagtgggtcggagacgggctcgcattgttcccgcatgctgtcagccgcagtcgccaactggcagcaggcgacgtgtagcagatgtccgggaggacaaaggcaggcacggtccccaccagccgcccgtaattgacggcctttgtcagccatggcagagctgacgctccacctcccacctccaagtcctcctcactgcagcccccacagcctcaggcctagggggtcaggcgcagcgggggagatggagtttgcagttccacttgcactcttttgtttattgtgttttatttttcaaaagtcggttgctttgaagtctctttggccaatgaaaatgcccgtgatgtgatcacacagtcagcactgttgaggacccccggattagtgggagatcaaacccagctcccctctagaagaaggattcgagccacagacagcttgccagtagccaattagggtaattggaaacttctgccccggcggggggtccccgctggaatcctgtgttcctcgccactggcttccagcgcctctgttttctcaaagggctgatactgtcaccactgggaccaagttaaacctggtcctggccccaggggccttgtggcaaacagggcacagaacgagactggcaaattaaaaccaaaattctagatggtgtcttgcgctccacacgcaggtcttactggggaaaaggatgggagtgggggctccccaggactcgattttagctaatgcgctgtgtcactgccccagctcggacgtagaagcccagccctccgtgagctcttgggaaaggggtgaattcactgggtcatggaagggacagtcaggtgaccagcggggtcgccagatgaagcttcccagccgggaaacaagacggggtttcttggcaggccctggtcctggggagcaggccctgttgttggctggagaggaaggtgtggggtggaacaggtgtccacatagctccatctctgggggctggagcacacactttgatgagcccccccggaaatgatgtcagagcctagccgcttccttatttgctcttttattgaggccgggcaggccctgggtcactttggaggcccctcttggtccacactggactggccgggaggtgatgggcggggaaggttctcgtgattgattgattctgagtctgagagtggcgagtggggagaggcttccccagttctctccagctttccctgcagctgcaacctgccctctggtcccaggtgtggagcctttgcctgtctctaaaaagagcctgttggcgacaaggtgtagggggcacaagtttacctgaaacaggtcagtggtctctcccaagaagcgcacgccacctctggtccctggccctgaaccctgccttcttcctccctccacggtttcttcccagactttctcaagctcctcctcactgcccttcctccccagcccagcctgggaacacagatgccccgcgggtaggaggcctcgagggaggagccgggctgatgcggggctgctcagggcaggccccagggcgagcttgccatcgtggccaggcagcctccacctgtgcttcagtggcccctgcccccctgaagcatgtggggtttgtccgctaggaggaggcaaggcccccgaagagaggagagacctgggagtgggagctcaggtcagggaggaggcaggggagtggggtctcccagacccaacggtgagctcagagcaagcttcacgcaggacgctccgaaacactgtgtggagggggctgtgttgtgggcaccttggggcctgattctccttcctccgaacgggctccttgatggcctggccacaggggcagctccccattggctgttaggaccagagtgtgaagaagaagtgaaatataaatatgtatacatatataaatatatttttaattacatgtcgtgtcacggtggctccagacatactgtttgcctagtttattccactgcttgaaagcgcttcctagccaatctgaacaacaacactttaagctgtttttctaaatgcaggttgctgctcctttttcagatatggaaggaaaacgttaagactattttttttttaaagaaacaacagtcaagcctaaaatttgagaccccgaggcagcttcccgagggagactgctcagacaggaactgcaggacagaagtggatgccccacagaccctggccccctccccaagtccatcccctctctgtggcatgaggaaggccgcgtccgagttgacctctgaatgtatgtgatgagaggcagagctggatattgcatttctaaggcttgcattgctttcccctcgcccgcggttcttggcgcatggaagaggcggtccagccatctgatgttgatcctgtctcagtctccccactgcctgtcaggatgagttagtcattgtttttctccgaggcggcctgcttgccacagccctgctccccaaggcctggtggctttgccgaagctctgggaccgcagccccagcgaggcccccaacctcacccagacgaggccaggagccccgccaccctccacgggatgtgcaccctcagaccccattctctctgttcgtccttccttgaccagtctgtaaaccttcactgtttggggatcgtcctgtccatccatgtaaatgtaaatgttggccgagtcggtatttattctgattgatttttattttattctattattttctccgagggatgagggtggggggtgtgggaagggtaccacagatcaggccggggcagctgtaggggcgggggcccagacagccaggccgccaccagagcagccccatggggtgccccagacgcgggcctccaagaagccaagtcccagtctgttttctggcatcagacaccggcccgtgttccttgtcagacagacagactctcaggcctgcctggggagtcgtgtccctcagctgcagggcactgtgttgggaaaccattggctgggcctttgaggacacagatcagaagaaagaaagacaactttcctctgcgcggaacactcacacggaagggctggccgcctccctgagccggctgggagtggacgacaggacctacctccccagagcaagggcctggggcttcccgccaaagctgccgcggaaccccgctagtgcgaccaccctccctccgtcggtatgtcctgctttccagctgaacccaaactacaagtgggtttaaaaaaataaacaaacaccaatcagctaaaatacaaatattcactatctactctaccgcccgcagatcttctcaccactctctcttctccttctctcctctctcactccgttgccactccacaccacacatcatcacaccacaccgttataccaccccaccttgccccaccatcacccgccctctctccccaccaccatcttcaagtcaacactcactcctccgcgcccctcaccccgcctcgtcatcaaacatacccagccaacaccctcgctccaccctccctctctcacccacatcaccacgaaacactcagtctccctctcaccctcttccccccctcctcctaacactatccaacacccttcttcctcccctcctcctcctcctcctacctctatctc

SEQ ID NO: 455667 - DNA, 5937 bp, Homo sapiens
gtcagatcagggatcattttttttccttcctctactccctcccccctacccgcccctccctccctgtttcccttccctccctccctcccctctctgctgggtctgtgcgctggggcgcccgatcccctccgcagctgggacgctccgaactcgaggcaggagtcggctctccggagcctcgtccctcccttccccttccctgcccccttcccccacccccgactcgggcttggcgcggcggccagaggaaccccgagcccgcatttgctgcatcgagcagttggtttagtatcagccaaacttgcagctgttttctctgtcctctttcccaccagtcccggcccaggcccctgagctggagggatggaaaactcctctgcagcatcagcctcctcggaggcagggagcagccgctcccaggagatcgaggagctggagcgcttcatcgacagctacgtgctggagtaccaggtgcaggggctgctggctgacaagacggagggtgatggcgagagcgagaggacccagtcccacatctcccagtggacagcggactgcagcgaaccgctggacagcagctgttccttctcccgagggcgagcccccccacagcagaatggcagcaaagacaactctctggacatgctgggcacggacatctgggcggccaacaccttcgattccttcagtggtgccacctgggacctgcagccggaaaagctggacttcacccagttccaccgcaaagtccgacacacgcccaagcagcccctgccacacatcgaccgcgaagggtgtggcaaagggaagctggaagatggggatggcatcaacctgaatgacatcgagaaggtccttccagcctggcagggctaccacccgatgccccatgaagtggagatcgcacacaccaagaagctgttccgcaggaggagaaatgatcgaaggcggcagcagagacctccggggggcaacaagccccaacagcatggtgaccaccagccaggcagtgccaaacacaacagggaccaccagaaatcctaccaggggggctcagcaccccacccctcagggaggcccactcaccatggctacagccagaaccggcgctggcaccatggcaacatgaagcacccaccaggcgacaagggggaggcaggcgcacaccgcaatgccaaagagaccatgaccatcgagaacccaaaactggaggacactgcaggggacaccgggcacagcagcctcgaggccccccgcagccctgacaccctggccccggtggcttctgagcggctgcccccacagcagtcaggggggccagaggttgagacaaaacgtaaagacagtattcttcccgagcgcatcggggagcggcccaaaattaccctgctccagtcttccaaagacagactgcggcgaaggctaaaggaaaaggatgaagtggccgtggagacgaccactccccagcagaacaagatggacaagctgatcgagatcctgaacagcatgcggaacaacagcagcgacgtggacaccaagctcaccaccttcatggaggaggcccagaactccaccaactccgaggagatgctgggcgagatcgtgcgcacaatctaccagaaggctgtgtccgaccgcagcttcgccttcaccgctgccaagctctgcgacaagatggcgctctttatggtggaggggaccaagttccggagcctgctcctcaacatgctgcagaaggacttcacggtgcgcgaggagctgcagcagcaggacgtggagcgctggctgggcttcatcaccttcctgtgcgaggtcttcggcaccatgcgcagcagcacaggcgagcccttccgtgtgctcgtgtgccccatctacacctgcctcagggagctcttgcaatctcaggatgtgaaggaagatgctgtcctttgctgctctatggagctgcagagtacaggccggctgctggaggaacagctgcctgagatgatgacagagctcctggccagcgcacgggacaagatgctgtgcccctcggagtccatgctgacccggtcgctgctcctagaggtcatcgagctccacgctaacagctggaaccctctgacgccccccatcacgcagtactacaacagaaccatccagaaactgacagcctgacagccagggggcctggcaggcggcccacgggcagctggggccctggtgcacagggccagatggacaggcgggaggacaggggtggccctggcgggagaaagaaatggggaggagggcaggcagagtcggtggccagtctggagccagacggggaagggagcaaatccctgagaggagtgcccccgcacaagccccccagcccgagcatgcaagctcacaccaataagggaagcatgtttctttttcctggtggccctggccctccccttcctcactcccgcctctcccctccccatcagacccatcccccacggagctttgtgtgagggatctcatcgctgtgactcctcggagaccttggcagcctcgcacgccggggcaccgcttgggtcagaaaggacctcggaaggctgaaaaagtgggtcggagacgggctcgcattgttcccgcatgctgtcagccgcagtcgccaactggcagcaggcgacgtgtagcagatgtccgggaggacaaaggcaggcacggtccccaccagccgcccgtaattgacggcctttgtcagccatggcagagctgacgctccacctcccacctccaagtcctcctcactgcagcccccacagcctcaggcctagggggtcaggcgcagcgggggagatggagtttgcagttccacttgcactcttttgtttattgtgttttatttttcaaaagtcggttgctttgaagtctctttggccaatgaaaatgcccgtgatgtgatcacacagtcagcactgttgaggacccccggattagtgggagatcaaacccagctcccctctagaagaaggattcgagccacagacagcttgccagtagccaattagggtaattggaaacttctgccccggcggggggtccccgctggaatcctgtgttcctcgccactggcttccagcgcctctgttttctcaaagggctgatactgtcaccactgggaccaagttaaacctggtcctggccccaggggccttgtggcaaacagggcacagaacgagactggcaaattaaaaccaaaattctagatggtgtcttgcgctccacacgcaggtcttactggggaaaaggatgggagtgggggctccccaggactcgattttagctaatgcgctgtgtcactgccccagctcggacgtagaagcccagccctccgtgagctcttgggaaaggggtgaattcactgggtcatggaagggacagtcaggtgaccagcggggtcgccagatgaagcttcccagccgggaaacaagacggggtttcttggcaggccctggtcctggggagcaggccctgttgttggctggagaggaaggtgtggggtggaacaggtgtccacatagctccatctctgggggctggagcacacactttgatgagcccccccggaaatgatgtcagagcctagccgcttccttatttgctcttttattgaggccgggcaggccctgggtcactttggaggcccctcttggtccacactggactggccgggaggtgatgggcggggaaggttctcgtgattgattgattctgagtctgagagtggcgagtggggagaggcttccccagttctctccagctttccctgcagctgcaacctgccctctggtcccaggtgtggagcctttgcctgtctctaaaaagagcctgttggcgacaaggtgtagggggcacaagtttacctgaaacaggtcagtggtctctcccaagaagcgcacgccacctctggtccctggccctgaaccctgccttcttcctccctccacggtttcttcccagactttctcaagctcctcctcactgcccttcctccccagcccagcctgggaacacagatgccccgcgggtaggaggcctcgagggaggagccgggctgatgcggggctgctcagggcaggccccagggcgagcttgccatcgtggccaggcagcctccacctgtgcttcagtggcccctgcccccctgaagcatgtggggtttgtccgctaggaggaggcaaggcccccgaagagaggagagacctgggagtgggagctcaggtcagggaggaggcaggggagtggggtctcccagacccaacggtgagctcagagcaagcttcacgcaggacgctccgaaacactgtgtggagggggctgtgttgtgggcaccttggggcctgattctccttcctccgaacgggctccttgatggcctggccacaggggcagctccccattggctgttaggaccagagtgtgaagaagaagtgaaatataaatatgtatacatatataaatatatttttaattacatgtcgtgtcacggtggctccagacatactgtttgcctagtttattccactgcttgaaagcgcttcctagccaatctgaacaacaacactttaagctgtttttctaaatgcaggttgctgctcctttttcagatatggaaggaaaacgttaagactattttttttttaaagaaacaacagtcaagcctaaaatttgagaccccgaggcagcttcccgagggagactgctcagacaggaactgcaggacagaagtggatgccccacagaccctggccccctccccaagtccatcccctctctgtggcatgaggaaggccgcgtccgagttgacctctgaatgtatgtgatgagaggcagagctggatattgcatttctaaggcttgcattgctttcccctcgcccgcggttcttggcgcatggaagaggcggtccagccatctgatgttgatcctgtctcagtctccccactgcctgtcaggatgagttagtcattgtttttctccgaggcggcctgcttgccacagccctgctccccaaggcctggtggctttgccgaagctctgggaccgcagccccagcgaggcccccaacctcacccagacgaggccaggagccccgccaccctccacgggatgtgcaccctcagaccccattctctctgttcgtccttccttgaccagtctgtaaaccttcactgtttggggatcgtcctgtccatccatgtaaatacagactctcaggcctgcctggggagtcgtgtccctcagctgcagggcactgtgttgggaaaccattggctgggcctttgaggacacagatcagaagaaagaaagacaactttcctctgcgcggaacactcacacggaagggctggccgcctccctgagccggctgggagtggacgacaggacctacctccccagagcaagggcctggggcttcccgccaaagctgccgcggaaccccgctagtgcgaccaccctccctccgtcggtatgtcctgctttccagctgaacccaaactacaagtgggtttaaaaaaataaacaaacaccaatcagctaaaatacaaatattcactatctactctaccgcccgcagatcttctcaccactctctcttctccttctctcctctctcactccgttgccactccacaccacacatcatcacaccacaccgttataccaccccaccttgccccaccatcacccgccctctctccccaccaccatcttcaagtcaacactcactcctccgcgcccctcaccccgcctcgtcatcaaacatacccagccaacaccctcgctccaccctccctctctcacccacatcaccacgaaacactcagtctccctctcaccctcttccccccctcctcctaacactatccaacacccttcttcctcccctcctcctcctcctcctacctctatctc

SEQ ID NO: 455668 - DNA, 4498 bp, Homo sapiens
gtcagatcagggatcattttttttccttcctctactccctcccccctacccgcccctccctccctgtttcccttccctccctccctcccctctctgctgggtctgtgcgctggggcgcccgatcccctccgcagctgggacgctccgaactcgaggcaggagtcggctctccggagcctcgtccctcccttccccttccctgcccccttcccccacccccgactcgggcttggcgcggcggccagaggaaccccgagcccgcatttgctgcatcgagcagttggtttagtatcagccaaacttgcagctgttttctctgtcctctttcccaccagtcccggcccaggcccctgagctggagggatggaaaactcctctgcagcatcagcctcctcggaggcagggagcagccgctcccaggagatcgaggagctggagcgcttcatcgacagctacgtgctggagtaccaggtgcaggggctgctggctgacaagacggagggtgatggcgagagcgagaggacccagtcccacatctcccagtggacagcggactgcagcgaaccgctggacagcagctgttccttctcccgagggcgagcccccccacagcagaatggcagcaaagacaactctctggacatgctgggcacggacatctgggcggccaacaccttcgattccttcagtggtgccacctgggacctgcagccggaaaagctggacttcacccagttccaccgcaaagtccgacacacgcccaagcagcccctgccacacatcgaccgcgaagggtgtggcaaagggaagctggaagatggggatggcatcaacctgaatgacatcgagaaggtccttccagcctggcagggctaccacccgatgccccatgaagtggagatcgcacacaccaagaagctgttccgcaggaggagaaatgatcgaaggcggcagcagagacctccggggggcaacaagccccaacagcatggtgaccaccagccaggcagtgccaaacacaacagggaccaccagaaatcctaccaggggggctcagcaccccacccctcagggaggcccactcaccatggctacagccagaaccggcgctggcaccatggcaacatgaagcacccaccaggcgacaagggggaggcaggcgcacaccgcaatgccaaagagaccatgaccatcgagaacccaaaactggaggacactgcaggggacaccgggcacagcagcctcgaggccccccgcagccctgacaccctggccccggtggcttctgagcggctgcccccacagcagtcaggggggccagaggttgagacaaaacgtaaagacagtattcttcccgagcgcatcggggagcggcccaaaattaccctgctccagtcttccaaagacagactgcggcgaaggctaaaggaaaaggatgaagtggccgtggagacgaccactccccagcagaacaagatggacaagctgatcgagatcctgaacagcatgcggaacaacagcagcgacgtggacaccaagctcaccaccttcatggaggaggcccagaactccaccaactccgaggagatgctgggcgagatcgtgcgcacaatctaccagaaggctgtgtccgaccgcagcttcgccttcaccgctgccaagctctgcgacaagatggcgctctttatggtggaggggaccaagttccggagcctgctcctcaacatgctgcagaaggacttcacggtgcgcgaggagctgcagcagcaggacgtggagcgctggctgggcttcatcaccttcctgtgcgaggtcttcggcaccatgcgcagcagcacaggcgagcccttccgtgtgctcgtgtgccccatctacacctgcctcagggagctcttgcaatctcaggatgtgaaggaagatgctgtcctttgctgctctatggagctgcagagtacaggccggctgctggaggaacagctgcctgagatgatgacagagctcctggccagcgcacgggacaagatgctgtgcccctcggagtccatgctgacccggtcgctgctcctagaggtcatcgagctccacgctaacagctggaaccctctgacgccccccatcacgcagtactacaacagaaccatccagaaactgacagcctgacagccagggggcctggcaggcggcccacgggcagctggggccctggtgcacagggccagatggacaggcgggaggacaggggtggccctggcgggagaaagaaatggggaggagggcaggcagagtcggtggccagtctggagccagacggggaagggagcaaatccctgagaggagtgcccccgcacaagccccccagcccgagcatgcaagctcacaccaataagggaagcatgtttctttttcctggtggccctggccctccccttcctcactcccgcctctcccctccccatcagacccatcccccacggagctttgtgtgagggatctcatcgctgtgactcctcggagaccttggcagcctcgcacgccggggcaccgcttgggtcagaaaggacctcggaaggctgaaaaagtgggtcggagacgggctcgcattgttcccgcatgctgtcagccgcagtcgccaactggcagcaggcgacgtgtagcagatgtccgggaggacaaaggcaggcacggtccccaccagccgcccgtaattgacggcctttgtcagccatggcagagctgacgctccacctcccacctccaagtcctcctcactgcagcccccacagcctcaggcctagggggtcaggcgcagcgggggagatggagtttgcagttccacttgcactcttttgtttattgtgttttatttttcaaaagtcggttgctttgaagtctctttggccaatgaaaatgcccgtgatgtgatcacacagtcagcactgttgaggacccccggattagtgggagatcaaacccagctcccctctagaagaaggattcgagccacagacagcttgccagtagccaattagggtaattggaaacttctgccccggcggggggtccccgctggaatcctgtgttcctcgccactggcttccagcgcctctgttttctcaaagggctgatactgtcaccactgggaccaagttaaacctggtcctggccccaggggccttgtggcaaacagggcacagaacgagactggcaaattaaaaccaaaattctagatggtgtcttgcgctccacacgcaggtcttactggggaaaaggatgggagtgggggctccccaggactcgattttagctaatgcgctgtgtcactgccccagctcggacgtagaagcccagccctccgtgagctcttgggaaaggggtgaattcactgggtcatggaagggacagtcaggtgaccagcggggtcgccagatgaagcttcccagccgggaaacaagacggggtttcttggcaggccctggtcctggggagcaggccctgttgttggctggagaggaaggtgtggggtggaacaggtgtccacatagctccatctctgggggctggagcacacactttgatgagcccccccggaaatgatgtcagagcctagccgcttccttatttgctcttttattgaggccgggcaggccctgggtcactttggaggcccctcttggtccacactggactggccgggaggtgatgggcggggaaggttctcgtgattgattgattctgagtctgagagtggcgagtggggagaggcttccccagttctctccagctttccctgcagctgcaacctgccctctggtcccaggtgtggagcctttgcctgtctctaaaaagagcctgttggcgacaaggtgtagggggcacaagtttacctgaaacaggtcagtggtctctcccaagaagcgcacgccacctctggtccctggccctgaaccctgccttcttcctccctccacggtttcttcccagactttctcaagctcctcctcactgcccttcctccccagcccagcctgggaacacagatgccccgcgggtaggaggcctcgagggaggagccgggctgatgcggggctgctcagggcaggccccagggcgagcttgccatcgtggccaggcagcctccacctgtgcttcagtggcccctgcccccctgaagcatgtggggtttgtccgctaggaggaggcaaggcccccgaagagaggagagacctgggagtgggagctcaggtcagggaggaggcaggggagtggggtctcccagacccaacggtgagctcagagcaagcttcacgcaggacgctccgaaacactgtgtggagggggctgtgttgtgggcaccttggggcctgattctccttcctccgaacgggctccttgatggcctggccacaggggcagctccccattggctgttaggaccagagtgtgaagaagaagtgaaatataaatatgtatacatatataaatatatttttaattacat

SEQ ID NO: 455669 - DNA, 5183 bp, Homo sapiens
gtcagatcagggatcattttttttccttcctctactccctcccccctacccgcccctccctccctgtttcccttccctccctccctcccctctctgctgggtctgtgcgctggggcgcccgatcccctccgcagctgggacgctccgaactcgaggcaggagtcggctctccggagcctcgtccctcccttccccttccctgcccccttcccccacccccgactcgggcttggcgcggcggccagaggaaccccgagcccgcatttgctgcatcgagcagttggtttagtatcagccaaacttgcagctgttttctctgtcctctttcccaccagtcccggcccaggcccctgagctggagggatggaaaactcctctgcagcatcagcctcctcggaggcagggagcagccgctcccaggagatcgaggagctggagcgcttcatcgacagctacgtgctggagtaccaggtgcaggggctgctggctgacaagacggagggtgatggcgagagcgagaggacccagtcccacatctcccagtggacagcggactgcagcgaaccgctggacagcagctgttccttctcccgagggcgagcccccccacagcagaatggcagcaaagacaactctctggacatgctgggcacggacatctgggcggccaacaccttcgattccttcagtggtgccacctgggacctgcagccggaaaagctggacttcacccagttccaccgcaaagtccgacacacgcccaagcagcccctgccacacatcgaccgcgaagggtgtggcaaagggaagctggaagatggggatggcatcaacctgaatgacatcgagaaggtccttccagcctggcagggctaccacccgatgccccatgaagtggagatcgcacacaccaagaagctgttccgcaggaggagaaatgatcgaaggcggcagcagagacctccggggggcaacaagccccaacagcatggtgaccaccagccaggcagtgccaaacacaacagggaccaccagaaatcctaccaggggggctcagcaccccacccctcagggaggcccactcaccatggctacagccagaaccggcgctggcaccatggcaacatgaagcacccaccaggcgacaagggggaggcaggcgcacaccgcaatgccaaagagaccatgaccatcgagaacccaaaactggaggacactgcaggggacaccgggcacagcagcctcgaggccccccgcagccctgacaccctggccccggtggcttctgagcggctgcccccacagcagtcaggggggccagaggttgagacaaaacgtaaagacagtattcttcccgagcgcatcggggagcggcccaaaattaccctgctccagtcttccaaagacagactgcggcgaaggctaaaggaaaaggatgaagtggccgtggagacgaccactccccagcagaacaagatggacaagctgatcgagatcctgaacagcatgcggaacaacagcagcgacgtggacaccaagctcaccaccttcatggaggaggcccagaactccaccaactccgaggagatgctgggcgagatcgtgcgcacaatctaccagaaggctgtgtccgaccgcagcttcgccttcaccgctgccaagctctgcgacaagatggcgctctttatggtggaggggaccaagttccggagcctgctcctcaacatgctgcagaaggacttcacggtgcgcgaggagctgcagcagcaggacgtggagcgctggctgggcttcatcaccttcctgtgcgaggtcttcggcaccatgcgcagcagcacaggcgagcccttccgtgtgctcgtgtgccccatctacacctgcctcagggagctcttgcaatctcaggatgtgaaggaagatgctgtcctttgctgctctatggagctgcagagtacaggccggctgctggaggaacagctgcctgagatgatgacagagctcctggccagcgcacgggacaagatgctgtgcccctcggagtccatgctgacccggtcgctgctcctagaggtcatcgagctccacgctaacagctggaaccctctgacgccccccatcacgcagtactacaacagaaccatccagaaactgacagcctgacagccagggggcctggcaggcggcccacgggcagctggggccctggtgcacagggccagatggacaggcgggaggacaggggtggccctggcgggagaaagaaatggggaggagggcaggcagagtcggtggccagtctggagccagacggggaagggagcaaatccctgagaggagtgcccccgcacaagccccccagcccgagcatgcaagctcacaccaataagggaagcatgtttctttttcctggtggccctggccctccccttcctcactcccgcctctcccctccccatcagacccatcccccacggagctttgtgtgagggatctcatcgctgtgactcctcggagaccttggcagcctcgcacgccggggcaccgcttgggtcagaaaggacctcggaaggctgaaaaagtgggtcggagacgggctcgcattgttcccgcatgctgtcagccgcagtcgccaactggcagcaggcgacgtgtagcagatgtccgggaggacaaaggcaggcacggtccccaccagccgcccgtaattgacggcctttgtcagccatggcagagctgacgctccacctcccacctccaagtcctcctcactgcagcccccacagcctcaggcctagggggtcaggcgcagcgggggagatggagtttgcagttccacttgcactcttttgtttattgtgttttatttttcaaaagtcggttgctttgaagtctctttggccaatgaaaatgcccgtgatgtgatcacacagtcagcactgttgaggacccccggattagtgggagatcaaacccagctcccctctagaagaaggattcgagccacagacagcttgccagtagccaattagggtaattggaaacttctgccccggcggggggtccccgctggaatcctgtgttcctcgccactggcttccagcgcctctgttttctcaaagggctgatactgtcaccactgggaccaagttaaacctggtcctggccccaggggccttgtggcaaacagggcacagaacgagactggcaaattaaaaccaaaattctagatggtgtcttgcgctccacacgcaggtcttactggggaaaaggatgggagtgggggctccccaggactcgattttagctaatgcgctgtgtcactgccccagctcggacgtagaagcccagccctccgtgagctcttgggaaaggggtgaattcactgggtcatggaagggacagtcaggtgaccagcggggtcgccagatgaagcttcccagccgggaaacaagacggggtttcttggcaggccctggtcctggggagcaggccctgttgttggctggagaggaaggtgtggggtggaacaggtgtccacatagctccatctctgggggctggagcacacactttgatgagcccccccggaaatgatgtcagagcctagccgcttccttatttgctcttttattgaggccgggcaggccctgggtcactttggaggcccctcttggtccacactggactggccgggaggtgatgggcggggaaggttctcgtgattgattgattctgagtctgagagtggcgagtggggagaggcttccccagttctctccagctttccctgcagctgcaacctgccctctggtcccaggtgtggagcctttgcctgtctctaaaaagagcctgttggcgacaaggtgtagggggcacaagtttacctgaaacaggtcagtggtctctcccaagaagcgcacgccacctctggtccctggccctgaaccctgccttcttcctccctccacggtttcttcccagactttctcaagctcctcctcactgcccttcctccccagcccagcctgggaacacagatgccccgcgggtaggaggcctcgagggaggagccgggctgatgcggggctgctcagggcaggccccagggcgagcttgccatcgtggccaggcagcctccacctgtgcttcagtggcccctgcccccctgaagcatgtggggtttgtccgctaggaggaggcaaggcccccgaagagaggagagacctgggagtgggagctcaggtcagggaggaggcaggggagtggggtctcccagacccaacggtgagctcagagcaagcttcacgcaggacgctccgaaacactgtgtggagggggctgtgttgtgggcaccttggggcctgattctccttcctccgaacgggctccttgatggcctggccacaggggcagctccccattggctgttaggaccagagtgtgaagaagaagtgaaatataaatatgtatacatatataaatatatttttaattacattcgtgtccctcagctgcagggcactgtgttgggaaaccattggctgggcctttgaggacacagatcagaagaaagaaagacaactttcctctgcgcggaacactcacacggaagggctggccgcctccctgagccggctgggagtggacgacaggacctacctccccagagcaagggcctggggcttcccgccaaagctgccgcggaaccccgctagtgcgaccaccctccctccgtcggtatgtcctgctttccagctgaacccaaactacaagtgggtttaaaaaaataaacaaacaccaatcagctaaaatacaaatattcactatctactctaccgcccgcagatcttctcaccactctctcttctccttctctcctctctcactccgttgccactccacaccacacatcatcacaccacaccgttataccaccccaccttgccccaccatcacccgccctctctccccaccaccatcttcaagtcaacactcactcctccgcgcccctcaccccgcctcgtcatcaaacatacccagccaacaccctcgctccaccctccctctctcacccacatcaccacgaaacactcagtctccctctcaccctcttccccccctcctcctaacactatccaacacccttcttcctcccctcctcctcctcctcctacctctatctc

SEQ ID NO: 455670 - DNA, 808 bp, Homo sapiens
tagtcattttcttggaggacctgagcccctcagaggtttgtgtctcgggccccattgtgcaccctcaatcttggttctgttgtttatttcatcctgctttgtggtagattctgttaaatctgagtcaggaagtgaggcttggcctgtaggctgagctcatcttctgcctttcccagcgattaaggcctaggtagacactaactctgacactgcacagtgcctgtgctggccaatcagacaagtggcctgcattccctgggcctcagtctcctgccctacacagtgggaattacagcacatagtttatgctgagggcaagccagcccctcgctgacttctcagggttgttggaagaacagaacgccatgatggataagaagatgcttccaggagcagagggtgtttctcaggtgtgggcatcgtcgtctcctccagcagcgtctcacggagttctctgtcctctttcccaccagtcccggcccaggcccctgagctggagggatggaaaactcctctgcagcatcagcctcctcggaggcagggagcagccgctcccaggagatcgaggagctggagcgcttcatcgacagctacgtgctggagtaccaggtgcaggggctgctggctgacaagacggagggtgatggcgagagcgagaggacccagtcccacatctcccaggtgagcgcgggcccggggttggggcagcttgggaaattcagagggggtgatgcaggagcccctaattctgggcagcatccagttgcctgacactagaccgccaaggcatgaatggtcccacccagca

SEQ ID NO: 455671 - DNA, 2767 bp, Homo sapiens
gaagtttccttattcagttgaagattgctatggtgtaacagaagttgtattttgcttttccccttaatccactttccaccctacgcaacccccctcttttcgcttaagaacatactgtagatttgttagaaatagtagtaccttctttccccaccccaaactgctacctgtttcttccttgtttggactctctgctcctctagaagatttcacagcaatgctggactgcagtgactatgttctagactcaagaatgaacaatccgtcagaaaccagtaaaccatctatggagagtggagatggcaacacaggcacacaaaccaatggtctggactttcagaagcagcctgtgcctgtaggaggagcaatctcaacagcccaggcgcaggctttccttggacatctccatcaggtccaactcgctggaacaagtttacaggctgctgctcagtctttaaatgtacagtctaaatctaatgaagaatcgggggattcgcagcagccaagccagccttcccagcagccttcagtgcaggcagccattccccagacccagcttatgctagctggaggacagataactgggcttactttgacgcctgcccagcaacagttactactccagcaggcacaggcacaggcacagctgctggctgctgcagtgcagcagcactccgccagccagcagcacagtgctgctggagccaccatctccgcctctgctgccacgcccatgacgcagatccccctgtctcagcccatacagatcgcacaggatcttcaacaactgcaacagcttcaacagcagaatctcaacctgcaacagtttgtgttggtgcatccaaccaccaatttgcagccagcgcagtttatcatctcacagacgccccagggccagcagggtctcctgcaagcgcaaaatcttctaacgcaactacctcagcaaagccaagccaacctcctacagtcgcagccaagcatcaccctcacctcccagccagcaaccccaacacgcacaatagcagcaaccccaattcagacacttccacagagccagtcaacaccaaagcgaattgatactcccagcttggaggagcccagtgaccttgaggagcttgagcagtttgccaagaccttcaaacaaagacgaatcaaacttggattcactcagggtgatgttgggctcgctatggggaaactatatggaaatgacttcagccaaactaccatctctcgatttgaagccttgaacctcagctttaagaacatgtgcaagttgaagccacttttagagaagtggctaaatgatgcagagaacctctcatctgattcgtccctctccagcccaagtgccctgaattctccaggaattgagggcttgagccgtaggaggaagaaacgcaccagcatagagaccaacatccgtgtggccttagagaagagtttcttggagaatcaaaagcctacctcggaagagatcactatgattgctgatcagctcaatatggaaaaagaggtgattcgtgtttggttctgtaaccgccgccagaaagaaaaaagaatcaacccaccaagcagtggtgggaccagcagctcacctattaaagcaattttccccagcccaacttcactggtggcgaccacaccaagccttgtgactagcagtgcagcaactaccctcacagtcagccctgtcctccctctgaccagtgctgctgtgacgaatctttcagttacaggcacttcagacaccacctccaacaacacagcaaccgtgatttccacagcgcctccagcttcctcagcagtcacgtccccctctctgagtccctccccttctgcctcagcctccacctccgaggcatccagtgccagtgagaccagcacaacacagaccacctccactcctttgtcctcccctcttgggaccagccaggtgatggtgacagcatcaggtttgcaaacagcagcagctgctgcccttcaaggagctgcacagttgccagcaaatgccagtcttgctgccatggcagctgctgcaggactaaacccaagcctgatggcaccctcacagtttgcggctggaggtgccttactcagtctgaatccagggaccctgagcggtgctctcagcccagctctaatgagcaacagtacactggcaactattcaagctcttgcttctggtggctctcttccaataacatcacttgatgcaactgggaacctggtatttgccaatgcgggaggagcccccaacatcgtgactgcccctctgttcctgaaccctcagaacctctctctgctcaccagcaaccctgttagcttggtctctgccgccgcagcatctgcagggaactctgcacctgtagccagccttcacgccacctccacctctgctgagtccatccagaactctctcttcacagtggcctctgccagcggggctgcgtccaccaccaccaccgcctccaaggcacagtgagctgggcagagctgggctgccagaagcctttttcactctgcagtgtgattggactgccagccaggttaataaactgaaaaatgtgattggcttcctctcgccgtgttgtgagggcaaaggagagaagggagaaaaaaaaaaaaaaaccacacacacccatacacacataccagaaaaagaaagaaaggatggagacggaacatttgcctaattttgtaataaaacactgtcttttcaggattgcttcatggattggagaactttctaaccaaaaattaaaaa

SEQ ID NO: 455672 - DNA, 879 bp, Homo sapiens
aaaaatattcaaaatggcggacggaggagcagcgagtcaagatgagagttcagccgcggcggcagcagcagcagactcaagaatgaacaatccgtcagaaaccagtaaaccatctatggagagtggagatggcaacacaggcacacaaaccaatggtctggactttcagaagcagcctgtgcctgtaggaggagcaatctcaacagcccaggcgcaggctttccttggacatctccatcaggtccaactcgctggaacaagtttacaggctgctgctcagtctttaaatgtacagtctaaatctaatgaagaatcgggggattcgcagcagccaagccagccttcccagcagccttcagtgcaggcagccattccccagacccagcttatgctagctggaggacagataactgggcttactttgacgcctgcccagcaacagttactactccagcaggcacaggcacaggcacagctgctggctgctgcagtgcagcagcactccgccagccagcagcacagtgctgctggagccaccatctccgcctctgctgccacgcccatgacgcagatccccctgtctcagcccatacagatcgcacaggatcttcaacaactgcaacagcttcaacagcagaatctcaacctgcaacagtttgtgttggtgcatccaaccaccaatttgcagccagcgcagtttatcatctcacagacgccccagggccagcagggtctctgcaagcgcaaatcttctaacgcaataactcagaaagcaagccaacttctaaagtcggcagcaaggattaccttaactccagcaagaaaccaaaagaaatagggtacccaattgacttcccgagcagcaccaaggatggtccc

SEQ ID NO: 455673 - DNA, 2148 bp, Homo sapiens
aaaaatattcaaaatggcggacggaggagcagcgagtcaagatgagagttcagccgcggcggcagcagcagcagactggaaaagtaagaagagctttcctgcctttttaattaccaaactactctcagttttcaatgaatcagttcaaagaaagaatgcagtctttctatacctgactcaagaatgaacaatccgtcagaaaccagtaaaccatctatggagagtggagatggcaacacaggcacacaaaccaatggtctggactttcagaagcagcctgtgcctgtaggaggagcaatctcaacagcccaggcgcaggctttccttggacatctccatcaggtccaactcgctggaacaagtttacaggctgctgctcagtctttaaatgtacagtctaaatctaatgaagaatcgggggattcgcagcagccaagccagccttcccagcagccttcagtgcaggcagccattccccagacccagcttatgctagctggaggacagataactgggcttactttgacgcctgcccagcaacagttactactccagcaggcacaggcacaggcacagctgctggctgctgcagtgcagcagcactccgccagccagcagcacagtgctgctggagccaccatctccgcctctgctgccacgcccatgacgcagatccccctgtctcagcccatacagatcgcacaggatcttcaacaactgcaacagcttcaacagcagaatctcaacctgcaacagtttgtgttggtgcatccaaccaccaatttgcagccagcgcagtttatcatctcacagacgccccagggccagcagggtctcctgcaagcgcaaaatcttctaacgcaactacctcagcaaagccaagccaacctcctacagtcgcagccaagcatcaccctcacctcccagccagcaaccccaacacgcacaatagcagcaaccccaattcagacacttccacagagccagtcaacaccaaagcgaattgatactcccagcttggaggagcccagtgaccttgaggagcttgagcagtttgccaagaccttcaaacaaagacgaatcaaacttggattcactcagggtgatgttgggctcgctatggggaaactatatggaaatgacttcagccaaactaccatctctcgatttgaagccttgaacctcagctttaagaacatgtgcaagttgaagccacttttagagaagtggctaaatgatgcagagaacctctcatctgattcgtccctctccagcccaagtgccctgaattctccaggaattgagggcttgagccgtaggaggaagaaacgcaccagcatagagaccaacatccgtgtggccttagagaagagtttcttggagaatcaaaagcctacctcggaagagatcactatgattgctgatcagctcaatatggaaaaagaggtgattcgtgtttggttctgtaaccgccgccagaaagaaaaaagaatcaacccaccaagcagtggtgggaccagcagctcacctattaaagcaattttccccagcccaacttcactggtggcgaccacaccaagccttgtgactagcagtgcagcaactaccctcacagtcagccctgtcctccctctgaccagtgctgctgtgacgaatctttcagttacaggcacttcagacaccacctccaacaacacagcaaccgtgatttccacagcgcctccagcttcctcagcagtcacgtccccctctctgagtccctccccttctgcctcagcctccacctccgaggcatccagtgccagtgagaccagcacaacacagaccacctccactcctttgtcctcccctcttgggaccagccaggtgatggtgacagcatcaggtttgcaaacagcagcagctgctgcccttcaaggagctgcacagttgccagcaaatgccagtcttgctgccatggcagctgctgcaggactaaacccaagcctgatggcaccctcacagtttgcggctggaggtgccttactcagtctgaatccagggaccctgagcggtgctctcagcccagctctaatgagcaacagtacactggcaactattcaaggattgcttcatggattggagaactttctaaccaaaaattaaaaa

SEQ ID NO: 455674 - DNA, 2575 bp, Homo sapiens
aaaaatattcaaaatggcggacggaggagcagcgagtcaagatgagagttcagccgcggcggcagcagcagcagactcaagaatgaacaatccgtcagaaaccagtaaaccatctatggagagtggagatggcaacacaggcacacaaaccaatggtctggactttcagaagcagcctgtgcctgtaggaggagcaatctcaacagcccaggcgcaggctttccttggacatctccatcaggtccaactcgctggaacaagtttacaggctgctgctcagtctttaaatgtacagtctaaatctaatgaagaatcgggggattcgcagcagccaagccagccttcccagcagccttcagtgcaggcagccattccccagacccagcttatgctagctggaggacagataactgggcttactttgacgcctgcccagcaacagttactactccagcaggcacaggcacaggcacagctgctggctgctgcagtgcagcagcactccgccagccagcagcacagtgctgctggagccaccatctccgcctctgctgccacgcccatgacgcagatccccctgtctcagcccatacagatcgcacaggatcttcaacaactgcaacagcttcaacagcagaatctcaacctgcaacagtttgtgttggtgcatccaaccaccatcatctcacagacgccccagggccagcagggtctcctgcaagcgcaaaatcttctaacgcaactacctcagcaaagccaagccaacctcctacagtcgcagccaagcatcaccctcacctcccagccagcaaccccaacacgcacaatagcagcaaccccaattcagacacttccacagagccagtcaacaccaaagcgaattgatactcccagcttggaggagcccagtgaccttgaggagcttgagcagtttgccaagaccttcaaacaaagacgaatcaaacttggattcactcagggtgatgttgggctcgctatggggaaactatatggaaatgacttcagccaaactaccatctctcgatttgaagccttgaacctcagctttaagaacatgtgcaagttgaagccacttttagagaagtggctaaatgatgcagagaacctctcatctgattcgtccctctccagcccaagtgccctgaattctccaggaattgagggcttgagccgtaggaggaagaaacgcaccagcatagagaccaacatccgtgtggccttagagaagagtttcttggagaatcaaaagcctacctcggaagagatcactatgattgctgatcagctcaatatggaaaaagaggtgattcgtgtttggttctgtaaccgccgccagaaagaaaaaagaatcaacccaccaagcagtggtgggaccagcagctcacctattaaagcaattttccccagcccaacttcactggtggcgaccacaccaagccttgtgactagcagtgcagcaactaccctcacagtcagccctgtcctccctctgaccagtgctgctgtgacgaatctttcagttacaggcacttcagacaccacctccaacaacacagcaaccgtgatttccacagcgcctccagcttcctcagcagtcacgtccccctctctgagtccctccccttctgcctcagcctccacctccgaggcatccagtgccagtgagaccagcacaacacagaccacctccactcctttgtcctcccctcttgggaccagccaggtgatggtgacagcatcaggtttgcaaacagcagcagctgctgcccttcaaggagctgcacagttgccagcaaatgccagtcttgctgccatggcagctgctgcaggactaaacccaagcctgatggcaccctcacagtttgcggctggaggtgccttactcagtctgaatccagggaccctgagcggtgctctcagcccagctctaatgagcaacagtacactggcaactattcaagctcttgcttctggtggctctcttccaataacatcacttgatgcaactgggaacctggtatttgccaatgcgggaggagcccccaacatcgtgactgcccctctgttcctgaaccctcagaacctctctctgctcaccagcaaccctgttagcttggtctctgccgccgcagcatctgcagggaactctgcacctgtagccagccttcacgccacctccacctctgctgagtccatccagaactctctcttcacagtggcctctgccagcggggctgcgtccaccaccaccaccgcctccaaggcacagtgagctgggcagagctgggctgccagaagcctttttcactctgcagtgtgattggactgccagccaggttaataaactgaaaaatgtgattggcttcctctcgccgtgttgtgagggcaaaggagagaagggagaaaaaaaaaaaaaaaccacacacacccatacacacataccagaaaaagaaagaaaggatggagacggaacatttgcctaattttgtaataaaacactgtcttttcaggattgcttcatggattggagaactttctaaccaaaaattaaaaa

SEQ ID NO: 455675 - DNA, 2169 bp, Homo sapiens
aaaaatattcaaaatggcggacggaggagcagcgagtcaagatgagagttcagccgcggcggcagcagcagcagactcaagaatgaacaatccgtcagaaaccagtaaaccatctccgcctctgctgccacgcccatgacgcagatccccctgtctcagcccatacagatcgcacaggatcttcaacaactgcaacagcttcaacagcagaatctcaacctgcaacagtttgtgttggtgcatccaaccaccaatttgcagccagcgcagtttatcatctcacagacgccccagggccagcagggtctcctgcaagcgcaaaatcttctaacgcaactacctcagcaaagccaagccaacctcctacagtcgcagccaagcatcaccctcacctcccagccagcaaccccaacacgcacaatagcagcaaccccaattcagacacttccacagagccagtcaacaccaaagcgaattgatactcccagcttggaggagcccagtgaccttgaggagcttgagcagtttgccaagaccttcaaacaaagacgaatcaaacttggattcactcagggtgatgttgggctcgctatggggaaactatatggaaatgacttcagccaaactaccatctctcgatttgaagccttgaacctcagctttaagaacatgtgcaagttgaagccacttttagagaagtggctaaatgatgcagagaacctctcatctgattcgtccctctccagcccaagtgccctgaattctccaggaattgagggcttgagccgtaggaggaagaaacgcaccagcatagagaccaacatccgtgtggccttagagaagagtttcttggagaatcaaaagcctacctcggaagagatcactatgattgctgatcagctcaatatggaaaaagaggtgattcgtgtttggttctgtaaccgccgccagaaagaaaaaagaatcaacccaccaagcagtggtgggaccagcagctcacctattaaagcaattttccccagcccaacttcactggtggcgaccacaccaagccttgtgactagcagtgcagcaactaccctcacagtcagccctgtcctccctctgaccagtgctgctgtgacgaatctttcagttacaggcacttcagacaccacctccaacaacacagcaaccgtgatttccacagcgcctccagcttcctcagcagtcacgtccccctctctgagtccctccccttctgcctcagcctccacctccgaggcatccagtgccagtgagaccagcacaacacagaccacctccactcctttgtcctcccctcttgggaccagccaggtgatggtgacagcatcaggtttgcaaacagcagcagctgctgcccttcaaggagctgcacagttgccagcaaatgccagtcttgctgccatggcagctgctgcaggactaaacccaagcctgatggcaccctcacagtttgcggctggaggtgccttactcagtctgaatccagggaccctgagcggtgctctcagcccagctctaatgagcaacagtacactggcaactattcaagctcttgcttctggtggctctcttccaataacatcacttgatgcaactgggaacctggtatttgccaatgcgggaggagcccccaacatcgtgactgcccctctgttcctgaaccctcagaacctctctctgctcaccagcaaccctgttagcttggtctctgccgccgcagcatctgcagggaactctgcacctgtagccagccttcacgccacctccacctctgctgagtccatccagaactctctcttcacagtggcctctgccagcggggctgcgtccaccaccaccaccgcctccaaggcacagtgagctgggcagagctgggctgccagaagcctttttcactctgcagtgtgattggactgccagccaggttaataaactgaaaaatgtgattggcttcctctcgccgtgttgtgagggcaaaggagagaagggagaaaaaaaaaaaaaaaccacacacacccatacacacataccagaaaaagaaagaaaggatggagacggaacatttgcctaattttgtaataaaacactgtcttttcaggattgcttcatggattggagaactttctaaccaaaaattaaaaa

SEQ ID NO: 455676 - DNA, 2630 bp, Homo sapiens
ggctcactgcggcctcaaccttctgggttcaagcagtccttcccctctcagcccaagttgctgggactacaggcacacaaaccaatggtctggactttcagaagcagcctgtgcctgtaggaggagcaatctcaacagcccaggcgcaggctttccttggacatctccatcaggtccaactcgctggaacaagtttacaggctgctgctcagtctttaaatgtacagtctaaatctaatgaagaatcgggggattcgcagcagccaagccagccttcccagcagccttcagtgcaggcagccattccccagacccagcttatgctagctggaggacagataactgggcttactttgacgcctgcccagcaacagttactactccagcaggcacaggcacaggcacagctgctggctgctgcagtgcagcagcactccgccagccagcagcacagtgctgctggagccaccatctccgcctctgctgccacgcccatgacgcagatccccctgtctcagcccatacagatcgcacaggatcttcaacaactgcaacagcttcaacagcagaatctcaacctgcaacagtttgtgttggtgcatccaaccaccaatttgcagccagcgcagtttatcatctcacagacgccccagggccagcagggagggaagactgctataatagaaactacaaatttcgtctcctgcaagcgcaaaatcttctaacgcaactacctcagcaaagccaagccaacctcctacagtcgcagccaagcatcaccctcacctcccagatctggcccagtccagcctgaggtttctggagctggggtaacttatctgtaaccaccccatctaaagccagcaaccccaacacgcacaatagcagcaaccccaattcagacacttccacagagccagtcaacaccaaagcgaattgatactcccagcttggaggagcccagtgaccttgaggagcttgagcagtttgccaagaccttcaaacaaagacgaatcaaacttggattcactcagggtgatgttgggctcgctatggggaaactatatggaaatgacttcagccaaactaccatctctcgatttgaagccttgaacctcagctttaagaacatgtgcaagttgaagccacttttagagaagtggctaaatgatgcagagaacctctcatctgattcgtccctctccagcccaagtgccctgaattctccaggaattgagggcttgagccgtaggaggaagaaacgcaccagcatagagaccaacatccgtgtggccttagagaagagtttcttggagaatcaaaagcctacctcggaagagatcactatgattgctgatcagctcaatatggaaaaagaggtgattcgtgtttggttctgtaaccgccgccagaaagaaaaaagaatcaacccaccaagcagtggtgggaccagcagctcacctattaaagcaattttccccagcccaacttcactggtggcgaccacaccaagccttgtgactagcagtgcagcaactaccctcacagtcagccctgtcctccctctgaccagtgctgctgtgacgaatctttcagttacaggcacttcagacaccacctccaacaacacagcaaccgtgatttccacagcgcctccagcttcctcagcagtcacgtccccctctctgagtccctccccttctgcctcagcctccacctccgaggcatccagtgccagtgagaccagcacaacacagaccacctccactcctttgtcctcccctcttgggaccagccaggtgatggtgacagcatcaggtttgcaaacagcagcagctgctgcccttcaaggagctgcacagttgccagcaaatgccagtcttgctgccatggcagctgctgcaggactaaacccaagcctgatggcaccctcacagtttgcggctggaggtgccttactcagtctgaatccagggaccctgagcggtgctctcagcccagctctaatgagcaacagtacactggcaactattcaagctcttgcttctggtggctctcttccaataacatcacttgatgcaactgggaacctggtatttgccaatgcgggaggagcccccaacatcgtgactgcccctctgttcctgaaccctcagaacctctctctgctcaccagcaaccctgttagcttggtctctgccgccgcagcatctgcagggaactctgcacctgtagccagccttcacgccacctccacctctgctgagtccatccagaactctctcttcacagtggcctctgccagcggggctgcgtccaccaccaccaccgcctccaaggcacagtgagctgggcagagctgggctgccagaagcctttttcactctgcagtgtgattggactgccagccaggttaataaactgaaaaatgtgattggcttcctctcgccgtgttgtgagggcaaaggagagaagggagaaaaaaaaaaaaaaaccacacacacccatacacacataccagaaaaagaaagaaaggatggagacggaacatttgcctaattttgtaataaaacactgtcttttcaggattgcttcatggattggagaactttctaaccaaaaattaaaaa

SEQ ID NO: 455677 - DNA, 1475 bp, Homo sapiens
acaacacgcgcgacgcacacagcgaccgacgggcacacacaatgtgtctaggtacgaggcctgggtgttcacagcaatgctggactgcagtgactatgttctagactcaagaatgaacaatccgtcagaaaccagtaaaccatctatggagagtggagatggcaacacaggcacacaaaccaatggtctggactttcagaagcagcctgtgcctgtaggaggagcaatctcaacagcccaggcgcaggctttccttggacatctccatcaggtccaactcgctggaacaagtttacaggctgctgctcagtctttaaatgtacagtctaaatctaatgaagaatcgggggattcgcagcagccaagccagccttcccagcagccttcagtgcaggcagccattcctccctctgaccagtgctgctgtgacgaatctttcagttacaggcacttcagacaccacctccaacaacacagcaaccgtgatttccacagcgcctccagcttcctcagcagtcacgtccccctctctgagtccctccccttctgcctcagcctccacctccgaggcatccagtgccagtgagaccagcacaacacagaccacctccactcctttgtcctcccctcttgggaccagccaggtgatggtgacagcatcaggtttgcaaacagcagcagctgctgcccttcaaggagctgcacagttgccagcaaatgccagtcttgctgccatggcagctgctgcaggactaaacccaagcctgatggcaccctcacagtttgcggctggaggtgccttactcagtctgaatccagggaccctgagcggtgctctcagcccagctctaatgagcaacagtacactggcaactattcaagctcttgcttctggtggctctcttccaataacatcacttgatgcaactgggaacctggtatttgccaatgcgggaggagcccccaacatcgtgactgcccctctgttcctgaaccctcagaacctctctctgctcaccagcaaccctgttagcttggtctctgccgccgcagcatctgcagggaactctgcacctgtagccagccttcacgccacctccacctctgctgagtccatccagaactctctcttcacagtggcctctgccagcggggctgcgtccaccaccaccaccgcctccaaggcacagtgagctgggcagagctgggctgccagaagcctttttcactctgcagtgtgattggactgccagccaggttaataaactgaaaaatgtgattggcttcctctcgccgtgttgtgagggcaaaggagagaagggagaaaaaaaaaaaaaaaccacacacacccatacacacataccagaaaaagaaagaaaggatggagacggaacatttgcctaattttgtaataaaacactgtcttttcaggattgcttcatggattggagaactttctaaccaaaaattaaaaa

SEQ ID NO: 455678 - DNA, 1318 bp, Homo sapiens
agatggggaaaaaaatgtctttaaagcagtaatctctttgaagtgggctgttttgtgatcatacaaggactttgattatagttgagtttatgtttcttaacaccctgggaagggcagtagtcatacctttgtttccagatgaagacccaaaataccaggtcactaattaccttagtgacggggccaggaagaaagcctagaattcttgactcttattttccccattaaactctctcaactgcctacttcctaattctcaagcatagataagagatgtaataggagtctcaattttatactgttattgtcacacattataagaattatcttgtaaatatatctttttctctagaatgtttctttcattttggaaagaaagagaaataagtctttcaaagaagggtcaaaatgactataaaagttttacattttgtgctgatcataacctcgtttgtatgagtaagcatccaggaaagcagtaactgagaagcacaaaccatagaagagtaaagaaaaataaatatttccacctatttccccagctggattttcgttttgtaagttccttttggtgtgttgtcaaaatgagacctgcgtctgcatggtaataaagtgactcctcttttggacttgcagaggtgccttactcagtctgaatccagggaccctgagcggtgctctcagcccagctctaatgagcaacagtacactggcaactattcaagctcttgcttctggtggctctcttccaataacatcacttgatgcaactgggaacctggtatttgccaatgcgggaggagcccccaacatcgtgactgcccctctgttcctgaaccctcagaacctctctctgctcaccagcaaccctgttagcttggtctctgccgccgcagcatctgcagggaactctgcacctgtagccagccttcacgccacctccacctctgctgagtccatccagaactctctcttcacagtggcctctgccagcggggctgcgtccaccaccaccaccgcctccaaggcacagtgagctgggcagagctgggctgccagaagcctttttcactctgcagtgtgattggactgccagccaggttaataaactgaaaaatgtgattggcttcctctcgccgtgttgtgagggcaaaggagagaagggagaaaaaaaaaaaaaaaccacacacacccatacacacataccagaaaaagaaagaaaggatggagacggaacatttgcctaattttgtaataaaacactgtcttttcaggattgcttcatggattggagaactttctaaccaaaaattaaaaa

SEQ ID NO: 455679 - DNA, 909 bp, Homo sapiens
acaacacgcgcgacgcacacagcgaccgacgggcacacacaatgtgtctaggtacgaggcctgggtgttcacagcaatgctggactgcagtgactatgttctagactcaagaatgaacaatccgtcagaaaccagtaaaccatctatggagagtggagatggcaacacaggcacacaaaccaatggtctggactttcagaagcagcctgtgcctgtaggaggagcaatctcaacagcccaggcgcaggctttccttggacatctccatcaggtccaactcgctggaacaagtttacaggctgctgctcagtctttaaatgtacagtctaaatctaatgaagaatcgggggattcgcagcagccaagccagccttcccagcagccttcagtgcaggcagccattccccagacccagcttatgctagctggaggacagataactgggcttactttgacgcctgcccagcaacagttactactccagcaggcacaggcacaggcacagctgctggctgctgcagtgcagcagcactccgccagccagcagcacagtgctgctggagccaccatctccgcctctgctgccacgcccatgacgcagatccccctgtctcagcccatacagatcgcacaggatcttcaacaactgcaacagcttcaacagcagaatctcaacctgcaacagtttgtgttggtgcatccaaccaccaatttgcagccagcgcagtttatcatctcacagacgccccagggccagcagggtctctgcaagcgcaaatcttctaacgcaataactcagaaagcaagccaacttctaaagtcggcagcaaggattaccttaactccagcaagaaaccaaaagaaatagggtacccaattgacttcccgagcagcaccaaggatggtccc

SEQ ID NO: 455680 - DNA, 2596 bp, Homo sapiens
aaaaatattcaaaatggcggacggaggagcagcgagtcaagatgagagttcagccgcggcggcagcagcagcagactcaagaatgaacaatccgtcagaaaccagtaaaccatctatggagagtggagatggcaacacaggcacacaaaccaatggtctggactttcagaagcagcctgtgcctgtaggaggagcaatctcaacagcccaggcgcaggctttccttggacatctccatcaggtccaactcgctggaacaagtttacaggctgctgctcagtctttaaatgtacagtctaaatctaatgaagaatcgggggattcgcagcagccaagccagccttcccagcagccttcagtgcaggcagccattccccagacccagcttatgctagctggaggacagataactgggcttactttgacgcctgcccagcaacagttactactccagcaggcacaggcacaggcacagctgctggctgctgcagtgcagcagcactccgccagccagcagcacagtgctgctggagccaccatctccgcctctgctgccacgcccatgacgcagatccccctgtctcagcccatacagatcgcacaggatcttcaacaactgcaacagcttcaacagcagaatctcaacctgcaacagtttgtgttggtgcatccaaccaccaatttgcagccagcgcagtttatcatctcacagacgccccagggccagcagggtctcctgcaagcgcaaaatcttctaacgcaactacctcagcaaagccaagccaacctcctacagtcgcagccaagcatcaccctcacctcccagccagcaaccccaacacgcacaatagcagcaaccccaattcagacacttccacagagccagtcaacaccaaagcgaattgatactcccagcttggaggagcccagtgaccttgaggagcttgagcagtttgccaagaccttcaaacaaagacgaatcaaacttggattcactcagggtgatgttgggctcgctatggggaaactatatggaaatgacttcagccaaactaccatctctcgatttgaagccttgaacctcagctttaagaacatgtgcaagttgaagccacttttagagaagtggctaaatgatgcagagaacctctcatctgattcgtccctctccagcccaagtgccctgaattctccaggaattgagggcttgagccgtaggaggaagaaacgcaccagcatagagaccaacatccgtgtggccttagagaagagtttcttggagaatcaaaagcctacctcggaagagatcactatgattgctgatcagctcaatatggaaaaagaggtgattcgtgtttggttctgtaaccgccgccagaaagaaaaaagaatcaacccaccaagcagtggtgggaccagcagctcacctattaaagcaattttccccagcccaacttcactggtggcgaccacaccaagccttgtgactagcagtgcagcaactaccctcacagtcagccctgtcctccctctgaccagtgctgctgtgacgaatctttcagttacaggcacttcagacaccacctccaacaacacagcaaccgtgatttccacagcgcctccagcttcctcagcagtcacgtccccctctctgagtccctccccttctgcctcagcctccacctccgaggcatccagtgccagtgagaccagcacaacacagaccacctccactcctttgtcctcccctcttgggaccagccaggtgatggtgacagcatcaggtttgcaaacagcagcagctgctgcccttcaaggagctgcacagttgccagcaaatgccagtcttgctgccatggcagctgctgcaggactaaacccaagcctgatggcaccctcacagtttgcggctggaggtgccttactcagtctgaatccagggaccctgagcggtgctctcagcccagctctaatgagcaacagtacactggcaactattcaagctcttgcttctggtggctctcttccaataacatcacttgatgcaactgggaacctggtatttgccaatgcgggaggagcccccaacatcgtgactgcccctctgttcctgaaccctcagaacctctctctgctcaccagcaaccctgttagcttggtctctgccgccgcagcatctgcagggaactctgcacctgtagccagccttcacgccacctccacctctgctgagtccatccagaactctctcttcacagtggcctctgccagcggggctgcgtccaccaccaccaccgcctccaaggcacagtgagctgggcagagctgggctgccagaagcctttttcactctgcagtgtgattggactgccagccaggttaataaactgaaaaatgtgattggcttcctctcgccgtgttgtgagggcaaaggagagaagggagaaaaaaaaaaaaaaaccacacacacccatacacacataccagaaaaagaaagaaaggatggagacggaacatttgcctaattttgtaataaaacactgtcttttcaggattgcttcatggattggagaactttctaaccaaaaattaaaaa

SEQ ID NO: 455681 - DNA, 2218 bp, Homo sapiens
gaagtttccttattcagttgaagattgctatggtgtaacagaagttgtattttgcttttccccttaatccactttccaccctacgcaacccccctcttttcgcttaagaacatactgtagatttgttagaaatagtagtaccttctttccccaccccaaactgctacctgtttcttccttgtttggactctctgctcctctagaagatttcacagcaatgctggactgcagtgactatgttctagactcaagaatgaacaatccgtcagaaaccagtaaaccatctatggagagtggagatggcaacacaggcacacaaaccaatggtctggactttcagaagcagcctgtgcctgtaggaggagcaatctcaacagcccaggcgcaggctttccttggacatctccatcaggtccaactcgctggaacaagtttacaggctgctgctcagtctttaaatgtacagtctaaatctaatgaagaatcgggggattcgcagcagccaagccagccttcccagcagccttcagtgcaggcagccattccccagacccagcttatgctagctggaggacagataactgggcttactttgacgcctgcccagcaacagttactactccagcaggcacaggcacaggcacagctgctggctgctgcagtgcagcagcactccgccagccagcagcacagtgctgctggagccaccatctccgcctctgctgccacgcccatgacgcagatccccctgtctcagcccatacagatcgcacaggatcttcaacaactgcaacagcttcaacagcagaatctcaacctgcaacagtttgtgttggtgcatccaaccaccaatttgcagccagcgcagtttatcatctcacagacgccccagggccagcagggtctcctgcaagcgcaaaatcttctaacgcaactacctcagcaaagccaagccaacctcctacagtcgcagccaagcatcaccctcacctcccagccagcaaccccaacacgcacaatagcagcaaccccaattcagacacttccacagagccagtcaacaccaaagcgaattgatactcccagcttggaggagcccagtgaccttgaggagcttgagcagtttgccaagaccttcaaacaaagacgaatcaaacttggattcactcagggtgatgttgggctcgctatggggaaactatatggaaatgacttcagccaaactaccatctctcgatttgaagccttgaacctcagctttaagaacatgtgcaagttgaagccacttttagagaagtggctaaatgatgcagagaacctctcatctgattcgtccctctccagcccaagtgccctgaattctccaggaattgagggcttgagccgtaggaggaagaaacgcaccagcatagagaccaacatccgtgtggccttagagaagagtttcttggagaatcaaaagcctacctcggaagagatcactatgattgctgatcagctcaatatggaaaaagaggtgattcgtgtttggttctgtaaccgccgccagaaagaaaaaagaatcaacccaccaagcagtggtgggaccagcagctcacctattaaagcaattttccccagcccaacttcactggtggcgaccacaccaagccttgtgactagcagtgcagcaactaccctcacagtcagccctgtcctccctctgaccagtgctgctgtgacgaatctttcagttacaggcacttcagacaccacctccaacaacacagcaaccgtgatttccacagcgcctccagcttcctcagcagtcacgtccccctctctgagtccctccccttctgcctcagcctccacctccgaggcatccagtgccagtgagaccagcacaacacagaccacctccactcctttgtcctcccctcttgggaccagccaggtgatggtgacagcatcaggtttgcaaacagcagcagctgctgcccttcaaggagctgcacagttgccagcaaatgccagtcttgctgccatggcagctgctgcaggactaaacccaagcctgatggcaccctcacagtttgcggctggaggtgccttactcagtctgaatccagggaccctgagcggtgctctcagcccagctctaatgagcaacagtacactggcaactattcaaggattgcttcatggattggagaactttctaaccaaaaattaaaaa

SEQ ID NO: 455682 - DNA, 1879 bp, Homo sapiens
gaagtttccttattcagttgaagattgctatggtgtaacagaagttgtattttgcttttccccttaatccactttccaccctacgcaacccccctcttttcgcttaagaacatactgtagatttgttagaaatagtagtaccttctttccccaccccaaactgctacctgtttcttccttgtttggactctctgctcctctagaagatttcacagcaatgctggactgcagtgactatgttctagactcaagaatgaacaatccgtcagaaaccagtaaaccatctatggagagtggagatggcaacacaggcacacaaaccaatggtctggactttcagaagcagcctgtgcctgtaggaggagcaatctcaacagcccaggcgcaggctttccttggacatctccatcaggtccaactcgctggaacaagtttacaggctgctgctcagtctttaaatgtacagtctaaatctaatgaagaatcgggggattcgcagcagccaagccagccttcccagcagccttcagtgcaggcagccattccccagacccagcttatgctagctggaggacagataactgggcttactttgacgcctgcccagcaacagttactactccagcaggcacaggcacaggcacagctgctggctgctgcagtgcagcagcactccgccagccagcagcacagtgctgctggagccaccatctccgcctctgctgccacgcccatgacgcagatccccctgtctcagcccatacagatcgcacaggatcttcaacaactgcaacagcttcaacagcagaatctcaacctgcaacagtttgtgttggtgcatccaaccaccaatttgcagccagcgcagtttatcatctcacagacgccccagggccagcagggtctcctgcaagcgcaaaatcttctaacgcaactacctcagcaaagccaagccaacctcctacagtcgcagccaagcatcaccctcacctcccagccagcaaccccaacacgcacaatagcagcaaccccaattcagacacttccacagagccagtcaacaccaaagcgaattgatactcccagcttggaggagcccagtgaccttgaggagcttgagcagtttgccaagaccttcaaacaaagacgaatcaaacttggattcactcagggtgatgttgggctcgctatggggaaactatatggaaatgacttcagccaaactaccatctctcgatttgaagccttgaacctcagctttaagaacatgtgcaagttgaagccacttttagagaagtggctaaatgatgcagagaacctctcatctgattcgtccctctccagcccaagtgccctgaattctccaggaattgagggcttgagccgtaggaggaagaaacgcaccagcatagagaccaacatccgtgtggccttagagaagagtttcttggagaatcaaaagcctacctcggaagagatcactatgattgctgatcagctcaatatggaaaaagaggtgattcgtgtttggttctgtaaccgccgccagaaagaaaaaagaatcaacccaccaagcagtggtgggaccagcagctcacctattaaagcaattttccccagcccaacttcactggtggcgaccacaccaagccttgtgactagcagtgcagcaactaccctcacagtcagccctgtcctccctctgaccagtgctgctgtgacgaatctttcagttacaggcacttcagacaccacctccaacaacacataggaatgctggaccagggtaccagattttttcaacaaagggggtgaagtgtcctactaaaaagaataaatgttggcagtgaattaaccaatttttcaaataaaaaaaaaa

SEQ ID NO: 455683 - DNA, 2291 bp, Homo sapiens
acggcaggtacaggctgggtggaatcgcgtaagaaggtgtccctcagcatttactagtagccatgctatgaaagagtgtaagtgaaagtagtaacagggtattatttgatgcctgaccaagaattagttatactcgagaagatcatggcagcggagcgtcacctatggtgaggtggtagtaaattgcacgataagtcaggtaaaccatgaataaaggaatcgttgaagccaccatctccgcctctgctgccacgcccatgacgcagatccccctgtctcagcccatacagatcgcacaggatcttcaacaactgcaacagcttcaacagcagaatctcaacctgcaacagtttgtgttggtgcatccaaccaccaatttgcagccagcgcagtttatcatctcacagacgccccagggccagcagggtctcctgcaagcgcaaaatcttctaacgcaactacctcagcaaagccaagccaacctcctacagtcgcagccaagcatcaccctcacctcccagccagcaaccccaacacgcacaatagcagcaaccccaattcagacacttccacagagccagtcaacaccaaagcgaattgatactcccagcttggaggagcccagtgaccttgaggagcttgagcagtttgccaagaccttcaaacaaagacgaatcaaacttggattcactcagggtgatgttgggctcgctatggggaaactatatggaaatgacttcagccaaactaccatctctcgatttgaagccttgaacctcagctttaagaacatgtgcaagttgaagccacttttagagaagtggctaaatgatgcagagaacctctcatctgattcgtccctctccagcccaagtgccctgaattctccaggaattgagggcttgagccgtaggaggaagaaacgcaccagcatagagaccaacatccgtgtggccttagagaagagtttcttggagaatcaaaagcctacctcggaagagatcactatgattgctgatcagctcaatatggaaaaagaggtgattcgtgtttggttctgtaaccgccgccagaaagaaaaaagaatcaacccaccaagcagtggtgggaccagcagctcacctattaaagcaattttccccagcccaacttcactggtggcgaccacaccaagccttgtgactagcagtgcagcaactaccctcacagtcagccctgtcctccctctgaccagtgctgctgtgacgaatctttcagttacaggcacttcagacaccacctccaacaacacagcaaccgtgatttccacagcgcctccagcttcctcagcagtcacgtccccctctctgagtccctccccttctgcctcagcctccacctccgaggcatccagtgccagtgagaccagcacaacacagaccacctccactcctttgtcctcccctcttgggaccagccaggtgatggtgacagcatcaggtttgcaaacagcagcagctgctgcccttcaaggagctgcacagttgccagcaaatgccagtcttgctgccatggcagctgctgcaggactaaacccaagcctgatggcaccctcacagtttgcggctggaggtgccttactcagtctgaatccagggaccctgagcggtgctctcagcccagctctaatgagcaacagtacactggcaactattcaagctcttgcttctggtggctctcttccaataacatcacttgatgcaactgggaacctggtatttgccaatgcgggaggagcccccaacatcgtgactgcccctctgttcctgaaccctcagaacctctctctgctcaccagcaaccctgttagcttggtctctgccgccgcagcatctgcagggaactctgcacctgtagccagccttcacgccacctccacctctgctgagtccatccagaactctctcttcacagtggcctctgccagcggggctgcgtccaccaccaccaccgcctccaaggcacagtgagctgggcagagctgggctgccagaagcctttttcactctgcagtgtgattggactgccagccaggttaataaactgaaaaatgtgattggcttcctctcgccgtgttgtgagggcaaaggagagaagggagaaaaaaaaaaaaaaaccacacacacccatacacacataccagaaaaagaaagaaaggatggagacggaacatttgcctaattttgtaataaaacactgtcttttcaggattgcttcatggattggagaactttctaaccaaaaattaaaaa

SEQ ID NO: 455684 - DNA, 1561 bp, Homo sapiens
gaagtttccttattcagttgaagattgctatggtgtaacagaagttgtattttgcttttccccttaatccactttccaccctacgcaacccccctcttttcgcttaagaacatactgtagatttgttagaaatagtagtaccttctttccccaccccaaactgctacctgtttcttccttgtttggactctctgctcctctagaagatttcacagcaatgctggactgcagtgactatgttctagactcaagaatgaacaatccgtcagaaaccagtaaaccatctatggagagtggagatggcaacacaggcacacaaaccaatggtctggactttcagaagcagcctgtgcctgtaggaggagcaatctcaacagcccaggcgcaggctttccttggacatctccatcaggtccaactcgctggaacaagtttacaggctgctgctcagtctttaaatgtacagtctaaatctaatgaagaatcgggggattcgcagcagccaagccagccttcccagcagccttcagtgcaggcagccattccccagacccagcttatgctagctggaggacagataactgggcttactttgacgcctgcccagcaacagttactactccagcaggcacaggcacaggcacagctgctggctgctgcagtgcagcagcactccgccagccagcagcacagtgctgctggagccaccatctccgcctctgctgccacgcccatgacgcagatccccctgtctcagcccatacagatcgcacaggatcttcaacaactgcaacagcttcaacagcagaatctcaacctgcaacagtttgtgttggtgcatccaaccaccaatttgcagccagcgcagtttatcatctcacagacgccccagggccagcagggtctcctgcaagcgcaaaatcttctaacgcaactacctcagcaaagccaagccaacctcctacagtcgcagccaagcatcaccctcacctcccagccagcaaccccaacacgcacaatagcagcaaccccaattcagacacttccacagagccagtcaacaccaaagcgaattgatactcccagcttggaggagcccagtgaccttgaggagcttgagcagtttgccaagaccttcaaacaaagacgaatcaaacttggattcactcagcttcacgccacctccacctctgctgagtccatccagaactctctcttcacagtggcctctgccagcggggctgcgtccaccaccaccaccgcctccaaggcacagtgagctgggcagagctgggctgccagaagcctttttcactctgcagtgtgattggactgccagccaggttaataaactgaaaaatgtgattggcttcctctcgccgtgttgtgagggcaaaggagagaagggagaaaaaaaaaaaaaaaccacacacacccatacacacataccagaaaaagaaagaaaggatggagacggaacatttgcctaattttgtaataaaacactgtcttttcaggattgcttcatggattggagaactttctaaccaaaaattaaaaa

SEQ ID NO: 455685 - DNA, 532 bp, Homo sapiens
ttattggcagtccaggttcccgttgcatcacgtgatgttattggaagagagccaccagaacctctctctgctcaccagcaaccctgttagcttggtctctgccgccgcagcatctgcagggaactctgcacctgtagccagccttcacgccacctccacctctgctgagtccatccagaactctctcttcacagtggcctctgccagcggggctgcgtccaccaccaccaccgcctccaaggcacagtgagctgggcagagctgggctgccagaagcctttttcactctgcagtgtgattggactgccagccaggttaataaactgaaaaatgtgattggcttcctctcgccgtgttgtgagggcaaaggagagaagggagaaaaaaaaaaaaaaaccacacacacccatacacacataccagaaaaagaaagaaaggatggagacggaacatttgcctaattttgtaataaaacactgtcttttcaggattgcttcatggattggagaactttctaaccaaaaattaaaaa

SEQ ID NO: 455686 - DNA, 2620 bp, Homo sapiens
acttgtcatggcgactgtccagctttgtgccaggagcctcgcaggggttgatgggattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccgcgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttctttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgcca

SEQ ID NO: 455687 - DNA, 302 bp, Homo sapiens
ttgggaggccgaggtgggtggatcacctgaggtcaggagttcaacaccagcctggccaacatggtgaaaccccatctctactaaaaatacaaaattagccgggcgtagtggcgggcgcctgtaatcccacctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgcca

SEQ ID NO: 455688 - DNA, 2065 bp, Homo sapiens
gtgttcagagtatcccgatggccgtcggggcgtcttgcgatcgtgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttctttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgcca

SEQ ID NO: 455689 - DNA, 1409 bp, Homo sapiens
acttgtcatggcgactgtccagctttgtgccaggagcctcgcaggggttgatgggattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccgcgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacatgaagtccacaaagggtcagtctaggtaccgagcatgaattgtatgtacatag

SEQ ID NO: 455690 - DNA, 1725 bp, Homo sapiens
ccctcacaatcaattgcttaaaatgtttctagaaattcctggtatcacttaaaaatagcttccgttttgtgctctagaaggttattgttgctgagtgccagcagctacattttagaattaaggcaggtttggccagattggtgtgcagtgtggagatgaagaatcccacccctgcaagacggagccacataagaagccagcctgggcaacaagagtgaaactccgtctcaaaaaagataaataaagtaaaatggggtaagggaagattacgagactaatacacactaatactctgaggtgctcagtaaacatatttgcatggggtgtggccaccatcttgatttgaattcccgttgtcccagccttaggcccttcaaagcattggtcagggaaaaggggcacagaccctctcactcatgtgatgtcatctctcctccctgcttctgtctcctacagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttctttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgcca

SEQ ID NO: 455691 - DNA, 2507 bp, Homo sapiens
aatgcagggctgaggagtgtccgaagagaatgggcaggtgagcggtgagacagttgttcttccagaagctttgcagtgaaaggaatcaaagaaatggagccgtgtatcagcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccgcgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttctttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgcca

SEQ ID NO: 455692 - DNA, 1304 bp, Homo sapiens
acttgtcatggcgactgtccagctttgtgccaggagcctcgcaggggttgatgggattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccgcgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtcagcgcggttatatgagtcgagacgttgttaagccccggacagtgacg

SEQ ID NO: 455693 - DNA, 2822 bp, Homo sapiens
cgtgggcaaaggtacttaaagccctgaccgtcgttctccgtcctcctctgggtaccaactctattgcgcagctcgctgccgtgcgtttaacccaggcgaggaggaggaggagaaaattcccccagattcgggcagactgctttccagacacctccggcccacacagccgttcaccccccgtcttttcagtcctggaaaaggaattcgggctttcattgtctaacgtcgacagtctatatttctgctcttcagtctgtccttaggatgaagctctaactgaactgaagtaaggagaaacagccttgaatctttggagggtctgtcttccttttgggctctgtgcaactgcagctacagtggaaaaaagcaaactgctcttgatcccaggccctgcctaagcctcagcagaacttgtaagcctaaactgaagagcctcacccggacgagcaggcatcccttaaccttaagcaatccagttccacgccctggatcagtgaataaccccagctgcaccatgagccgcgttcgggatgctggctgtgtagcggcggggatagtgataggggctggtgcctggtactgtgtctacaaatacaccagggggagagaccagaccaagaagagaatggccaagcccaaaaaccgggctgtggctgggactggagccagggctagagctgggctaagagccggattcacaatcgaccttgggtcaggattcagtcccccaaccccagtccgtgctgaagcagaggacagggcccaggatgaagcctctgctctggacacagttggagctgaggcagtggccccagctgcatccagcgctgaggctcagagtggggcaggcagtcaggcccaagaggcagatggagccggggttgggcctaaggccgaatcagtagttggggctgcaatggcttctgcaatagcaccacctcccggggtgacagaggcccttggggctgcagaagcccctgcaatggcaggggctcccaaagtggcagaagctcccagagaagcggagacttccagggcagcggtgcctcctgggacagtggtgcctaccgaagcggcagcacccactgaggtgaccgagggtcctggggtagcagcacctaccaaggtagctgaagctcccggggtggcatcgcctaccgaggcagctgaggctcctgtgcccgcaacgcctactggggctgcagcacctactggggctgcagagtctcctggaacttctggttcccctagaacagcggtggttcctggaacatcagctgccaagaaagcaacccctggggctcacactggggctataccgaaagccacatcagcgactggagcggtacccaaaggtggaggcaagggtgtaaccaggtcccggaatgggggcaagggcaagggcaagaaaagcaaagttgaagtagacgaactggggatgggcttccgtcctggagatggggctgcagcagctgctgcagcctctgctaatggcggacaggctttcctggcagaggtccctgattctgaggaaggggagtccgggtggactgacacagagtcagattcagactctgagcccgagacccagcgcagagggaggggaagaagacccgttgccatgcagaagcgcccctttccttatgaaattgatgagattctgggtgtccgcgatctcaggaaggtccttgccttgcttcagaaatctgatgatcctttcatccaacaggtagctttgctcactctgagcaacaatgccaattattcatgcaatcaagagacaatccgcaaattgggaggcctcccaattattgcaaacatgatcaacaaaactgatccacacattaaggaaaaagccttaatggccatgaataacctgagtgagaattatgaaaatcagggccggcttcaggtgtacatgaataaagtgatggatgatatcatggcctctaacctgaactcagcagttcaagtagttggactaaaatttctaacaaacatgactattactaatgactaccaacacctgcttgtcaattccattgcaaactttttccgtttgctatctcagggaggtggaaaaatcaaggttgagattttgaaaatcctttcgaattttgctgaaaatccagatatgttgaagaaacttctcagtacccaagtgccagcatcatttagttccctctataattcttacgtggaatcagaaatccttattaatgcccttactctatttgagattatctatgacaatctcagagcagaagtgtttaactatagagaattcaataaaggttcccttttttacttatgcactacatctggagtgtgtgttaagaaaattagagccttagcaaatcaccatgacctcttagtgaaagtgaaagttataaaactagtgaacaaattctgattggttatgtaccgtcaaaagacttgaagaaatttcatgattttgcagtgtggaagcgttgaaaattgaaagttactgcttttccacttgctcatatagtaaagggatcctttcagctgccagtgttgaataatgtatcatccagagtgatgttatctgtgacagtcaccagctttaagctgaaccattttatgaataccaaataaatagacctcttgtactgaaaacatatttgtgactttaatcgtgctgcttggatagaaatatttttactggttcttctgaattgacagtaaacctgtccattatgaatggcctactgttctattatttgttttgacttgaatttatccaccaaagacttcatttgtgtatcatcaataaagttgtatgtttcaactgacaaaaa

SEQ ID NO: 455694 - DNA, 2861 bp, Homo sapiens
cgtgggcaaaggtacttaaagccctgaccgtcgttctccgtcctcctctgggtaccaactctattgcgcagctcgctgccgtgcgtttaacccaggcgaggaggaggaggagaaaattcccccagattcgggcaggcccgcaccccacattccgtcctgttttgagaggaggagggaagagaaataaacgtggcagcgcatagaaggccagcagggagactgctttccagacacctccggcccacacagccgttcaccccccgtcttttcagtcctggaaaaggaattcggtctgtccttaggatgaagctctaactgaactgaagtaaggagaaacagccttgaatctttggagggtctgtcttccttttgggctctgtgcaactgcagctacagtggaaaaaagcaaactgctcttgatcccaggccctgcctaagcctcagcagaacttgtaagcctaaactgaagagcctcacccggacgagcaggcatcccttaaccttaagcaatccagttccacgccctggatcagtgaataaccccagctgcaccatgagccgcgttcgggatgctggctgtgtagcggcggggatagtgataggggctggtgcctggtactgtgtctacaaatacaccagggggagagaccagaccaagaagagaatggccaagcccaaaaaccgggctgtggctgggactggagccagggctagagctgggctaagagccggattcacaatcgaccttgggtcaggattcagtcccccaaccccagtccgtgctgaagcagaggacagggcccaggatgaagcctctgctctggacacagttggagctgaggcagtggccccagctgcatccagcgctgaggctcagagtggggcaggcagtcaggcccaagaggcagatggagccggggttgggcctaaggccgaatcagtagttggggctgcaatggcttctgcaatagcaccacctcccggggtgacagaggcccttggggctgcagaagcccctgcaatggcaggggctcccaaagtggcagaagctcccagagaagcggagacttccagggcagcggtgcctcctgggacagtggtgcctaccgaagcggcagcacccactgaggtgaccgagggtcctggggtagcagcacctaccaaggtagctgaagctcccggggtggcatcgcctaccgaggcagctgaggctcctgtgcccgcaacgcctactggggctgcagcacctactggggctgcagagtctcctggaacttctggttcccctagaacagcggtggttcctggaacatcagctgccaagaaagcaacccctggggctcacactggggctataccgaaagccacatcagcgactggagcggtacccaaaggtggaggcaagggtgtaaccaggtcccggaatgggggcaagggcaagggcaagaaaagcaaagttgaagtagacgaactggggatgggcttccgtcctggagatggggctgcagcagctgctgcagcctctgctaatggcggacaggctttcctggcagaggtccctgattctgaggaaggggagtccgggtggactgacacagagtcagattcagactctgagcccgagacccagcgcagagggaggggaagaagacccgttgccatgcagaagcgcccctttccttatgaaattgatgagattctgggtgtccgcgatctcaggaaggtccttgccttgcttcagaaatctgatgatcctttcatccaacaggtagctttgctcactctgagcaacaatgccaattattcatgcaatcaagagacaatccgcaaattgggaggcctcccaattattgcaaacatgatcaacaaaactgatccacacattaaggaaaaagccttaatggccatgaataacctgagtgagaattatgaaaatcagggccggcttcaggtgtacatgaataaagtgatggatgatatcatggcctctaacctgaactcagcagttcaagtagttggactaaaatttctaacaaacatgactattactaatgactaccaacacctgcttgtcaattccattgcaaactttttccgtttgctatctcagggaggtggaaaaatcaaggttgagattttgaaaatcctttcgaattttgctgaaaatccagatatgttgaagaaacttctcagtacccaagtgccagcatcatttagttccctctataattcttacgtggaatcagaaatccttattaatgcccttactctatttgagattatctatgacaatctcagagcagaagtgtttaactatagagaattcaataaaggttcccttttttacttatgcactacatctggagtgtgtgttaagaaaattagagccttagcaaatcaccatgacctcttagtgaaagtgaaagttataaaactagtgaacaaattctgattggttatgtaccgtcaaaagacttgaagaaatttcatgattttgcagtgtggaagcgttgaaaattgaaagttactgcttttccacttgctcatatagtaaagggatcctttcagctgccagtgttgaataatgtatcatccagagtgatgttatctgtgacagtcaccagctttaagctgaaccattttatgaataccaaataaatagacctcttgtactgaaaacatatttgtgactttaatcgtgctgcttggatagaaatatttttactggttcttctgaattgacagtaaacctgtccattatgaatggcctactgttctattatttgttttgacttgaatttatccaccaaagacttcatttgtgtatcatcaataaagttgtatgtttcaactgacaaaaa

SEQ ID NO: 455695 - DNA, 2807 bp, Homo sapiens
cgtgggcaaaggtacttaaagccctgaccgtcgttctccgtcctcctctgggtaccaactctattgcgcagctcgctgccgtgcgtttaacccaggcgaggaggaggaggagaaaattcccccagattcgggcaggcccgcaccccacattccgtcctgttttgagaggaggagggaagagaaataaacgtggcagcgcatagaaggccagcagggagactgctttccagacacctccggcccacacagccgttcaccccccgtcttttcagtcctggaaaaggaattcggtctgtccttaggatgaagctctaactgaactgaagtaaggagaaacagccttgaatctttggagggtctgtcttccttttgggctctgtgcaactgcagctacagtggaaaaaagcaaactgctcttgatcccaggccctgcctaagcctcagcagaacttgtaagcctaaactgaagagcctcacccggacgagcaggcatcccttaaccttaagcaatccagttccacgccctggatcagtgaataaccccagctgcaccatgagccgcgttcgggatgctggctgtgtagcggcggggatagtgataggggctggtgcctggtactgtgtctacaaatacaccagggggagagaccagaccaagaagagaatggccaagcccaaaaaccgggctgtggctgggactggagccagggctagagctgggctaagagccggattcacaatcgaccttgggtcaggattcagtcccccaaccccagtccgtgctgaagcagaggacagggcccaggatgaagcctctgctctggacacagttggagctgaggcagtggccccagctgcatccagcgctgaggctcagagtggggcaggcagtcaggcccaagaggcagatggagccggggttgggcctaaggccgaatcagtagttggggctgcaatggcttctgcaatagcaccacctcccggggtgacagaggcccttggggctgcagaagcccctgcaatggcaggggctcccaaagtggcagaagctcccagagaagcggagacttccagggcagcggtgcctcctgggacagtggtgcctaccgaagcggcagcacccactgaggtgaccgagggtcctggggtagcagcacctaccaaggtagctgaagctcccggggtggcatcgcctaccgaggcagctgaggctcctgtgcccgcaacgcctactggggctgcagcacctactggggctgcagagtctcctggaacttctggttcccctagaacagcggtggttcctggaacatcagctgccaagaaagcaacccctggggctcacactggggctataccgaaagccacatcagcgactggagcggtacccaaaggtggaggcaagggtgtaaccaggtcccggaatgggggcaagggcaagggcaaggctgcagcagctgctgcagcctctgctaatggcggacaggctttcctggcagaggtccctgattctgaggaaggggagtccgggtggactgacacagagtcagattcagactctgagcccgagacccagcgcagagggaggggaagaagacccgttgccatgcagaagcgcccctttccttatgaaattgatgagattctgggtgtccgcgatctcaggaaggtccttgccttgcttcagaaatctgatgatcctttcatccaacaggtagctttgctcactctgagcaacaatgccaattattcatgcaatcaagagacaatccgcaaattgggaggcctcccaattattgcaaacatgatcaacaaaactgatccacacattaaggaaaaagccttaatggccatgaataacctgagtgagaattatgaaaatcagggccggcttcaggtgtacatgaataaagtgatggatgatatcatggcctctaacctgaactcagcagttcaagtagttggactaaaatttctaacaaacatgactattactaatgactaccaacacctgcttgtcaattccattgcaaactttttccgtttgctatctcagggaggtggaaaaatcaaggttgagattttgaaaatcctttcgaattttgctgaaaatccagatatgttgaagaaacttctcagtacccaagtgccagcatcatttagttccctctataattcttacgtggaatcagaaatccttattaatgcccttactctatttgagattatctatgacaatctcagagcagaagtgtttaactatagagaattcaataaaggttcccttttttacttatgcactacatctggagtgtgtgttaagaaaattagagccttagcaaatcaccatgacctcttagtgaaagtgaaagttataaaactagtgaacaaattctgattggttatgtaccgtcaaaagacttgaagaaatttcatgattttgcagtgtggaagcgttgaaaattgaaagttactgcttttccacttgctcatatagtaaagggatcctttcagctgccagtgttgaataatgtatcatccagagtgatgttatctgtgacagtcaccagctttaagctgaaccattttatgaataccaaataaatagacctcttgtactgaaaacatatttgtgactttaatcgtgctgcttggatagaaatatttttactggttcttctgaattgacagtaaacctgtccattatgaatggcctactgttctattatttgttttgacttgaatttatccaccaaagacttcatttgtgtatcatcaataaagttgtatgtttcaactgacaaaaa

SEQ ID NO: 455696 - DNA, 2778 bp, Homo sapiens
cgtgggcaaaggtacttaaagccctgaccgtcgttctccgtcctcctctgggtaccaactctattgcgcagctcgctgccgtgcgtttaacccaggcgaggaggaggaggagaaaattcccccagattcgggcagactgctttccagacacctccggcccacacagccgttcaccccccgtcttttcagtcctggaaaaggaattcggtctgtccttaggatgaagctctaactgaactgaagtaaggagaaacagccttgaatctttggagggtctgtcttccttttgggctctgtgcaactgcagctacagtggaaaaaagcaaactgctcttgatcccaggccctgcctaagcctcagcagaacttgtaagcctaaactgaagagcctcacccggacgagcaggcatcccttaaccttaagcaatccagttccacgccctggatcagtgaataaccccagctgcaccatgagccgcgttcgggatgctggctgtgtagcggcggggatagtgataggggctggtgcctggtactgtgtctacaaatacaccagggggagagaccagaccaagaagagaatggccaagcccaaaaaccgggctgtggctgggactggagccagggctagagctgggctaagagccggattcacaatcgaccttgggtcaggattcagtcccccaaccccagtccgtgctgaagcagaggacagggcccaggatgaagcctctgctctggacacagttggagctgaggcagtggccccagctgcatccagcgctgaggctcagagtggggcaggcagtcaggcccaagaggcagatggagccggggttgggcctaaggccgaatcagtagttggggctgcaatggcttctgcaatagcaccacctcccggggtgacagaggcccttggggctgcagaagcccctgcaatggcaggggctcccaaagtggcagaagctcccagagaagcggagacttccagggcagcggtgcctcctgggacagtggtgcctaccgaagcggcagcacccactgaggtgaccgagggtcctggggtagcagcacctaccaaggtagctgaagctcccggggtggcatcgcctaccgaggcagctgaggctcctgtgcccgcaacgcctactggggctgcagcacctactggggctgcagagtctcctggaacttctggttcccctagaacagcggtggttcctggaacatcagctgccaagaaagcaacccctggggctcacactggggctataccgaaagccacatcagcgactggagcggtacccaaaggtggaggcaagggtgtaaccaggtcccggaatgggggcaagggcaagggcaagaaaagcaaagttgaagtagacgaactggggatgggcttccgtcctggagatggggctgcagcagctgctgcagcctctgctaatggcggacaggctttcctggcagaggtccctgattctgaggaaggggagtccgggtggactgacacagagtcagattcagactctgagcccgagacccagcgcagagggaggggaagaagacccgttgccatgcagaagcgcccctttccttatgaaattgatgagattctgggtgtccgcgatctcaggaaggtccttgccttgcttcagaaatctgatgatcctttcatccaacaggtagctttgctcactctgagcaacaatgccaattattcatgcaatcaagagacaatccgcaaattgggaggcctcccaattattgcaaacatgatcaacaaaactgatccacacattaaggaaaaagccttaatggccatgaataacctgagtgagaattatgaaaatcagggccggcttcaggtgtacatgaataaagtgatggatgatatcatggcctctaacctgaactcagcagttcaagtagttggactaaaatttctaacaaacatgactattactaatgactaccaacacctgcttgtcaattccattgcaaactttttccgtttgctatctcagggaggtggaaaaatcaaggttgagattttgaaaatcctttcgaattttgctgaaaatccagatatgttgaagaaacttctcagtacccaagtgccagcatcatttagttccctctataattcttacgtggaatcagaaatccttattaatgcccttactctatttgagattatctatgacaatctcagagcagaagtgtttaactatagagaattcaataaaggttcccttttttacttatgcactacatctggagtgtgtgttaagaaaattagagccttagcaaatcaccatgacctcttagtgaaagtgaaagttataaaactagtgaacaaattctgattggttatgtaccgtcaaaagacttgaagaaatttcatgattttgcagtgtggaagcgttgaaaattgaaagttactgcttttccacttgctcatatagtaaagggatcctttcagctgccagtgttgaataatgtatcatccagagtgatgttatctgtgacagtcaccagctttaagctgaaccattttatgaataccaaataaatagacctcttgtactgaaaacatatttgtgactttaatcgtgctgcttggatagaaatatttttactggttcttctgaattgacagtaaacctgtccattatgaatggcctactgttctattatttgttttgacttgaatttatccaccaaagacttcatttgtgtatcatcaataaagttgtatgtttcaactgacaaaaa

SEQ ID NO: 455697 - DNA, 2780 bp, Homo sapiens
cgtgggcaaaggtacttaaagccctgaccgtcgttctccgtcctcctctgggtaccaactctattgcgcagctcgctgccgtgcgtttaacccaggcgaggaggaggaggagaaaattcccccagattcgggcaggcccgcaccccacattccgtcctgttttgagaggaggagggaagagaaataaacgtggcagcgcatagaaggccagcagggagactgctttccagacacctccggcccacacagccgttcaccccccgtcttttcagtcctggaaaaggaattcggtctgtccttaggatgaagctctaactgaactgaagtaaggagaaacagccttgaatctttggagggtctgtcttccttttgggctctgtgcaactgcagctacagtggaaaaaagcaaactgctcttgatcccaggccctgcctaagcctcagcagaacttgtaagcctaaactgaagagcctcacccggacgagcaggcatcccttaaccttaagcaatccagttccacgccctggatcagtgaataaccccagctgcaccatgagccgcgttcgggatgctggctgtgtagcggcggggatagtgataggggctggtgcctggtactgtgtctacaaatacaccgggctgtggctgggactggagccagggctagagctgggattcagtcccccaaccccagtccgtgctgaagcagaggacagggcccaggatgaagcctctgctctggacacagttggagctgaggcagtggccccagctgcatccagcgctgaggctcagagtggggcaggcagtcaggcccaagaggcagatggagccggggttgggcctaaggccgaatcagtagttggggctgcaatggcttctgcaatagcaccacctcccggggtgacagaggcccttggggctgcagaagcccctgcaatggcaggggctcccaaagtggcagaagctcccagagaagcggagacttccagggcagcggtgcctcctgggacagtggtgcctaccgaagcggcagcacccactgaggtgaccgagggtcctggggtagcagcacctaccaaggtagctgaagctcccggggtggcatcgcctaccgaggcagctgaggctcctgtgcccgcaacgcctactggggctgcagcacctactggggctgcagagtctcctggaacttctggttcccctagaacagcggtggttcctggaacatcagctgccaagaaagcaacccctggggctcacactggggctataccgaaagccacatcagcgactggagcggtacccaaaggtggaggcaagggtgtaaccaggtcccggaatgggggcaagggcaagggcaagaaaagcaaagttgaagtagacgaactggggatgggcttccgtcctggagatggggctgcagcagctgctgcagcctctgctaatggcggacaggctttcctggcagaggtccctgattctgaggaaggggagtccgggtggactgacacagagtcagattcagactctgagcccgagacccagcgcagagggaggggaagaagacccgttgccatgcagaagcgcccctttccttatgaaattgatgagattctgggtgtccgcgatctcaggaaggtccttgccttgcttcagaaatctgatgatcctttcatccaacaggtagctttgctcactctgagcaacaatgccaattattcatgcaatcaagagacaatccgcaaattgggaggcctcccaattattgcaaacatgatcaacaaaactgatccacacattaaggaaaaagccttaatggccatgaataacctgagtgagaattatgaaaatcagggccggcttcaggtgtacatgaataaagtgatggatgatatcatggcctctaacctgaactcagcagttcaagtagttggactaaaatttctaacaaacatgactattactaatgactaccaacacctgcttgtcaattccattgcaaactttttccgtttgctatctcagggaggtggaaaaatcaaggttgagattttgaaaatcctttcgaattttgctgaaaatccagatatgttgaagaaacttctcagtacccaagtgccagcatcatttagttccctctataattcttacgtggaatcagaaatccttattaatgcccttactctatttgagattatctatgacaatctcagagcagaagtgtttaactatagagaattcaataaaggttcccttttttacttatgcactacatctggagtgtgtgttaagaaaattagagccttagcaaatcaccatgacctcttagtgaaagtgaaagttataaaactagtgaacaaattctgattggttatgtaccgtcaaaagacttgaagaaatttcatgattttgcagtgtggaagcgttgaaaattgaaagttactgcttttccacttgctcatatagtaaagggatcctttcagctgccagtgttgaataatgtatcatccagagtgatgttatctgtgacagtcaccagctttaagctgaaccattttatgaataccaaataaatagacctcttgtactgaaaacatatttgtgactttaatcgtgctgcttggatagaaatatttttactggttcttctgaattgacagtaaacctgtccattatgaatggcctactgttctattatttgttttgacttgaatttatccaccaaagacttcatttgtgtatcatcaataaagttgtatgtttcaactgacaaaaa

SEQ ID NO: 455698 - DNA, 2674 bp, Homo sapiens
tggtattaaaccgccttgttaactcgcagacactgctttccagacacctccggcccacacagccgttcaccccccgtcttttcagtcctggaaaaggaattcggtctgtccttaggatgaagctctaactgaactgaagtaaggagaaacagccttgaatctttggagggtctgtcttccttttgggctctgtgcaactgcagctacagtggaaaaaagcaaactgctcttgatcccaggccctgcctaagcctcagcagaacttgtaagcctaaactgaagagcctcacccggacgagcaggcatcccttaaccttaagcaatccagttccacgccctggatcagtgaataaccccagctgcaccatgagccgcgttcgggatgctggctgtgtagcggcggggatagtgataggggctggtgcctggtactgtgtctacaaatacaccagggggagagaccagaccaagaagagaatggccaagcccaaaaaccgggctgtggctgggactggagccagggctagagctgggctaagagccggattcacaatcgaccttgggtcaggattcagtcccccaaccccagtccgtgctgaagcagaggacagggcccaggatgaagcctctgctctggacacagttggagctgaggcagtggccccagctgcatccagcgctgaggctcagagtggggcaggcagtcaggcccaagaggcagatggagccggggttgggcctaaggccgaatcagtagttggggctgcaatggcttctgcaatagcaccacctcccggggtgacagaggcccttggggctgcagaagcccctgcaatggcaggggctcccaaagtggcagaagctcccagagaagcggagacttccagggcagcggtgcctcctgggacagtggtgcctaccgaagcggcagcacccactgaggtgaccgagggtcctggggtagcagcacctaccaaggtagctgaagctcccggggtggcatcgcctaccgaggcagctgaggctcctgtgcccgcaacgcctactggggctgcagcacctactggggctgcagagtctcctggaacttctggttcccctagaacagcggtggttcctggaacatcagctgccaagaaagcaacccctggggctcacactggggctataccgaaagccacatcagcgactggagcggtacccaaaggtggaggcaagggtgtaaccaggtcccggaatgggggcaagggcaagggcaagaaaagcaaagttgaagtagacgaactggggatgggcttccgtcctggagatggggctgcagcagctgctgcagcctctgctaatggcggacaggctttcctggcagaggtccctgattctgaggaaggggagtccgggtggactgacacagagtcagattcagactctgagcccgagacccagcgcagagggaggggaagaagacccgttgccatgcagaagcgcccctttccttatgaaattgatgagattctgggtgtccgcgatctcaggaaggtccttgccttgcttcagaaatctgatgatcctttcatccaacaggtagctttgctcactctgagcaacaatgccaattattcatgcaatcaagagacaatccgcaaattgggaggcctcccaattattgcaaacatgatcaacaaaactgatccacacattaaggaaaaagccttaatggccatgaataacctgagtgagaattatgaaaatcagggccggcttcaggtgtacatgaataaagtgatggatgatatcatggcctctaacctgaactcagcagttcaagtagttggactaaaatttctaacaaacatgactattactaatgactaccaacacctgcttgtcaattccattgcaaactttttccgtttgctatctcagggaggtggaaaaatcaaggttgagattttgaaaatcctttcgaattttgctgaaaatccagatatgttgaagaaacttctcagtacccaagtgccagcatcatttagttccctctataattcttacgtggaatcagaaatccttattaatgcccttactctatttgagattatctatgacaatctcagagcagaagtgtttaactatagagaattcaataaaggttcccttttttacttatgcactacatctggagtgtgtgttaagaaaattagagccttagcaaatcaccatgacctcttagtgaaagtgaaagttataaaactagtgaacaaattctgattggttatgtaccgtcaaaagacttgaagaaatttcatgattttgcagtgtggaagcgttgaaaattgaaagttactgcttttccacttgctcatatagtaaagggatcctttcagctgccagtgttgaataatgtatcatccagagtgatgttatctgtgacagtcaccagctttaagctgaaccattttatgaataccaaataaatagacctcttgtactgaaaacatatttgtgactttaatcgtgctgcttggatagaaatatttttactggttcttctgaattgacagtaaacctgtccattatgaatggcctactgttctattatttgttttgacttgaatttatccaccaaagacttcatttgtgtatcatcaataaagttgtatgtttcaactgacaaaaa

SEQ ID NO: 455699 - DNA, 649 bp, Homo sapiens
agccctacagtacagaggctatttatctggtattcataaaatggttcagcttaaagctggtgactgtcacagataacatcactctggatgcatacagttattcaacactggcagctgaaaggttcccttttttacttatgcactacatctggagtgtgtgttaagaaaattagagccttagcaaatcaccatgacctcttagtgaaagtgaaagttataaaactagtgaacaaattctgattggttatgtaccgtcaaaagacttgaagaaatttcatgattttgcagtgtggaagcgttgaaaattgaaagttactgcttttccacttgctcatatagtaaagggatcctttcagctgccagtgttgaataatgtatcatccagagtgatgttatctgtgacagtcaccagctttaagctgaaccattttatgaataccaaataaatagacctcttgtactgaaaacatatttgtgactttaatcgtgctgcttggatagaaatatttttactggttcttctgaattgacagtaaacctgtccattatgaatggcctactgttctattatttgttttgacttgaatttatccaccaaagacttcatttgtgtatcatcaataaagttgtatgtttcaactgacaaaaa

SEQ ID NO: 455700 - DNA, 428 bp, Homo sapiens
gcctctcgtccttccatttagatgctggaagttgtaggcattggcagagcaggctaaggttgaagatgtagaaaacgttaaactaggtctgtgaatcagcaaacacaggccttgacacctgtgtctgggtgctagcccgccaacgaagcattgtgtccctaaactcttctctaagtagaactggttagacacgaagtgagccagagccctaagcctcatttttatcctttacccctaggccctgcctaagcctcagcagaacttgtaagcctaaactgaagagcctcacccggacgagcaggcatcccttaaccttaagcaatccagttccacgccctggatcagtgaataaccccagctgcaccatgagccgcgttcgggatgctggctgtgtagcggcggggatagtgataggggctggtgcctgg

SEQ ID NO: 455701 - DNA, 396 bp, Homo sapiens
gtgcctcggtctcccccactcctggccggctttccagacctgaggtgctcaaacgcggctcattttggtgggcggtggggaaagggggagggggaaacgaaaagacttttgatagactttacgaagaatccgcttacttcctttccagccagtgttttttggttttgtttataatattcaggcccgcaccccacattccgtcctgttttgagaggaggagggaagagaaataaacgtggcagcgcatagaaggccagcagggaggttgggaaagggtaaccaggaggcgggggtggggcatgcaatttggtaacaatctgggcggcacactcccaccctgactttccccaccaccgccccggcaccctcccatcccccagccgaccctctgtgatt

SEQ ID NO: 455702 - DNA, 2663 bp, Homo sapiens
gaatcatttgacattctgatgtgcaaacacgaaaaggcagttactgagacccttgtcctggatgctgatccatccaccaggctttcattgtctaacgtcgacagtctatatttctgctcttcagtctgtccttaggatgaagctctaactgaactgaagtctgtcttccttttgggctctgtgcaactgcagctacagtggaaaaaagcaaactgctcttgatcccaggccctgcctaagcctcagcagaacttgtaagcctaaactgaagagcctcacccggacgagcaggcatcccttaaccttaagcaatccagttccacgccctggatcagtgaataaccccagctgcaccatgagccgcgttcgggatgctggctgtgtagcggcggggatagtgataggggctggtgcctggtactgtgtctacaaatacaccagggggagagaccagaccaagaagagaatggccaagcccaaaaaccgggctgtggctgggactggagccagggctagagctgggctaagagccggattcacaatcgaccttgggtcaggattcagtcccccaaccccagtccgtgctgaagcagaggacagggcccaggatgaagcctctgctctggacacagttggagctgaggcagtggccccagctgcatccagcgctgaggctcagagtggggcaggcagtcaggcccaagaggcagatggagccggggttgggcctaaggccgaatcagtagttggggctgcaatggcttctgcaatagcaccacctcccggggtgacagaggcccttggggctgcagaagcccctgcaatggcaggggctcccaaagtggcagaagctcccagagaagcggagacttccagggcagcggtgcctcctgggacagtggtgcctaccgaagcggcagcacccactgaggtgaccgagggtcctggggtagcagcacctaccaaggtagctgaagctcccggggtggcatcgcctaccgaggcagctgaggctcctgtgcccgcaacgcctactggggctgcagcacctactggggctgcagagtctcctggaacttctggttcccctagaacagcggtggttcctggaacatcagctgccaagaaagcaacccctggggctcacactggggctataccgaaagccacatcagcgactggagcggtacccaaaggtggaggcaagggtgtaaccaggtcccggaatgggggcaagggcaagggcaagaaaagcaaagttgaagtagacgaactggggatgggcttccgtcctggagatggggctgcagcagctgctgcagcctctgctaatggcggacaggctttcctggcagaggtccctgattctgaggaaggggagtccgggtggactgacacagagtcagattcagactctgagcccgagacccagcgcagagggaggggaagaagacccgttgccatgcagaagcgcccctttccttatgaaattgatgagattctgggtgtccgcgatctcaggaaggtccttgccttgcttcagaaatctgatgatcctttcatccaacaggtagctttgctcactctgagcaacaatgccaattattcatgcaatcaagagacaatccgcaaattgggaggcctcccaattattgcaaacatgatcaacaaaactgatccacacattaaggaaaaagccttaatggccatgaataacctgagtgagaattatgaaaatcagggccggcttcaggtgtacatgaataaagtgatggatgatatcatggcctctaacctgaactcagcagttcaagtagttggactaaaatttctaacaaacatgactattactaatgactaccaacacctgcttgtcaattccattgcaaactttttccgtttgctatctcagggaggtggaaaaatcaaggttgagattttgaaaatcctttcgaattttgctgaaaatccagatatgttgaagaaacttctcagtacccaagtgccagcatcatttagttccctctataattcttacgtggaatcagaaatccttattaatgcccttactctatttgagattatctatgacaatctcagagcagaagtgtttaactatagagaattcaataaaggttcccttttttacttatgcactacatctggagtgtgtgttaagaaaattagagccttagcaaatcaccatgacctcttagtgaaagtgaaagttataaaactagtgaacaaattctgattggttatgtaccgtcaaaagacttgaagaaatttcatgattttgcagtgtggaagcgttgaaaattgaaagttactgcttttccacttgctcatatagtaaagggatcctttcagctgccagtgttgaataatgtatcatccagagtgatgttatctgtgacagtcaccagctttaagctgaaccattttatgaataccaaataaatagacctcttgtactgaaaacatatttgtgactttaatcgtgctgcttggatagaaatatttttactggttcttctgaattgacagtaaacctgtccattatgaatggcctactgttctattatttgttttgacttgaatttatccaccaaagacttcatttgtgtatcatcaataaagttgtatgtttcaactgacaaaaa

SEQ ID NO: 455703 - DNA, 3320 bp, Homo sapiens
cgtgggcaaaggtacttaaagccctgaccgtcgttctccgtcctcctctgggtaccaactctattgcgcagctcgctgccgtgcgtttaacccaggcgaggaggaggaggagaaaattcccccagattcgggcaggcccgcaccccacattccgtcctgttttgagaggaggagggaagagaaataaacgtggcagcgcatagaaggccagcagggagactgctttccagacacctccggcccacacagccgttcaccccccgtcttttcagtcctggaaaaggaattcggtctgtccttaggatgaagctctaactgaactgaagtaaggagaaacagccttgaatctttggagggtctgtcttccttttgggctctgtgcaactgcagctacagtggaaaaaagcaaactgctcttgatcccaggccctgcctaagcctcagcagaacttgtaagcctaaactgaagagcctcacccggacgagcaggcatcccttaaccttaagcaatccagttccacgccctggatcagtgaataaccccagctgcaccatgagccgcgttcgggatgctggctgtgtagcggcggggatagtgataggggctggtgcctggtactgtgtctacaaatacaccagggggagagaccagaccaagaagagaatggccaagcccaaaaaccgggctgtggctgggactggagccagggctagagctgggctaagagccggattcacaatcgaccttgggtcaggattcagtcccccaaccccagtccgtgctgaagcagaggacagggcccaggatgaagcctctgctctggacacagttggagctgaggcagtggccccagctgcatccagcgctgaggctcagagtggggcaggcagtcaggcccaagaggcagatggagccggggttgggcctaaggccgaatcagtagttggggctgcaatggcttctgcaatagcaccacctcccggggtgacagaggcccttggggctgcagaagcccctgcaatggcaggggctcccaaagtggcagaagctcccagagaagcggagacttccagggcagcggtgcctcctgggacagtggtgcctaccgaagcggcagcacccactgaggtgaccgagggtcctggggtagcagcacctaccaaggtagctgaagctcccggggtggcatcgcctaccgaggcagctgaggctcctgtgcccgcaacgcctactggggctgcagcacctactggggctgcagagtctcctggaacttctggttcccctagaacagcggtggttcctggaacatcagctgccaagaaagcaacccctggggctcacactggggctataccgaaagccacatcagcgactggagcggtacccaaaggtggaggcaagggtgtaaccaggtcccggaatgggggcaagggcaagggcaagaaaagcaaagttgaagtagacgaactggggatgggcttccgtcctggagatggggctgcagcagctgctgcagcctctgctaatggcggacaggctttcctggcagaggtccctgattctgaggaaggggagtccgggtggactgacacagagtcagattcagactctgagcccgagacccagcgcagagggaggggaagaagacccgttgccatgcagaagcgcccctttccttatgaaattgatgagattctgggtgtccgcgatctcaggaaggtccttgccttgcttcagaaatctgatgatcctttcatccaacaggtagctttgctcactctgagcaacaatgccaattattcatgcaatcaagagacaatccgcaaattgggaggcctcccaattattgcaaacatgatcaacaaaactgatccacacattaaggaaaaagccttaatggccatgaataacctgagtgagaattatgaaaatcagggccggcttcaggtgtacatgaataaagtgatggatgatatcatggcctctaacctgaactcagcagttcaagtagttggactaaaatttctaacaaacatgactattactaatgactaccaacacctgcttgtcaattccattgcaaactttttccgtttgctatctcagggaggtggaaaaatcaaggttgagattttgaaaatcctttcgaattttgctgaaaatccagatatgttgaagaaacttctcagtacccaagtgccagcatcatttagttccctctataattcttacgtggaatcagaaatccttattaatgcccttactctatttgagattatctatgacaatctcagagcagaagtgtttaactatagagaattcaataaaggttcccttttttacttatgcactacatctggagtgtgtgttaagaaaattagagccttagcaaatcaccatgacctcttagtgaaagtgaaagttataaaactagtgaacaaattctgattggttatgtaccgtcaaaagacttgaagaaatttcatgattttgcagtgtggaagcgttgaaaattgaaagttactgcttttccacttgctcatatagtaaagggatcctttcagctgccagtgttgaataatgtatcatccagagtgatgttatctgtgacagtcaccagctttaagctgaaccattttatgaataccaaataaatagacctcttgtactgaaaacatatttgtgactttaatcgtgctgcttggatagaaatatttttactggttcttctgaattgacagtaaacctgtccattatgaatggcctactgttctattatttgttttgacttgaatttatccaccaaagacttcatttgtgtatcatcaataaagttgtatgtttcaactgacaaaaaaaaaaaaaaaaaaacaaaaaaaaaaaacaaaaataaaacaacaaaacaacaaaaaaacaaaaaaaacaaacacaacaaaacaaacaccctcaaaacacaccaacaaatccacaacacaagcgcgcttctatatcgaacgcgccggccgcccaatcatattgaacagctgtcttgtttctgtagcaagacaggagacgcttcgaatcttgaggtagatgaaacacattcaatggaggaggatgcgggctcattccaatcagccggacaggagacagatgacactatactgttcatcgtctaggaaaggaccccacactgatggatggttgagaataaaagcaccatcctgcatgtacagaattgtttaccgactgaacttacaaagttgggtgtagatatggtaaacaccagacagctgggcaggtaagatgcctgcctgtattttatcaatttcgcagc

SEQ ID NO: 455704 - DNA, 2905 bp, Homo sapiens
cgtgggcaaaggtacttaaagccctgaccgtcgttctccgtcctcctctgggtaccaactctattgcgcagctcgctgccgtgcgtttaacccaggcgaggaggaggaggagaaaattcccccagattcgggcaggcccgcaccccacattccgtcctgttttgagaggaggagggaagagaaataaacgtggcagcgcatagaaggccagcagggagactgctttccagacacctccggcccacacagccgttcaccccccgtcttttcagtcctggaaaaggaattcgggctttcattgtctaacgtcgacagtctatatttctgctcttcagtctgtccttaggatgaagctctaactgaactgaagtaaggagaaacagccttgaatctttggagggtctgtcttccttttgggctctgtgcaactgcagctacagtggaaaaaagcaaactgctcttgatcccaggccctgcctaagcctcagcagaacttgtaagcctaaactgaagagcctcacccggacgagcaggcatcccttaaccttaagcaatccagttccacgccctggatcagtgaataaccccagctgcaccatgagccgcgttcgggatgctggctgtgtagcggcggggatagtgataggggctggtgcctggtactgtgtctacaaatacaccagggggagagaccagaccaagaagagaatggccaagcccaaaaaccgggctgtggctgggactggagccagggctagagctgggctaagagccggattcacaatcgaccttgggtcaggattcagtcccccaaccccagtccgtgctgaagcagaggacagggcccaggatgaagcctctgctctggacacagttggagctgaggcagtggccccagctgcatccagcgctgaggctcagagtggggcaggcagtcaggcccaagaggcagatggagccggggttgggcctaaggccgaatcagtagttggggctgcaatggcttctgcaatagcaccacctcccggggtgacagaggcccttggggctgcagaagcccctgcaatggcaggggctcccaaagtggcagaagctcccagagaagcggagacttccagggcagcggtgcctcctgggacagtggtgcctaccgaagcggcagcacccactgaggtgaccgagggtcctggggtagcagcacctaccaaggtagctgaagctcccggggtggcatcgcctaccgaggcagctgaggctcctgtgcccgcaacgcctactggggctgcagcacctactggggctgcagagtctcctggaacttctggttcccctagaacagcggtggttcctggaacatcagctgccaagaaagcaacccctggggctcacactggggctataccgaaagccacatcagcgactggagcggtacccaaaggtggaggcaagggtgtaaccaggtcccggaatgggggcaagggcaagggcaagaaaagcaaagttgaagtagacgaactggggatgggcttccgtcctggagatggggctgcagcagctgctgcagcctctgctaatggcggacaggctttcctggcagaggtccctgattctgaggaaggggagtccgggtggactgacacagagtcagattcagactctgagcccgagacccagcgcagagggaggggaagaagacccgttgccatgcagaagcgcccctttccttatgaaattgatgagattctgggtgtccgcgatctcaggaaggtccttgccttgcttcagaaatctgatgatcctttcatccaacaggtagctttgctcactctgagcaacaatgccaattattcatgcaatcaagagacaatccgcaaattgggaggcctcccaattattgcaaacatgatcaacaaaactgatccacacattaaggaaaaagccttaatggccatgaataacctgagtgagaattatgaaaatcagggccggcttcaggtgtacatgaataaagtgatggatgatatcatggcctctaacctgaactcagcagttcaagtagttggactaaaatttctaacaaacatgactattactaatgactaccaacacctgcttgtcaattccattgcaaactttttccgtttgctatctcagggaggtggaaaaatcaaggttgagattttgaaaatcctttcgaattttgctgaaaatccagatatgttgaagaaacttctcagtacccaagtgccagcatcatttagttccctctataattcttacgtggaatcagaaatccttattaatgcccttactctatttgagattatctatgacaatctcagagcagaagtgtttaactatagagaattcaataaaggttcccttttttacttatgcactacatctggagtgtgtgttaagaaaattagagccttagcaaatcaccatgacctcttagtgaaagtgaaagttataaaactagtgaacaaattctgattggttatgtaccgtcaaaagacttgaagaaatttcatgattttgcagtgtggaagcgttgaaaattgaaagttactgcttttccacttgctcatatagtaaagggatcctttcagctgccagtgttgaataatgtatcatccagagtgatgttatctgtgacagtcaccagctttaagctgaaccattttatgaataccaaataaatagacctcttgtactgaaaacatatttgtgactttaatcgtgctgcttggatagaaatatttttactggttcttctgaattgacagtaaacctgtccattatgaatggcctactgttctattatttgttttgacttgaatttatccaccaaagacttcatttgtgtatcatcaataaagttgtatgtttcaactgacaaaaa

SEQ ID NO: 455705 - DNA, 2796 bp, Homo sapiens
cgtgggcaaaggtacttaaagccctgaccgtcgttctccgtcctcctctgggtaccaactctattgcgcagctcgctgccgtgcgtttaacccaggcgaggaggaggaggagaaaattcccccagattcgggcaggcccgcaccccacattccgtcctgttttgagaggaggagggaagagaaataaacgtggcagcgcatagaaggccagcagggagactgctttccagacacctccggcccacacagccgttcaccccccgtcttttcagtcctggaaaaggaattcgggtctgtcttccttttgggctctgtgcaactgcagctacagtggaaaaaagcaaactgctcttgatcccaggccctgcctaagcctcagcagaacttgtaagcctaaactgaagagcctcacccggacgagcaggcatcccttaaccttaagcaatccagttccacgccctggatcagtgaataaccccagctgcaccatgagccgcgttcgggatgctggctgtgtagcggcggggatagtgataggggctggtgcctggtactgtgtctacaaatacaccagggggagagaccagaccaagaagagaatggccaagcccaaaaaccgggctgtggctgggactggagccagggctagagctgggctaagagccggattcacaatcgaccttgggtcaggattcagtcccccaaccccagtccgtgctgaagcagaggacagggcccaggatgaagcctctgctctggacacagttggagctgaggcagtggccccagctgcatccagcgctgaggctcagagtggggcaggcagtcaggcccaagaggcagatggagccggggttgggcctaaggccgaatcagtagttggggctgcaatggcttctgcaatagcaccacctcccggggtgacagaggcccttggggctgcagaagcccctgcaatggcaggggctcccaaagtggcagaagctcccagagaagcggagacttccagggcagcggtgcctcctgggacagtggtgcctaccgaagcggcagcacccactgaggtgaccgagggtcctggggtagcagcacctaccaaggtagctgaagctcccggggtggcatcgcctaccgaggcagctgaggctcctgtgcccgcaacgcctactggggctgcagcacctactggggctgcagagtctcctggaacttctggttcccctagaacagcggtggttcctggaacatcagctgccaagaaagcaacccctggggctcacactggggctataccgaaagccacatcagcgactggagcggtacccaaaggtggaggcaagggtgtaaccaggtcccggaatgggggcaagggcaagggcaagaaaagcaaagttgaagtagacgaactggggatgggcttccgtcctggagatggggctgcagcagctgctgcagcctctgctaatggcggacaggctttcctggcagaggtccctgattctgaggaaggggagtccgggtggactgacacagagtcagattcagactctgagcccgagacccagcgcagagggaggggaagaagacccgttgccatgcagaagcgcccctttccttatgaaattgatgagattctgggtgtccgcgatctcaggaaggtccttgccttgcttcagaaatctgatgatcctttcatccaacaggtagctttgctcactctgagcaacaatgccaattattcatgcaatcaagagacaatccgcaaattgggaggcctcccaattattgcaaacatgatcaacaaaactgatccacacattaaggaaaaagccttaatggccatgaataacctgagtgagaattatgaaaatcagggccggcttcaggtgtacatgaataaagtgatggatgatatcatggcctctaacctgaactcagcagttcaagtagttggactaaaatttctaacaaacatgactattactaatgactaccaacacctgcttgtcaattccattgcaaactttttccgtttgctatctcagggaggtggaaaaatcaaggttgagattttgaaaatcctttcgaattttgctgaaaatccagatatgttgaagaaacttctcagtacccaagtgccagcatcatttagttccctctataattcttacgtggaatcagaaatccttattaatgcccttactctatttgagattatctatgacaatctcagagcagaagtgtttaactatagagaattcaataaaggttcccttttttacttatgcactacatctggagtgtgtgttaagaaaattagagccttagcaaatcaccatgacctcttagtgaaagtgaaagttataaaactagtgaacaaattctgattggttatgtaccgtcaaaagacttgaagaaatttcatgattttgcagtgtggaagcgttgaaaattgaaagttactgcttttccacttgctcatatagtaaagggatcctttcagctgccagtgttgaataatgtatcatccagagtgatgttatctgtgacagtcaccagctttaagctgaaccattttatgaataccaaataaatagacctcttgtactgaaaacatatttgtgactttaatcgtgctgcttggatagaaatatttttactggttcttctgaattgacagtaaacctgtccattatgaatggcctactgttctattatttgttttgacttgaatttatccaccaaagacttcatttgtgtatcatcaataaagttgtatgtttcaactgacaaaaa

SEQ ID NO: 455706 - DNA, 2536 bp, Homo sapiens
tacaagttctgctgaggcttaggcagggcctgggatcaagagcagtttgcttttttccactgtagctgcagttgcacagagcccaaaaggaagacagaccctccaaagattcaaggctgtttctccttacttcagttcagttagagcctcacccggacgagcaggcatcccttaaccttaagcaatccagttccacgccctggatcagtgaataaccccagctgcaccatgagccgcgttcgggatgctggctgtgtagcggcggggatagtgataggggctggtgcctggtactgtgtctacaaatacaccagggggagagaccagaccaagaagagaatggccaagcccaaaaaccgggctgtggctgggactggagccagggctagagctgggctaagagccggattcacaatcgaccttgggtcaggattcagtcccccaaccccagtccgtgctgaagcagaggacagggcccaggatgaagcctctgctctggacacagttggagctgaggcagtggccccagctgcatccagcgctgaggctcagagtggggcaggcagtcaggcccaagaggcagatggagccggggttgggcctaaggccgaatcagtagttggggctgcaatggcttctgcaatagcaccacctcccggggtgacagaggcccttggggctgcagaagcccctgcaatggcaggggctcccaaagtggcagaagctcccagagaagcggagacttccagggcagcggtgcctcctgggacagtggtgcctaccgaagcggcagcacccactgaggtgaccgagggtcctggggtagcagcacctaccaaggtagctgaagctcccggggtggcatcgcctaccgaggcagctgaggctcctgtgcccgcaacgcctactggggctgcagcacctactggggctgcagagtctcctggaacttctggttcccctagaacagcggtggttcctggaacatcagctgccaagaaagcaacccctggggctcacactggggctataccgaaagccacatcagcgactggagcggtacccaaaggtggaggcaagggtgtaaccaggtcccggaatgggggcaagggcaagggcaagaaaagcaaagttgaagtagacgaactggggatgggcttccgtcctggagatggggctgcagcagctgctgcagcctctgctaatggcggacaggctttcctggcagaggtccctgattctgaggaaggggagtccgggtggactgacacagagtcagattcagactctgagcccgagacccagcgcagagggaggggaagaagacccgttgccatgcagaagcgcccctttccttatgaaattgatgagattctgggtgtccgcgatctcaggaaggtccttgccttgcttcagaaatctgatgatcctttcatccaacaggtagctttgctcactctgagcaacaatgccaattattcatgcaatcaagagacaatccgcaaattgggaggcctcccaattattgcaaacatgatcaacaaaactgatccacacattaaggaaaaagccttaatggccatgaataacctgagtgagaattatgaaaatcagggccggcttcaggtgtacatgaataaagtgatggatgatatcatggcctctaacctgaactcagcagttcaagtagttggactaaaatttctaacaaacatgactattactaatgactaccaacacctgcttgtcaattccattgcaaactttttccgtttgctatctcagggaggtggaaaaatcaaggttgagattttgaaaatcctttcgaattttgctgaaaatccagatatgttgaagaaacttctcagtacccaagtgccagcatcatttagttccctctataattcttacgtggaatcagaaatccttattaatgcccttactctatttgagattatctatgacaatctcagagcagaagtgtttaactatagagaattcaataaaggttcccttttttacttatgcactacatctggagtgtgtgttaagaaaattagagccttagcaaatcaccatgacctcttagtgaaagtgaaagttataaaactagtgaacaaattctgattggttatgtaccgtcaaaagacttgaagaaatttcatgattttgcagtgtggaagcgttgaaaattgaaagttactgcttttccacttgctcatatagtaaagggatcctttcagctgccagtgttgaataatgtatcatccagagtgatgttatctgtgacagtcaccagctttaagctgaaccattttatgaataccaaataaatagacctcttgtactgaaaacatatttgtgactttaatcgtgctgcttggatagaaatatttttactggttcttctgaattgacagtaaacctgtccattatgaatggcctactgttctattatttgttttgacttgaatttatccaccaaagacttcatttgtgtatcatcaataaagttgtatgtttcaactgacaaaaa

SEQ ID NO: 455707 - DNA, 799 bp, Homo sapiens
cgatctctgtttctctggaggaagccaaggacaagagcagttgctgtggctgggactctgccttttaggggagcccgtgtatctctttgggatcctgaaagggggcaggaaaggctggggtcccagtccaccctaatggtatctgagtgtcctagggcttcagttttcccacctgtccaatgggaccctttctgtcctcaccctacaaggggcacaaagggatgacaccaaacctggcaggaacttttcacgcaatcaagggaaggaaaggcattcctggcagagggaacagcatgccaagcgtgagaaggctcagagtaaggaggttaagagcccaagtattggagcctacagttttgccccttccatgcagtgtgacagtgggcaagttcctttccctctctgggtctcagttctgtcccctgcaaaatggtcagagcttaccccttggctgtgcagggtcaactttctgactggtgagagggattctcatgcaggttaagcttctgctgctcctcctcacctgcaaagcttttctgccacttttgcctccttggaaaactcttatccatctctcaaaactccagctaccacatccttgcagccttccctcatatacccccactactactgtagccctgtccttccctccagccccactctggccctggggctggggaagtgtctgtgtccagctgtctcccctgacctcagggttccttgggggctgggctgaggcctcagtacagagggggctctggaaatgtttgttgactgaataaaggaattcagtggaaaa

SEQ ID NO: 455708 - DNA, 4365 bp, Homo sapiens
gactgaggggctttttctctctgtgccccaggcaagttgcactcattatggaattccggcggcccgctaggcaagttgcactcatggcacctccaagtgaagagacgcccctgatccctcagcgttcatgcagcctcttgtccacggaggctggtgccctgcatgtgctgctgcccgctcggggccccggggcccccccagcgcctatctttctcctttggggaccacttggctgaggacctgtgcgtgcaggctgccaaggccagcggcatcctgcctgtgtaccactccctctttgctctggccacggaggacctgtcctgctggttccccccgagccacatcttctccgtggaggatgccagcacccaagtcctgctgtacaggattcgcttttacttccccaattggtttgggctggagaagtgccaccgcttcgggctacgcaaggatttggccagtgctatccttgacctgccagtcctggagcacctctttgcccagcaccgcagtgacctggtgagtgggcgcctccccgtgggcctcagtctcaaggagcagggtgagtgtctcagcctggccgtgttggacctggcccggatggcgcgagagcaggcccagcggccgggagagctgctgaagactgtcagctacaaggcctgcctacccccaagcctgcgcgacctgatccagggcctgagcttcgtgacgcggaggcgtattcggaggacggtgcgcagagccctgcgccgcgtggccgcctgccaggcagaccggcactcgctcatggccaagtacatcatggacctggagcggctggatccagccggggccgccgagaccttccacgtgggcctccctggggcccttggtggccacgacgggctggggctgctccgcgtggctggtgacggcggcatcgcctggacccagggagaacaggaggtcctccagcccttctgcgactttccagaaatcgtagacattagcatcaagcaggccccgcgcgttggcccggccggagagcaccgcctggtcactgttaccaggacagacaaccagattttagaggccgagttcccagggctgcccgaggctctgtcgttcgtggcgctcgtggacggctacttccggctgaccacggactcccagcacttcttctgcaaggaggtggcaccgccgaggctgctggaggaagtggccgagcagtgccacggccccatcactctggactttgccatcaacaagctcaagactgggggctcacgtcctggctcctatgttctccgccgcagcccccaggactttgacagcttcctcctcactgtctgtgtccagaacccccttggtcctgattataagggctgcctcatccggcgcagccccacaggaaccttccttctggttggcctcagccgaccccacagcagtcttcgagagctcctggcaacctgctgggatggggggctgcacgtagatggggtggcagtgaccctcacttcctgctgtatccccagacccaaagaaaagtccaacctgatcgtggtccagagaggtcacagcccacccacatcatccttggttcagccccaatcccaataccagctgagtcagatgacatttcacaagatccctgctgacagcctggagtggcatgagaacctgggccatgggtccttcaccaagatttaccggggctgtcgccatgaggtggtggatggggaggcccgaaagacagaggtgctgctgaaggtcatggatgccaagcacaagaactgcatggagtcattcctggaagcagcgagcttgatgagccaagtgtcgtaccggcatctcgtgctgctccacggcgtgtgcatggctggagacagcaccatggtgcaggaatttgtacacctgggggccatagacatgtatctgcgaaaacgtggccacctggtgccagccagctggaagctgcaggtggtcaaacagctggcctacgccctcaactatctggaggacaaaggcctgccccatggcaatgtctctgcccggaaggtgctcctggctcgggagggggctgatgggagcccgcccttcatcaagctgagtgaccctggggtcagccccgctgtgttaagcctggagatgctcaccgacaggatcccctgggtggcccccgagtgtctccgggaggcgcagacacttagcttggaagctgacaagtggggcttcggcgccacggtctgggaagtgtttagtggcgtcaccatgcccatcagtgccctggatcctgctaagaaactccaattttatgaggaccggcagcagctgccggcccccaagtggacagagctggccctgctgattcaacagtgcatggcctatgagccggtccagaggccctccttccgagccgtcattcgtgacctcaatagcctcatctcttcagactatgagctcctctcagaccccacacctggtgccctggcacctcgtgatgggctgtggaatggtgcccagctctatgcctgccaagaccccacgatcttcgaggagagacacctcaagtacatctcacagctgggcaagggcaactttggcagcgtggagctgtgccgctatgacccgctaggcgacaatacaggtgccctggtggccgtgaaacagctgcagcacagcgggccagaccagcagagggactttcagcgggagattcagatcctcaaagcactgcacagtgatttcattgtcaagtatcgtggtgtcagctatggcccgggccgccagagcctgcggctggtcatggagtacctgcccagcggctgcttgcgcgacttcctgcagcggcaccgcgcgcgcctcgatgccagccgcctccttctctattcctcgcagatctgcaagggcatggagtacctgggctcccgccgctgcgtgcaccgcgacctggccgcccgaaacatcctcgtggagagcgaggcacacgtcaagatcgctgacttcggcctagctaagctgctgccgcttgacaaagactactacgtggtccgcgagccaggccagagccccattttctggtatgcccccgaatccctctcggacaacatcttctctcgccagtcagacgtctggagcttcggggtcgtcctgtacgagctcttcacctactgcgacaaaagctgcagcccctcggccgagttcctgcggatgatgggatgtgagcgggatgtccccgccctctgccgcctcttggaactgctggaggagggccagaggctgccggcgcctcctgcctgccctgctgaggttcacgagctcatgaagctgtgctgggcccctagcccacaggaccggccatcattcagcgccctgggcccccagctggacatgctgtggagcggaagccgggggtgtgagactcatgccttcactgctcacccagagggcaaacaccactccctgtccttttcatagctcctgcccgcagacctctggattaggtctctgttgactggctgtgtgaccttaggcccggagctgcccctctctgggcctcagaggccttatgagggtcctctacttcaggaacacccccatgacattgcatttgggggggctcccgtggcctgtagaatagcctgtggcctttgcaatttgttaaggttcaagacagatgggcatatgtgtcagtggggctctctgagtcctggcccaaagaagcaaggaaccaaatttaagactctcgcatcttcccaaccccttaagccctggccccctgagtttccttttctcgtctctctctttttattttttttatttttatttttatttttgagacagagcctcgctctgttacccagggtggagtgcagtggtagcgatctcggctcacagtgcaacctctgcttcccaggttcaagcgattctcctgcctcagcctcccgagtagctgggattacaggtgtgcaccaccacacccggctaattttttttatttttaatagagatgaggtttcaccatgatggccaggctgatctcgaactcctaacctcaagtgatcctcccacctcagcctcccaaagtgttggaataataggcatgagccactgcacccaggcttttttttttttaaatttattattattatttttaagagacaggatcttgctacgttgcccaggctggtcttgaactcctgggctacagtgatcctcctgccttatcctcctaaatagctgggactacagcacctagttttgagtttcctgtcttatttccaatggggacattcatgtagctttttttttttttttttttttgagacggagtctcgctctgtcgcccaggctggagtacagtggcgcaatctaggctcactg

SEQ ID NO: 455709 - DNA, 3620 bp, Homo sapiens
  misc_feature (3)..(5): n is a, c, g, or t
  misc_feature (3549)..(3550): n is a, c, g, or t
aannngccgagtgggactttcctctcgctgcctcccggctctgcccgcccttcgaaagtccagggtccctgcccgctagaggcaagttgcactcatggcacctccaagtgaagagacgcccctgatccctcagcgttcatgcagcctcttgtccacggaggctggtgccctgcatgtgctgctgcccgctcggggccccggggcccccccagcgcctatctttctcctttggggaccacttggctgaggacctgtgcgtgcaggctgccaaggccagcggcatcctgcctgtgtaccactccctctttgctctggccacggaggacctgtcctgctggttccccccgagccacatcttctccgtggaggatgccagcacccaagtcctgctgtacaggattcgcttttacttccccaattggtttgggctggagaagtgccaccgcttcgggctacgcaaggatttggccagtgctatccttgacctgccagtcctggagcacctctttgcccagcaccgcagtgacctggtgagtgggcgcctccccgtgggcctcagtctcaaggagcagggtgagtgtctcagcctggccgtgttggacctggcccggatggcgcgagagcaggcccagcggccgggagagctgctgaagactgtcagctacaaggcctgcctacccccaagcctgcgcgacctgatccagggcctgagcttcgtgacgcggaggcgtattcggaggacggtgcgcagagccctgcgccgcgtggccgcctgccaggcagaccggcactcgctcatggccaagtacatcatggacctggagcggctggatccagccggggccgccgagaccttccacgtgggcctccctggggcccttggtggccacgacgggctggggctgctccgcgtggctggtgacggcggcatcgcctggacccagggagaacaggaggtcctccagcccttctgcgactttccagaaatcgtagacattagcatcaagcaggccccgcgcgttggcccggccggagagcaccgcctggtcactgttaccaggacagacaaccagattttagaggccgagttcccagggctgcccgaggctctgtcgttcgtggcgctcgtggacggctacttccggctgaccacggactcccagcacttcttctgcaaggaggtggcaccgccgaggctgctggaggaagtggccgagcagtgccacggccccatcactctggactttgccatcaacaagctcaagactgggggctcacgtcctggctcctatgttctccgccgcagcccccaggactttgacagcttcctcctcactgtctgtgtccagaacccccttggtcctgattataagggctgcctcatccggcgcagccccacaggaaccttccttctggttggcctcagccgaccccacagcagtcttcgagagctcctggcaacctgctgggatggggggctgcacgtagatggggtggcagtgaccctcacttcctgctgtatccccagacccaaagaaaagtccaacctgatcgtggtccagagaggtcacagcccacccacatcatccttggttcagccccaatcccaataccagctgagtcagatgacatttcacaagatccctgctgacagcctggagtggcatgagaacctgggccatgggtccttcaccaagatttaccggggctgtcgccatgaggtggtggatggggaggcccgaaagacagaggtgctgctgaaggtcatggatgccaagcacaagaactgcatggagtcattcctggaagcagcgagcttgatgagccaagtgtcgtaccggcatctcgtgctgctccacggcgtgtgcatggctggagacagcaccatggtgcaggaatttgtacacctgggggccatagacatgtatctgcgaaaacgtggccacctggtgccagccagctggaagctgcaggtggtcaaacagctggcctacgccctcaactatctggaggacaaaggcctgccccatggcaatgtctctgcccggaaggtgctcctggctcgggagggggctgatgggagcccgcccttcatcaagctgagtgaccctggggtcagccccgctgtgttaagcctggagatgctcaccgacaggatcccctgggtggcccccgagtgtctccgggaggcgcagacacttagcttggaagctgacaagtggggcttcggcgccacggtctgggaagtgtttagtggcgtcaccatgcccatcagtgccctggatcctgctaagaaactccaattttatgaggaccggcagcagctgccggcccccaagtggacagagctggccctgctgattcaacagtgcatggcctatgagccggtccagaggccctccttccgagccgtcattcgtgacctcaatagcctcatctcttcagactatgagctcctctcagaccccacacctggtgccctggcacctcgtgatgggctgtggaatggtgcccagctctatgcctgccaagaccccacgatcttcgaggagagacacctcaagtacatctcacagctgggcaagggcaactttggcagcgtggagctgtgccgctatgacccgctaggcgacaatacaggtgccctggtggccgtgaaacagctgcagcacagcgggccagaccagcagagggactttcagcgggagattcagatcctcaaagcactgcacagtgatttcattgtcaagtatcgtggtgtcagctatggcccgggccgccagagcctgcggctggtcatggagtacctgcccagcggctgcttgcgcgacttcctgcagcggcaccgcgcgcgcctcgatgccagccgcctccttctctattcctcgcagatctgcaagggcatggagtacctgggctcccgccgctgcgtgcaccgcgacctggccgcccgaaacatcctcgtggagagcgaggcacacgtcaagatcgctgacttcggcctagctaagctgctgccgcttgacaaagactactacgtggtccgcgagccaggccagagccccattttctggtatgcccccgaatccctctcggacaacatcttctctcgccagtcagacgtctggagcttcggggtcgtcctgtacgagctcttcacctactgcgacaaaagctgcagcccctcggccgagttcctgcggatgatgggatgtgagcgggatgtccccgccctctgccgcctcttggaactgctggaggagggccagaggctgccggcgcctcctgcctgccctgctgaggtgagcgccgcagggctagcctcagtttcccagtctgtagattgggccggggtctcgggcaagccagctggcgcctgagtctctgtactgagaagaaaggctagagtgtgaggccgatgaggatcctggcccccacttggctactctctcactgtggcaagtcagagcactttcagagcctcagtttacccttttccaaaatgagaatagtaatgccttatagggtgagggaagattagactcctgnncacctgtgcctatgagggctcagctcaaagccgagcacacagtcgatgctccataaatggtggtgacgtt

SEQ ID NO: 455710 - DNA, 913 bp, Homo sapiens
cgatctctgtttctctggaggaagccaaggacaagagcagttgctgtggctgggactctgccttttaggggagcccgtgtatctctttgggatcctgaaagggggcaggaaaggctggggtcccagtccaccctaatggtatctgagtgtcctagggcttcagttttcccacctgtccaatgggaccctttctgtcctcaccctacaaggggcacaaagggatgacaccaaacctggcaggaacttttcacgcaatcaagggaaggaaaggcattcctggcagagggaacagcatgccaagcgtgagaaggctcagagtaaggaggttaagagcccaagtattggagcctacagttttgccccttccatgcagtgtgacagtgggcaagttcctttccctctctgggtctcagttctgtcccctgcaaaatggtcagagcttaccccttggctgtgcagggtcaactttctgactggtgagagggattctcatgcaggttaagcttctgctgctcctcctcacctgcaaagcttttctgccacttttgcctccttggaaaactcttatccatctctcaaaactccagctaccacatccttgcagccttccctcatatacccccactactactgtagccctgtccttccctccagccccactctggccctggggctggggaagtgtctgtgtccagctgtctcccctgacctcagggttccttgggggctgggctgaggcctcagtacagagggggctctggaaatgtttgttgactgaataaaggaattcagtggaaaaaaaaaaataggaaataaaagatctcggaaaatagcattttgttaaaaccttggggggtaaaaccccggggagttttaacggaaaaattccagggaacacaacttgggggccaaa

SEQ ID NO: 455711 - DNA, 767 bp, Homo sapiens
gactgaggggctttttctctctgtgccccaggcaagttgcactcatggcacctccaagtgaagagacgcccctgatccctcagcgttcatgcagcctcttgtccacggaggctggtgccctgcatgtgctgctgcccgctcggggccccggggcccccccagcgcctatctttctcctttggggaccacttggctgaggacctgtgcgtgcaggctgccaaggccagcggcatcctgcctgtgtaccactccctctttgctctggccacggaggacctgtcctgctggttccccccgagccacatcttctccgtggaggatgccagcacccaagtcctgctgtacaggattcgccttttacttccccaattggaatagggctggcagaagtggcaccggattcggggactacgacaaagggaatttgggccaagtggctaatcccttgaaccatgccaagtacctgggaagccaccctcctaatggcccagacaccggcacgtgaacctgggttgagataggagcgccatcaccccgatgggccctcaaattctccaaagggagcaaggcgtgagtggtctcgagcactgggaccgaagtacggaacctggcccccggaatgggacgcgagaagcaggcacacagaggcccgggaagaagctggctggaaagaaccaggtcaagcaaacaaggggcctgagcctaaccccacaaaggccctgacgcgaaacctggaatcccagggggccctggagccatacagatga

SEQ ID NO: 455712 - DNA, 2204 bp, Homo sapiens
gactgaggggctttttctctctgtgccccaggcaagttgcactcattatggaattccggcggcccgctaggcaagttgcactcatggcacctccaagtgaagagacgcccctgatccctcagcgttcatgcagcctcttgtccacggaggctggtgccctgcatgtgctgctgcccgctcggggccccggggcccccccagcgcctatctttctcctttggggaccacttggctgaggacctgtgcgtgcaggctgccaaggccagcggcatcctgcctgtgtaccactccctctttgctctggccacggaggacctgtcctgctggttccccccgagccacatcttctccgtggaggatgccagcacccaagtcctgctgtacaggattcgcttttacttccccaattggtttgggctggagaagtgccaccgcttcgggctacgcaaggatttggccagtgctatccttgacctgccagtcctggagcacctctttgcccagcaccgcagtgacctggtgagtgggcgcctccccgtgggcctcagtctcaaggagcagggtgagtgtctcagcctggccgtgttggacctggcccggatggcgcgagagcaggcccagcggccgggagagctgctgaagactgtcagctacaaggcctgcctacccccaagcctgcgcgacctgatccagggcctgagcttcgtgacgcggaggcgtattcggaggacggtgcgcagagccctgcgccgcgtggccgcctgccaggcagaccggcactcgctcatggccaagtacatcatggacctggagcggctggatccagccggggccgccgagaccttccacgtgggcctccctggggcccttggtggccacgacgggctggggctgctccgcgtggctggtgacggcggcatcgcctggacccagggagaacaggaggtcctccagcccttctgcgactttccagaaatcgtagacattagcatcaagcaggccccgcgcgttggcccggccggagagcaccgcctggtcactgttaccaggacagacaaccagattttagaggccgagttcccagggctgcccgaggctctgtcgttcgtggcgctcgtggacggctacttccggctgaccacggactcccagcacttcttctgcaaggaggtggcaccgccgaggctgctggaggaagtggccgagcagtgccacggccccatcactctggactttgccatcaacaagctcaagactgggggctcacgtcctggctcctatgttctccgccgcagcccccaggactttgacagcttcctcctcactgtctgtgtccagaacccccttggtcctgattataagggctgcctcatccggcgcagccccacaggaaccttccttctggttggcctcagccgaccccacagcagtcttcgagagctcctggcaacctgctgggatggggggctgcacgtagatggggtggcagtgaccctcacttcctgctgtatccccagacccaaaggtgagccccttcctcccctggaatgagtggctgatctgggaccctggctttctatgtctgtgacagctcctgtgtgggtggcaagtggcagaaactgcaggtcaaggtgggttagggaagaaaaggtgatttgttggctcaggaagttagagatatataacctttaggtctggcttgatctaggcacagctagatgtgagccatgtcatctgcacctagtctctctccagctctcagctcttcctctgggtgaatttcactcctggacaaacccctctgatgggacaattctgagatgtgagttcttctgagtctcccagaatccctggtagaaccgatccctggttgtccacagtgccacttgctcattaaagccccctgcagggctccttccttccttgtcgctcatcccaaatccctatgggggctttctggatctcctttcaaataaaccatgtgccagccaggcacagtggctcacgtctgtaataccagcacttcgggaggctgaggcagatggatcacctgaggtcaggagtttgagaccagcgtggccaacatggcgaaactccatctctactaaaaatacaaaaattagctgggtgtgctggcacactcctgtagtcccagctacttgggaggctgaggcaggagaattacttgaacccagagagccgga

SEQ ID NO: 455713 - DNA, 314 bp, Homo sapiens
gactgaggggctttttctctctgtgccccaggcaagttgcactcatggcacctccaagtgaagagacgcccctgatccctcagcgttcatgcagcctcttgtccacggaggctggtgccctgcatgtgctgctgcccgctcggggccccggggcccccccagcgcctatctttctcctgtggggtccctgtccgacctgtgggcgccaatggccctcccctgacctcagggttccttgggggctgggctgaggcctcagtacagagggggctctggaaatgtttgttgactgaataaaggaattcagtggaaaa

SEQ ID NO: 455714 - DNA, 297 bp, Homo sapiens
gagattcagatcctcaaagcactgcacagtgatttcattgtcaagtatcgtggtgtcagctatggcccgggtgagccagctcccggatgagtgaaccaagacgtatgggtgcttttcaaagtgcacattcttaccctcctgccaggccactttaggtaggctgggaacgtgattattgatccagattcacatgggttacaggtttgaatcctgactctaccccttaccagttgtgaaaccttaacttttctgagcctcagtttctccagctgaaaaatgggccattgtgatatttac

SEQ ID NO: 455715 - DNA, 775 bp, Homo sapiens
gctgagatcgcaccactgcccacccagcctggatgacagagtgagactccgtctcaacagcagcagcaacaacaaaacaaaaacaacaacaaaaagccatgtgccctgaagtcttcatctcagggtcggcttctagagggtacctcaaactaaggcatgagttagctaacccttggggacttttcacctctgatttctggtttttctccctcatcctctccccatagaaaagtccaacctgatcgtggtccagagaggtcacagcccacccacatcatccttggttcagccccaatcccaataccagctgagtcagatgacatttcacaagatccctgctgacagcctggagtggcatgagaacctgggccatgggtccttcaccaagatttaccggggctgtcgccatgaggtggtggatggggaggcccgaaagacagaggtgctgctgaaggtcatggatgccaagcacaagaactgcatggagtcattcctggaagcagcgagcttgatgagccaagtgtcgtaccggcatctcgtgctgctccacggcgtgtgcatggctggagacagtgagaagccccacgaaaagacaaaaacacacaacacataacgcaaccacagattctgtcgtcacgagatactgttatgacatgtaatactaacgagaaggcaataatagaaccacagagagaaacgggcagaggccagtgtacataaagaattacacaaacacaatcaacaggacataacaatagaacagaaataacgcaca

SEQ ID NO: 455716 - DNA, 4649 bp, Homo sapiens
gactgaggggctttttctctctgtgccccaggcaagttgcactcattatggaattccggcggcccgctaggcaagttgcactcatggcacctccaagtgaagagacgcccctgatccctcagcgttcatgcagcctcttgtccacggaggctggtgccctgcatgtgctgctgcccgctcggggccccggggcccccccagcgcctatctttctcctttggggaccacttggctgaggacctgtgcgtgcaggctgccaaggccagcggcatcctgcctgtgtaccactccctctttgctctggccacggaggacctgtcctgctggttccccccgagccacatcttctccgtggaggatgccagcacccaagtcctgctgtacaggattcgcttttacttccccaattggtttgggctggagaagtgccaccgcttcgggctacgcaaggatttggccagtgctatccttgacctgccagtcctggagcacctctttgcccagcaccgcagtgacctggtgagtgggcgcctccccgtgggcctcagtctcaaggagcagggtgagtgtctcagcctggccgtgttggacctggcccggatggcgcgagagcaggcccagcggccgggagagctgctgaagactgtcagctacaaggcctgcctacccccaagcctgcgcgacctgatccagggcctgagcttcgtgacgcggaggcgtattcggaggacggtgcgcagagccctgcgccgcgtggccgcctgccaggcagaccggcactcgctcatggccaagtacatcatggacctggagcggctggatccagccggggccgccgagaccttccacgtgggcctccctggggcccttggtggccacgacgggctggggctgctccgcgtggctggtgacggcggcatcgcctggacccagggagaacaggaggtcctccagcccttctgcgactttccagaaatcgtagacattagcatcaagcaggccccgcgcgttggcccggccggagagcaccgcctggtcactgttaccaggacagacaaccagattttagaggccgagttcccagggctgcccgaggctctgtcgttcgtggcgctcgtggacggctacttccggctgaccacggactcccagcacttcttctgcaaggaggtggcaccgccgaggctgctggaggaagtggccgagcagtgccacggccccatcactctggactttgccatcaacaagctcaagactgggggctcacgtcctggctcctatgttctccgccgcagcccccaggactttgacagcttcctcctcactgtctgtgtccagaacccccttggtcctgattataagggctgcctcatccggcgcagccccacaggaaccttccttctggttggcctcagccgaccccacagcagtcttcgagagctcctggcaacctgctgggatggggggctgcacgtagatggggtggcagtgaccctcacttcctgctgtatccccagacccaaagaaaagtccaacctgatcgtggtccagagaggtcacagcccacccacatcatccttggttcagccccaatcccaataccagctgagtcagatgacatttcacaagatccctgctgacagcctggagtggcatgagaacctgggccatgggtccttcaccaagatttaccggggctgtcgccatgaggtggtggatggggaggcccgaaagacagaggtgctgctgaaggtcatggatgccaagcacaagaactgcatggagtcattcctggaagcagcgagcttgatgagccaagtgtcgtaccggcatctcgtgctgctccacggcgtgtgcatggctggagacagcaccatggtgcaggaatttgtacacctgggggccatagacatgtatctgcgaaaacgtggccacctggtgccagccagctggaagctgcaggtggtcaaacagctggcctacgccctcaactatctggaggacaaaggcctgccccatggcaatgtctctgcccggaaggtgctcctggctcgggagggggctgatgggagcccgcccttcatcaagctgagtgaccctggggtcagccccgctgtgttaagcctggagatgctcaccgacaggatcccctgggtggcccccgagtgtctccgggaggcgcagacacttagcttggaagctgacaagtggggcttcggcgccacggtctgggaagtgtttagtggcgtcaccatgcccatcagtgccctggatcctgctaagaaactccaattttatgaggaccggcagcagctgccggcccccaagtggacagagctggccctgctgattcaacagtgcatggcctatgagccggtccagaggccctccttccgagccgtcattcgtgacctcaatagcctcatctcttcagactatgagctcctctcagaccccacacctggtgccctggcacctcgtgatgggctgtggaatggtgcccagctctatgcctgccaagaccccacgatcttcgaggagagacacctcaagtacatctcacagctgggcaagggcaactttggcagcgtggagctgtgccgctatgacccgctaggcgacaatacaggtgccctggtggccgtgaaacagctgcagcacagcgggccagaccagcagagggactttcagcgggagattcagatcctcaaagcactgcacagtgatttcattgtcaagtatcgtggtgtcagctatggcccgggccgccagagcctgcggctggtcatggagtacctgcccagcggctgcttgcgcgacttcctgcagcggcaccgcgcgcgcctcgatgccagccgcctccttctctattcctcgcagatctgcaagggcatggagtacctgggctcccgccgctgcgtgcaccgcgacctggccgcccgaaacatcctcgtggagagcgaggcacacgtcaagatcgctgacttcggcctagctaagctgctgccgcttgacaaagactactacgtggtccgcgagccaggccagagccccattttctggtatgcccccgaatccctctcggacaacatcttctctcgccagtcagacgtctggagcttcggggtcgtcctgtacgagctcttcacctactgcgacaaaagctgcagcccctcggccgtgagtcggcttcccagagcccccagccttcttctccctccacgcccctcgtggccagtctccaacctgtctgcgcctgcgtccctctttagcatggggtcacctggtcccagcatcataggccccagtggggaggacgcttcctcacctttctgaccccttcacggttcaggcagcccctccccgctccatcacagatggcccctacccccaccacgggtggcccctccccctccacccacggaggctcctcccccaccacatgcgctcctccttggctccaggagttcctgcggatgatgggatgtgagcgggatgtccccgccctctgccgcctcttggaactgctggaggagggccagaggctgccggcgcctcctgcctgccctgctgaggttcacgagctcatgaagctgtgctgggcccctagcccacaggaccggccatcattcagcgccctgggcccccagctggacatgctgtggagcggaagccgggggtgtgagactcatgccttcactgctcacccagagggcaaacaccactccctgtccttttcatagctcctgcccgcagacctctggattaggtctctgttgactggctgtgtgaccttaggcccggagctgcccctctctgggcctcagaggccttatgagggtcctctacttcaggaacacccccatgacattgcatttgggggggctcccgtggcctgtagaatagcctgtggcctttgcaatttgttaaggttcaagacagatgggcatatgtgtcagtggggctctctgagtcctggcccaaagaagcaaggaaccaaatttaagactctcgcatcttcccaaccccttaagccctggccccctgagtttccttttctcgtctctctctttttattttttttatttttatttttatttttgagacagagcctcgctctgttacccagggtggagtgcagtggtagcgatctcggctcacagtgcaacctctgcttcccaggttcaagcgattctcctgcctcagcctcccgagtagctgggattacaggtgtgcaccaccacacccggctaattttttttatttttaatagagatgaggtttcaccatgatggccaggctgatctcgaactcctaacctcaagtgatcctcccacctcagcctcccaaagtgttggaataataggcatgagccactgcacccaggcttttttttttttaaatttattattattatttttaagagacaggatcttgctacgttgcccaggctggtcttgaactcctgggctacagtgatcctcctgccttatcctcctaaatagctgggactacagcacctagttttgagtttcctgtcttatttccaatggggacattcatgtagctttttttttttttttttttttgagacggagtctcgctctgtcgcccaggctggagtacagtggcgcaatctaggctcactg

SEQ ID NO: 455717 - DNA, 172 bp, Homo sapiens
aaaaaaaggaagaaggactgagaaggagagtgtctgtcgctcagtcccactcaggggccactcttctttgcagaacccccttggtcctgattataagggctgcctcatccggcgcagccccacaggaaccttccttctggttggcctcagccgaccccacagcagtcttcga

SEQ ID NO: 455718 - DNA, 1143 bp, Homo sapiens
agcgggccttccctccgcccacccgggaaaccggaagccgcctcccacttggttgctcgtacgcggctagtgggtcctcagtggatgtaggctgggcgccgcgatgttcgacgggacaccggcggagagcgacctcggggttaaggggtggggctgacgtcaggagccaagatggcggcggtggtcgcactctccttgaggcgccggttgccggccacaacccttggcggagcctgcctgcaggcctcccgaggagcccagacagctgcagccacagctccccgtatcaagaaatttgccatctatcgatgggacccagacaaggctggagacaaacctcatatgcagacttatgaagttgaccttaataaatgtggccccatggtattggatgctttaatcaagattaagaatgaagttgactctactttgaccttccgaagatcatgcagagaaggcatctgtggctcttgtgcaatgaacatcaatggaggcaacactctagcttgcacccgaaggattgacaccaacctcaataaggtctcaaaaatctaccctcttccacacatgtatgtgataaaggatcttgttcccgatttgagcaacttctatgcacagtacaaatccattgagccttatttgaagaagaaggatgaatctcaggaaggcaagcagcagtatctgcagtccatagaagagcgtgagaaactggacgggctctacgagtgcattctctgtgcctgctgtagcaccagctgccccagctactggtggaacggagacaaatatctggggcctgcagttcttatgcaggcctatcgctggatgattgactccagagatgacttcacagaggagcgcctggccaagctgcaggacccattctctctataccgctgccacaccatcatgaactgcacaaggacctgtcctaagggtctgaatccagggaaagctattgcagagatcaagaaaatgatggcaacctataaggagaagaaagcttcagtttaactgtttccatgctaaacatgatttataaccagctcagagctgaacataatttatatctaatttgagttcctttaaagatcttggttttccatgaatacagcatgtataataaaaattttaagaaataaa

SEQ ID NO: 455719 - DNA, 760 bp, Homo sapiens
gtgcctcctgcaaagcagatgttaacagctgtaggggcaaactgcagctaataccaatggtattggccagttgaaatcatcatggttttacaaagggttaatagagagggtagtttcttccacatacttttgagagctggtatatgctgatttctgctgctgcctatttaataatgatgatgtaaaagatttagagatgtctggctgattttgacattggcctgtagtcctagaagagacactaccctgagtgtctttgagcagtcagagagtgcacctctgccctgggcctgtttacctgttagagtgagccacacaagaaggaattcaacgtggcagagctcttgccagagggagctgaccatcttcaaatgttaaaaaaggtagacagaagagagcccttagcccaacccctatggttttgagggacttgatttgcattcaccttgcttggacactgaaccagctgaggaaggagtttcacccaagattgtgggttttccctttcagtttcagttatcatttgttattgattcttttctcttttttcaagggtctgaatccagggaaagctattgcagagatcaagaaaatgatggcaacctataaggagaagaaagcttcagtttaactgtttccatgctaaacatgatttataaccagctcagagctgaacataatttatatctaatttgagttcctttaaagatcttggttttccatgaatacagcatgtataataaaaattttaagaaataaa

SEQ ID NO: 455720 - DNA, 1785 bp, Homo sapiens
agcgggccttccctccgcccacccgggaaaccggaagccgcctcccacttggttgctcgtacgcggctagtgggtcctcagtggatgtaggctgggcgccgcgatgttcgacgggacaccggcggagagcgacctcggggttaaggggtggggctgacgtcaggagccaagatggcggcggtggtcgcactctccttgaggcgccggttgccggccacaacccttggcggagcctgcctgcaggcctcccgaggagcccagacagctgcagccacagctccccgtatcaagaaatttgccatctatcgatgggacccagacaaggctggagacaaacctcatatgcagacttatgaagttgaccttaataaatgtggccccatggtattggatgctttaatcaagattaagaatgaagttgactctactttgaccttccgaagatcatgcagagaaggcatctgtggctcttgtgcaatgaacatcaatggaggcaacactctagcttgcacccgaaggattgacaccaacctcaataaggtctcaaaaatctaccctcttccacacatgtatgtgataaaggatcttgttcccgatttgagcaacttctatgcacagtacaaatccattgagccttatttgaagaagaaggatgaatctcaggaaggcaagcagcagtatctgcagtccatagaagagcgtgagaaactggacgggctctacgagtgcattctctgtgcctgctgtagcaccagctgccccagctactggtggaacggagacaaatatctggggcctgcagttcttatgcaggcctatcgctggatgattgactccagagatgacttcacagaggagcgcctggccaagctgcaggacccattctctctataccgctgccacaccatcatgaactgcacaaggacctgtcctaagggtctgaatccagggaaagctattgcagagatcaagaaaatgatggcaacctataaggagaagaaagcttcagtttaactgtttccatgctaaacatgatttataaccagctcagagctgaacataatttatatctaatttgagttcctttaaagatcttggttttccatgaatacagcatgtataataaaaattttaagaaataaaaaaaaaaaaaaaagaaaaaaaaaaaaaaaaaaaaaaaaaaaaaaaaaaaaaaaaaaaagaacagaaaaaaagaaaaaaaaaaaacaaaaaaaaaaaaaaaaaaagaaaaaaaaaacaaaaaaaaaaaaagaagaggaggcgggcgcggcggcgcgccacctacactactcatcgacgcgcggggcgggaacataagcgacccgccccagttttttgtgatagagcgcggcgccctagtactgtggattttttataatagcgagagcggcggcgcgagctatacaaaacaaagcacgaagggaggggggaaagccaccgcgacagcgacggtcgacacatcagaagaaaagaaacaaaccacatcctggggggggcaatgaaagaagagaggaggggacaacacaaccacaacacaataagaaactgtctggcggagataatcaaacaaacctgacagctcaggagaatcagaacgaaatacacccgcaacagatatcgtcgggtaagagaaaaaaacaagtcaggaacacgcgaatcaaagaaagacaaaaaaatatatagaaggaggaggacaaaaaataaagaaacaagaggtgagcgacaccgagagaaagcgggagcggtatcctgcagggagtagaa

SEQ ID NO: 455721 - DNA, 1226 bp, Homo sapiens
atttcataggtcatttttgtaattccaggcaaggtctttgcagggcctcctgagggcaacagaaaatagaagagccccaaggcctccccttccttgtgggaatgtacatgtatacccacaaaagccacctcaaaagaattcagtaatgagcttggtgtgttacctgtgggtaacattcaggttcaggttctgaattctttttatgcttatagtctgaccactgaaccacaattctgcctgcctcccgaggagcccagacagctgcagccacagctccccgtatcaagaaatttgccatctatcgatgggacccagacaaggctggagacaaacctcatatgcagacttatgaagttgaccttaataaatgtggccccatggtattggatgctttaatcaagattaagaatgaagttgactctactttgaccttccgaagatcatgcagagaaggcatctgtggctcttgtgcaatgaacatcaatggaggcaacactctagcttgcacccgaaggattgacaccaacctcaataaggtctcaaaaatctaccctcttccacacatgtatgtgataaaggatcttgttcccgatttgagcaacttctatgcacagtacaaatccattgagccttatttgaagaagaaggatgaatctcaggaaggcaagcagcagtatctgcagtccatagaagagcgtgagaaactggacgggctctacgagtgcattctctgtgcctgctgtagcaccagctgccccagctactggtggaacggagacaaatatctggggcctgcagttcttatgcaggcctatcgctggatgattgactccagagatgacttcacagaggagcgcctggccaagctgcaggacccattctctctataccgctgccacaccatcatgaactgcacaaggacctgtcctaagggtctgaatccagggaaagctattgcagagatcaagaaaatgatggcaacctataaggagaagaaagcttcagtttaactgtttccatgctaaacatgatttataaccagctcagagctgaacataatttatatctaatttgagttcctttaaagatcttggttttccatgaatacagcatgtataataaaaattttaagaaataaatgttattctactttattaacaaaaaaacctaataaaaatctttcaggggggggcccggttccccaaattccgccttttggggagtca

SEQ ID NO: 455722 - DNA, 1092 bp, Homo sapiens
tatttcttaaaatttttattatacatgctgtattcatggaaaaccaagatctttaaaggaactcaaattagatataaattatgttcagctctgagctggttataaatcatgtttagcatggaaacagttaaactgaagctttcttctccttataaatttgccatctatcgatgggacccagacaaggctggagacaaacctcatatgcagacttatgaagttgaccttaataaatgtggccccatggtattggatgctttaatcaagattaagaatgaagttgactctactttgaccttccgaagatcatgcagagaaggcatctgtggctcttgtgcaatgaacatcaatggaggcaacactctagcttgcacccgaaggattgacaccaacctcaataaggtctcaaaaatctaccctcttccacacatgtatgtgataaaggatcttgttcccgatttgagcaacttctatgcacagtacaaatccattgagccttatttgaagaagaaggatgaatctcaggaaggcaagcagcagtatctgcagtccatagaagagcgtgagaaactggacgggctctacgagtgcattctctgtgcctgctgtagcaccagctgccccagctactggtggaacggagacaaatatctggggcctgcagttcttatgcaggcctatcgctggatgattgactccagagatgacttcacagaggagcgcctggccaagctgcaggacccattctctctataccgctgccacaccatcatgaactgcacaaggacctgtcctaagggtctgaatccagggaaagctattgcagagatcaagaaaatgatggcaacctataaggagaagaaagcttcagtttaactgtttccatgctaaacatgatttataaccagctcagagctgaacataatttatatctaatttgagttcctttaaagatcttggttttccatgaatacagcatgtataataaaaattttaagaaataaatgttattctactttattaacaaaaaaacctaataaaaatctttcaggggggggcccggttccccaaattccgccttttggggagtca

SEQ ID NO: 455723 - DNA, 954 bp, Homo sapiens
agcgggccttccctccgcccacccgggaaaccggaagccgcctcccacttggttgctcgtacgcggctagtgggtcctcagtggatgtaggctgggcgccgcgatgttcgacgggacaccggcggagagcgacctcggggttaaggggtggggctgacgtcaggagccaagatggcggcggtggtcgcactctccttgaggcgccggttgccggccacaacccttggcggagcctgcctgcaggcctcccgaggagcccagacagctgcagccacagctccccgtatcaagaaatttgccatctatcgatgggacccagacaaggctggagacaaacctcatatgcagacttatgaagttgaccttaataaatgtggccccatggtattggatgctttaatcaagattaagaatgaagttgactctactttgaccttccgaagatcatgcagagaaggtgagcatttcattcctgttgggctccagatacttgtggtcttccaaagaggcttgggctggccaaagctgatagagacatctggaaaacagctgcagctctctgctgggtgaacttgctgtgcaacctaattccttttcttgggtaaatgcatccaaaattctaaccgtggtgcaagttctggtttctgagtttactttccttcaggagcattctatcctgtggttactgcatctggcggtccctgtgagctgctccacgcttcaaggcctagctaggacctgctggctggcaccttccatgctgctgagctcttttattaagggagcagtggagagtttctgtctggcacttatgcttgtccagcaggggagatgtgtgagtctccctcagctcccagcatgacatgtccttggtagctgtgttctggattggctggtacagtgtctccctcagcatgtggttacttgtgctgctggtgccacatgagcccattt

SEQ ID NO: 455724 - DNA, 847 bp, Homo sapiens
gtgcctcctgcaaagcagatgttaacagctgtaggggcaaactgcagctaataccaatggtattggccagttgaaatcatcatggttttacaaagggttaatagagagggtagtttcttccacatacttttgagagctggtatatgctgatttctgctgctgcctatttaataatgatgatgtaaaagatttagagatgtctggctgattttgacattggcctgtagtcctagaagagacactaccctgagtgtctttgagcagtcagagagtgcacctctgccctgggcctgtttacctgttagagtgagccacacaagaaggaattcaacgtggcagagctcttgccagagggagctgaccatcttcaaatgttaaaaaaggtagacagaagagagcccttagcccaacccctatggttttgagggacttgatttgcattcaccttgcttggacactgaaccagctgaggaaggagtttcacccaagattgtgggttttccctttcagtttcagttatcatttgttattgattcttttctcttttttcaagggtctgaatccagggaaagctattgcagagatcaagaaaatgatggcaacctataaggagaagaaagcttcagtttaactgtttccatgctaaacatgatttataaccagctcagagctgaacataatttatatctaatttgagttcctttaaagatcttggttttccatgaatacagcatgtataataaaaattttaagaaataaatgttattctactttattaacaaaaaaacctaataaaaatctttcaggggggggcccggttccccaaattccgccttttggggagtca

SEQ ID NO: 455725 - DNA, 286 bp, Homo sapiens
cactgtgatcatcaaaatagaactgtgcagtacttaaaatgtaagaatctgcaaaaacaaaactacagaacaaattccgaaggtgacctgagaagaccaaatggataagctaatacatccaggtgtctccgattatattatgataaagtgtagggaggttgaacgttacataaataccactggatatttttctttgttagatgtggccccatggtattggatgctttaatcaagattaagaatgaagttgactctactttgaccttccgaagatcatgcagagaag

SEQ ID NO: 455726 - DNA, 1230 bp, Homo sapiens
agcgggccttccctccgcccacccgggaaaccggaagccgcctcccacttggttgctcgtacgcggctagtgggtcctcagtggatgtaggctgggcgccgcgatgttcgacgggacaccggcggagagcgacctcggggttaaggggtggggctgacgtcaggagccaagatggcggcggtggtcgcactctccttgaggcgccggttgccggccacaacccttggcggagcctgcctgcaggcctcccgaggagcccagacagctgcagccacagctccccgtatcaagaaatttgccatctatcgatgggacccagacaaggctggagacaaacctcatatgcagacttatgaagttgaccttaataaatgtggccccatggtattggatgctttaatcaagattaagaatgaagttgactctactttgaccttccgaagatcatgcagagaaggcatctgtggctcttgtgcaatgaacatcaatggaggcaacactctagcttgcacccgaaggattgacaccaacctcaataaggtctcaaaaatctaccctcttccacacatgtatgtgataaaggatcttgttcccgatttgagcaacttctatgcacagtacaaatccattgagccttatttgaagaagaaggatgaatctcaggaaggcaagcagcagtatctgcagtccatagaagagcgtgagaaactggacgggctctacgagtgcattctctgtgcctgctgtagcaccagctgccccagctactggtggaacggagacaaatatctggggcctgcagttcttatgcaggcctatcgctggatgattgactccagagatgacttcacagaggagcgcctggccaagctgcaggacccattctctctataccgctgccacaccatcatgaactgcacaaggacctgtcctaagggtctgaatccagggaaagctattgcagagatcaagaaaatgatggcaacctataaggagaagaaagcttcagtttaactgtttccatgctaaacatgatttataaccagctcagagctgaacataatttatatctaatttgagttcctttaaagatcttggttttccatgaatacagcatgtataataaaaattttaagaaataaatgttattctactttattaacaaaaaaacctaataaaaatctttcaggggggggcccggttccccaaattccgccttttggggagtca

SEQ ID NO: 455727 - DNA, 1326 bp, Homo sapiens
agcgggccttccctccgcccacccgggaaaccggaagccgcctcccacttggttgctcgtacgcggctagtgggtcctcagtggatgtaggctgggcgccgcgatgttcgacgggacaccggcggagagcgacctcggggttaaggggtggggctgacgtcaggagccaagatggcggcggtggtcgcactctccttgaggcgccggttgccggccacaacccttggcggagcctgcctgcagtagggacggggtttcaccatgttggctgggctggtcttgaatccctgatctcaggtgatttcccaacctcagcctcccaaagtgctgggattacaggcctcccgaggagcccagacagctgcagccacagctccccgtatcaagaaatttgccatctatcgatgggacccagacaaggctggagacaaacctcatatgcagacttatgaagttgaccttaataaatgtggccccatggtattggatgctttaatcaagattaagaatgaagttgactctactttgaccttccgaagatcatgcagagaaggcatctgtggctcttgtgcaatgaacatcaatggaggcaacactctagcttgcacccgaaggattgacaccaacctcaataaggtctcaaaaatctaccctcttccacacatgtatgtgataaaggatcttgttcccgatttgagcaacttctatgcacagtacaaatccattgagccttatttgaagaagaaggatgaatctcaggaaggcaagcagcagtatctgcagtccatagaagagcgtgagaaactggacgggctctacgagtgcattctctgtgcctgctgtagcaccagctgccccagctactggtggaacggagacaaatatctggggcctgcagttcttatgcaggcctatcgctggatgattgactccagagatgacttcacagaggagcgcctggccaagctgcaggacccattctctctataccgctgccacaccatcatgaactgcacaaggacctgtcctaagggtctgaatccagggaaagctattgcagagatcaagaaaatgatggcaacctataaggagaagaaagcttcagtttaactgtttccatgctaaacatgatttataaccagctcagagctgaacataatttatatctaatttgagttcctttaaagatcttggttttccatgaatacagcatgtataataaaaattttaagaaataaatgttattctactttattaacaaaaaaacctaataaaaatctttcaggggggggcccggttccccaaattccgccttttggggagtca

SEQ ID NO: 455728 - DNA, 1097 bp, Homo sapiens
agcgggccttccctccgcccacccgggaaaccggaagccgcctcccacttggttgctcgtacgcggctagtgggtcctcagtggatgtaggctgggcgccgcgatgttcgacgggacaccggcggagagcgacctcggggttaaggggtggggctgacgtcaggagccaagatggcggcggtggtcgcactctccttgaggcgccggttgccggccacaacccttggcggagcctgcctgcaggcctcccgaggagcccagacagctgcagccacagctccccgtatcaagaaatttgccatctatcgatgggacccagacaaggctggagacaaacctcatatgcagacttatgaagttgaccttaataaatgtggccccatggtattggatgctttaatcaagattaagaatgaagttgactctactttgaccttccgaagatcatgcagagaaggcatctgtggctcttgtgcaatgaacatcaatggaggcaacactctagcttgcacccgaaggattgacaccaacctcaataaggtctcaaagatttgagcaacttctatgcacagtacaaatccattgagccttatttgaagaagaaggatgaatctcaggaaggcaagcagcagtatctgcagtccatagaagagcgtgagaaactggacgggctctacgagtgcattctctgtgcctgctgtagcaccagctgccccagctactggtggaacggagacaaatatctggggcctgcagttcttatgcaggcctatcgctggatgattgactccagagatgacttcacagaggagcgcctggccaagctgcaggacccattctctctataccgctgccacaccatcatgaactgcacaaggacctgtcctaagggtctgaatccagggaaagctattgcagagatcaagaaaatgatggcaacctataaggagaagaaagcttcagtttaactgtttccatgctaaacatgatttataaccagctcagagctgaacataatttatatctaatttgagttcctttaaagatcttggttttccatgaatacagcatgtataataaaaattttaagaaataaa

SEQ ID NO: 455729 - DNA, 502 bp, Homo sapiens
agccggcgccattttgaaagtggagtcgcctgcccctgccgctgccgccgccgccgtcgctgtcgtagtcgccgccgccgctgccggagaaagagcacgagcggggaagccccagagtgaaatctagcatcctgccggctggtctgcccgcccctccttcctttttccggccttcgtgaaacgcgcttcatcgttgatctgccatccccatctggcttatactggcgagtatggcatatggatcttatgtcagtctgctgcttttgctaatatctgtgcatgaccctagtaaggcacatacttggtagcccttttgccctacatagaagtgttgaaattgtgcttctcaactcaccccacagtacggctacagcaccgcaggcgagcgatgcttgttttcccaaaggaaagttgacctcgggctagcctttcctggcaagctggataaataagaaacacgaatgctcctccgggccatcggcgcacacgatgccacggaatc

SEQ ID NO: 455730 - DNA, 2368 bp, Homo sapiens
agccggcgccattttgaaagtggagtcgcctgcccctgccgctgccgccgccgccgtcgctgtcgtagtcgccgccgccgctgccggagaaagagcacgagcggggaagccccagagtgaaatctagcatcctgccggctggtctgcccgcccctccttccttttccccccggcccccgtcccctccccccgcaggtgccatccgccgccatccgccctctctacccccccatccccaggtgaggggggtgagttcaggaagcggagaccccgaggaacccagcagggtcaccatttgcagcgcaacatggcaggagctggaggagggaatgatattcagtggtgtttttctcaggtgaaaggagcagtagatgatgatgtagcagaagcagatataatttctacagtagaatttaatcattctggagaattactagcaacaggagataaaggtggtagagttgtcatctttcaacaggagcaggagaacaaaatccagtctcatagcagaggagaatataatgtttacagcaccttccagagccatgaaccagagtttgactacttgaaaagtttagaaatagaagaaaagatcaacaaaattaggtggttaccccagaaaaatgctgctcagtttttattgtctaccaatgataaaacaataaaattatggaaaatcagtgaaagggacaaaagaccagaagggtataacttgaaagaggaggatggaaggtatagagatcctactacagttactacactacgagtgccagtctttaggcctatggatctaatggttgaggccagtccacgaagaatatttgccaatgctcatacatatcacatcaactcaatttctattaatagtgattatgaaacatatttatctgcagatgatttgcggattaatctttggcatctggaaattacagacaggagttttaacattgtggatatcaagcctgccaatatggaagagctaacagaggtgattacagcagcagaatttcatccaaacagctgtaacacatttgtatacagcagcagtaaaggaactattcggctatgtgacatgagggcatctgccctctgtgatagacattctaaattgtttgaagaacctgaagatcccagtaacaggtcatttttttccgaaatcatctcctctatttcggatgtaaaattcagccatagtggtcgatatatgatgactagagactatttgtcagtcaaaatttgggacttaaatatggaaaacaggcctgtggaaacataccaggtgcatgaatacctcagaagtaaactctgttcactgtatgaaaatgactgcatatttgacaaatttgaatgttgttggaatggatctgacagtgttgtcatgactggatcttacaataatttcttcagaatgtttgacagaaacacaaagcgagacataaccctagaagcatcgcgggaaaacaataagcctcgcacagttctgaagcctcgcaaagtctgtgcaagtggcaagcgaaagaaagatgaaataagtgttgacagcctagacttcaataagaaaatccttcacacagcctggcaccccaaggaaaatatcattgccgtagctactacaaacaatctgtatatatttcaagacaaagtgaattagggttggcattcctagcagaagaacccacttcctgcttagttgagatagttgaatctagcattcgttcctataaaagagagaggtccattgtggcgcccctttccagtgtttgacagtgtgccattcgacaacacattgttatagctacatggagaaagctctgtggattcatcactgtggtgttctccatgtctgctagccatttaggtaagggtagggcacttttaatttaaatgacttcttgcaccatcttgcctaatggactagattggactgtatcaacattgatttactccactttttatgccttccattgtgatgacgtcaaacacagtgaaagccttcagtcatgctatgggatttaattgtgtatcctcattactgtatcatttgtggggtacaccccttccccctttttttaaattaaatacagctcattcttactgtggcttgtagcattcctcctcttctggcctcctggactgctccccttcatctcttacccttgccccctccacccggtcttggtggtggtatattaaaaaaagaaagaatgaaagcacacaaaatgagtcagtttggggtcagtggtataaagggggtatatgttgcaaacaaatgttttagtaacagttggctgtaatcactcctcgccgtgtctggcactgaaaataaggaaaaaaaacctactactgaataaaagtgacaaagaatgga

SEQ ID NO: 455731 - DNA, 2384 bp, Homo sapiens
tgcgtgcagatttgtccctcccgctcgggagcctggtggatcttctcccacctccccaccttgccccccgcctttatttttttttcctgcaggtcttcatttaatttctatttttccccctgctgcaagccttcttgggtgtatatacacatttattttgcctcgagaaggaagagcgccttataagttaaaatacagtgggggcatatgtgtattttttccccactgtagatgccaatatttttgagactggaagcctaaattttttgtttcgaaccatttcgtttccgtttcttcccttttaccgccgaagagtgcaaggcctttcatgagctggaggagggaatgatattcagtggtgtttttctcaggtgaaaggagcagtagatgatgatgtagcagaagcagatataatttctacagtagaatttaatcattctggagaattactagcaacaggagataaaggtggtagagttgtcatctttcaacaggagcaggagaacaaaatccagtctcatagcagaggagaatataatgtttacagcaccttccagagccatgaaccagagtttgactacttgaaaagtttagaaatagaagaaaagatcaacaaaattaggtggttaccccagaaaaatgctgctcagtttttattgtctaccaatgataaaacaataaaattatggaaaatcagtgaaagggacaaaagaccagaagggtataacttgaaagaggaggatggaaggtatagagatcctactacagttactacactacgagtgccagtctttaggcctatggatctaatggttgaggccagtccacgaagaatatttgccaatgctcatacatatcacatcaactcaatttctattaatagtgattatgaaacatatttatctgcagatgatttgcggattaatctttggcatctggaaattacagacaggagttttaacattgtggatatcaagcctgccaatatggaagagctaacagaggtgattacagcagcagaatttcatccaaacagctgtaacacatttgtatacagcagcagtaaaggaactattcggctatgtgacatgagggcatctgccctctgtgatagacattctaaattgtttgaagaacctgaagatcccagtaacaggtcatttttttccgaaatcatctcctctatttcggatgtaaaattcagccatagtggtcgatatatgatgactagagactatttgtcagtcaaaatttgggacttaaatatggaaaacaggcctgtggaaacataccaggtgcatgaatacctcagaagtaaactctgttcactgtatgaaaatgactgcatatttgacaaatttgaatgttgttggaatggatctgacagtgttgtcatgactggatcttacaataatttcttcagaatgtttgacagaaacacaaagcgagacataaccctagaagcatcgcgggaaaacaataagcctcgcacagttctgaagcctcgcaaagtctgtgcaagtggcaagcgaaagaaagatgaaataagtgttgacagcctagacttcaataagaaaatccttcacacagcctggcaccccaaggaaaatatcattgccgtagctactacaaacaatctgtatatatttcaagacaaagtgaattagggttggcattcctagcagaagaacccacttcctgcttagttgagatagttgaatctagcattcgttcctataaaagagagaggtccattgtggcgcccctttccagtgtttgacagtgtgccattcgacaacacattgttatagctacatggagaaagctctgtggattcatcactgtggtgttctccatgtctgctagccatttaggtaagggtagggcacttttaatttaaatgacttcttgcaccatcttgcctaatggactagattggactgtatcaacattgatttactccactttttatgccttccattgtgatgacgtcaaacacagtgaaagccttcagtcatgctatgggatttaattgtgtatcctcattactgtatcatttgtggggtacaccccttccccctttttttaaattaaatacagctcattcttactgtggcttgtagcattcctcctcttctggcctcctggactgctccccttcatctcttacccttgccccctccacccggtcttggtggtggtatattaaaaaaagaaagaatgaaagcacacaaaatgagtcagtttggggtcagtggtataaagggggtatatgttgcaaacaaatgttttagtaacagttggctgtaatcactcctcgccgtgtctggcactgaaaataaggaaaaaaaacctactactgaataaaagtgacaaagaatgga

SEQ ID NO: 455732 - DNA, 2348 bp, Homo sapiens
aggaaaaggacaatacatcatattaaataacagatcggggagttgaccctaaagtgggcataggaagaaggtgtgcctcacctagctctttctgggcaagactttatcattatttttagatgaacttccttattatgggtgctcagttttttttcatcagtttttttcatagactataccatcaaatacataagagtaaattagcaatcaaattgatccatatttaacgtcattatttccctaatgaattgagcttatttattcagctttatttagccttttcccccgttaagttttctcatttaatccttgaaggcctttagaaatataaaaaacagaatgtaattgtataaagacacaactaatggggtattgagaatgtgcagggtcctttggaattgattacatatttgattattttgaaatatttttcaacaatggtccatatatttttgttttcattttagaacaaaatccagtctcatagcagaggagaatataatgtttacagcaccttccagagccatgaaccagagtttgactacttgaaaagtttagaaatagaagaaaagatcaacaaaattaggtggttaccccagaaaaatgctgctcagtttttattgtctaccaatgataaaacaataaaattatggaaaatcagtgaaagggacaaaagaccagaagggtataacttgaaagaggaggatggaaggtatagagatcctactacagttactacactacgagtgccagtctttaggcctatggatctaatggttgaggccagtccacgaagaatatttgccaatgctcatacatatcacatcaactcaatttctattaatagtgattatgaaacatatttatctgcagatgatttgcggattaatctttggcatctggaaattacagacaggagttttaacattgtggatatcaagcctgccaatatggaagagctaacagaggtgattacagcagcagaatttcatccaaacagctgtaacacatttgtatacagcagcagtaaaggaactattcggctatgtgacatgagggcatctgccctctgtgatagacattctaaattgtttgaagaacctgaagatcccagtaacaggtcatttttttccgaaatcatctcctctatttcggatgtaaaattcagccatagtggtcgatatatgatgactagagactatttgtcagtcaaaatttgggacttaaatatggaaaacaggcctgtggaaacataccaggtgcatgaatacctcagaagtaaactctgttcactgtatgaaaatgactgcatatttgacaaatttgaatgttgttggaatggatctgacagtgttgtcatgactggatcttacaataatttcttcagaatgtttgacagaaacacaaagcgagacataaccctagaagcatcgcgggaaaacaataagcctcgcacagttctgaagcctcgcaaagtctgtgcaagtggcaagcgaaagaaagatgaaataagtgttgacagcctagacttcaataagaaaatccttcacacagcctggcaccccaaggaaaatatcattgccgtagctactacaaacaatctgtatatatttcaagacaaagtgaattagggttggcattcctagcagaagaacccacttcctgcttagttgagatagttgaatctagcattcgttcctataaaagagagaggtccattgtggcgcccctttccagtgtttgacagtgtgccattcgacaacacattgttatagctacatggagaaagctctgtggattcatcactgtggtgttctccatgtctgctagccatttaggtaagggtagggcacttttaatttaaatgacttcttgcaccatcttgcctaatggactagattggactgtatcaacattgatttactccactttttatgccttccattgtgatgacgtcaaacacagtgaaagccttcagtcatgctatgggatttaattgtgtatcctcattactgtatcatttgtggggtacaccccttccccctttttttaaattaaatacagctcattcttactgtggcttgtagcattcctcctcttctggcctcctggactgctccccttcatctcttacccttgccccctccacccggtcttggtggtggtatattaaaaaaagaaagaatgaaagcacacaaaatgagtcagtttggggtcagtggtataaagggggtatatgttgcaaacaaatgttttagtaacagttggctgtaatcactcctcgccgtgtctggcactgaaaataaggaaaaaaaacctactactgaataaaagtgacaaagaatgga

SEQ ID NO: 455733 - DNA, 2307 bp, Homo sapiens
agccggcgccattttgaaagtggagtcgcctgcccctgccgctgccgccgccgccgtcgctgtcgtagtcgccgccgccgctgccggagaaagagcacgagcggggaagccccagagtgaaatctagcatcctgccggctggtctgcccgcccctccttccttttccccccggcccccgtcccctccccccgcaggtgccatccgccgccatccgccctctctacccccccatccccaggtgaggggggtgagttcaggaagcggagaccccgaggaacccagcagggtcaccatttgcagcgcaacatggcaggagctggaggagggaatgatattcagtggtgtttttctcaggtgaaaggagcagtagatgatgatgtagcagaagcagatataatttctacagtagaatttaatcattctggagaattactagcaacaggagataaaggtggtagagttgtcatctttcaacaggagcaggagaacaaaatccagtctcatagcagaggagaatataatgtttacagcaccttccagagccatgaaccagagtttgactacttgaaaagtttagaaatagaagaaaagatcaacaaaattaggtggttaccccagaaaaatgctgctcagtttttattgtctaccaatgataaaacaataaaattatggaaaatcagtgaaagggacaaaagaccagaagggtgccagtctttaggcctatggatctaatggttgaggccagtccacgaagaatatttgccaatgctcatacatatcacatcaactcaatttctattaatagtgattatgaaacatatttatctgcagatgatttgcggattaatctttggcatctggaaattacagacaggagttttaacattgtggatatcaagcctgccaatatggaagagctaacagaggtgattacagcagcagaatttcatccaaacagctgtaacacatttgtatacagcagcagtaaaggaactattcggctatgtgacatgagggcatctgccctctgtgatagacattctaaattgtttgaagaacctgaagatcccagtaacaggtcatttttttccgaaatcatctcctctatttcggatgtaaaattcagccatagtggtcgatatatgatgactagagactatttgtcagtcaaaatttgggacttaaatatggaaaacaggcctgtggaaacataccaggtgcatgaatacctcagaagtaaactctgttcactgtatgaaaatgactgcatatttgacaaatttgaatgttgttggaatggatctgacagtgttgtcatgactggatcttacaataatttcttcagaatgtttgacagaaacacaaagcgagacataaccctagaagcatcgcgggaaaacaataagcctcgcacagttctgaagcctcgcaaagtctgtgcaagtggcaagcgaaagaaagatgaaataagtgttgacagcctagacttcaataagaaaatccttcacacagcctggcaccccaaggaaaatatcattgccgtagctactacaaacaatctgtatatatttcaagacaaagtgaattagggttggcattcctagcagaagaacccacttcctgcttagttgagatagttgaatctagcattcgttcctataaaagagagaggtccattgtggcgcccctttccagtgtttgacagtgtgccattcgacaacacattgttatagctacatggagaaagctctgtggattcatcactgtggtgttctccatgtctgctagccatttaggtaagggtagggcacttttaatttaaatgacttcttgcaccatcttgcctaatggactagattggactgtatcaacattgatttactccactttttatgccttccattgtgatgacgtcaaacacagtgaaagccttcagtcatgctatgggatttaattgtgtatcctcattactgtatcatttgtggggtacaccccttccccctttttttaaattaaatacagctcattcttactgtggcttgtagcattcctcctcttctggcctcctggactgctccccttcatctcttacccttgccccctccacccggtcttggtggtggtatattaaaaaaagaaagaatgaaagcacacaaaatgagtcagtttggggtcagtggtataaagggggtatatgttgcaaacaaatgttttagtaacagttggctgtaatcactcctcgccgtgtctggcactgaaaataaggaaaaaaaacctactactgaataaaagtgacaaagaatgga

SEQ ID NO: 455734 - DNA, 1332 bp, Homo sapiens
  misc_feature (10)..(10): n is a, c, g, or t
  misc_feature (13)..(13): n is a, c, g, or t
attagagganccnattgccacgctcggttatgtgacatgagggcatctgccctctgtgatagacattctaaattgtttgaagaacctgaagatcccagtaacaggtcatttttttccgaaatcatctcctctatttcggatgtaaaattcagccatagtggtcgatatatgatgactagagactatttgtcagtcaaaatttgggacttaaatatggaaaacaggcctgtggaaacataccaggtgcatgaatacctcagaagtaaactctgttcactgtatgaaaatgactgcatatttgacaaatttgaatgttgttggaatggatctgacagtgttgtcatgactggatcttacaataatttcttcagaatgtttgacagaaacacaaagcgagacataaccctagaagcatcgcgggaaaacaataagcctcgcacagttctgaagcctcgcaaagtctgtgcaagtggcaagcgaaagaaagatgaaataagtgttgacagcctagacttcaataagaaaatccttcacacagcctggcaccccaaggaaaatatcattgccgtagctactacaaacaatctgtatatatttcaagacaaagtgaattagggttggcattcctagcagaagaacccacttcctgcttagttgagatagttgaatctagcattcgttcctataaaagagagaggtccattgtggcgcccctttccagtgtttgacagtgtgccattcgacaacacattgttatagctacatggagaaagctctgtggattcatcactgtggtgttctccatgtctgctagccatttaggtaagggtagggcacttttaatttaaatgacttcttgcaccatcttgcctaatggactagattggactgtatcaacattgatttactccactttttatgccttccattgtgatgacgtcaaacacagtgaaagccttcagtcatgctatgggatttaattgtgtatcctcattactgtatcatttgtggggtacaccccttccccctttttttaaattaaatacagctcattcttactgtggcttgtagcattcctcctcttctggcctcctggactgctccccttcatctcttacccttgccccctccacccggtcttggtggtggtatattaaaaaaagaaagaatgaaagcacacaaaatgagtcagtttggggtcagtggtataaagggggtatatgttgcaaacaaatgttttagtaacagttggctgtaatcactcctcgccgtgtctggcactgaaaataaggaaaaaaaacctactactgaataaaagtgacaaagaatgga

SEQ ID NO: 455735 - DNA, 1471 bp, Homo sapiens
gggattacaggcgtgagccactgcgcccggcccaaaaaatgtaaatcataagataaagcattggtttcttgtgaacagctacagctacttcatgcggggttcttttgttttagaacctgtgagttccacagatagttgctcctttgagaagctggctggcctggttgatcacatagcctgtagttgcaaaaatacttaacaacgataattctgcactcctaagaagttttacttgaggatgctgtcaactttgctgatagttttggtagccataaaaagaataagcagaaaacccagttaattagtaccgtatttctggtttattctagtgattgagttgatgtcaacagcccctgtcccttagtttaaatctgcttttgaagtagcttcctatggtttaattgccgaatcattttacttgaaaacaatttcttgttctgcttgtttgactgagtgtactgtctattttcacagtgttgtcatgactggatcttacaataatttcttcagaatgtttgacagaaacacaaagcgagacataaccctagaagcatcgcgggaaaacaataagcctcgcacagttctgaagcctcgcaaagtctgtgcaagtggcaagcgaaagaaagatgaaataagtgttgacagcctagacttcaataagaaaatccttcacacagcctggcaccccaaggaaaatatcattgccgtagctactacaaacaatctgtatatatttcaagacaaagtgaattagggttggcattcctagcagaagaacccacttcctgcttagttgagatagttgaatctagcattcgttcctataaaagagagaggtccattgtggcgcccctttccagtgtttgacagtgtgccattcgacaacacattgttatagctacatggagaaagctctgtggattcatcactgtggtgttctccatgtctgctagccatttaggtaagggtagggcacttttaatttaaatgacttcttgcaccatcttgcctaatggactagattggactgtatcaacattgatttactccactttttatgccttccattgtgatgacgtcaaacacagtgaaagccttcagtcatgctatgggatttaattgtgtatcctcattactgtatcatttgtggggtacaccccttccccctttttttaaattaaatacagctcattcttactgtggcttgtagcattcctcctcttctggcctcctggactgctccccttcatctcttacccttgccccctccacccggtcttggtggtggtatattaaaaaaagaaagaatgaaagcacacaaaatgagtcagtttggggtcagtggtataaagggggtatatgttgcaaacaaatgttttagtaacagttggctgtaatcactcctcgccgtgtctggcactgaaaataaggaaaaaaaacctactactgaataaaagtgacaaagaatgga

SEQ ID NO: 455736 - DNA, 1909 bp, Homo sapiens
  misc_feature (1883)..(1883): n is a, c, g, or t
  misc_feature (1897)..(1897): n is a, c, g, or t
agccggcgccattttgaaagtggagtcgcctgcccctgccgctgccgccgccgccgtcgctgtcgtagtcgccgccgccgctgccggagaaagagcacgagcggggaagccccagagtgaaatctagcatcctgccggctggtctgcccgcccctccttccttttccccccggcccccgtcccctccccccgcaggtgccatccgccgccatccgccctctctacccccccatccccaggtgaggggggtgagttcaggaagcggagaccccgaggaacccagcagggtcaccatttgcagcgcaacatggcaggagctggaggagggaatgatattcagtggtgtttttctcaggtgaaaggagcagtagatgatgatgtagcagaagcagatataatttctacagtagaatttaatcattctggagaattactagcaacaggagataaaggtggtagagttgtcatctttcaacaggagcaggagaacaaaatccagtctcatagcagaggagaatataatgtttacagcaccttccagagccatgaaccagagtttgactacttgaaaagtttagaaatagaagaaaagatcaacaaaattaggtggttaccccagaaaaatgctgctcagtttttattgtctaccaatgataaaacaataaaattatggaaaatcagtgaaagggacaaaagaccagaagggtataacttgaaagaggaggatggaaggtatagagatcctactacagttactacactacgagtgccagtctttaggcctatggatctaatggttgaggccagtccacgaagaatatttgccaatgctcatacatatcacatcaactcaatttctattaatagtgattatgaaacatatttatctgcagatgatttgcggattaatctttggcatctggaaattacagacaggagttttaacattgtggatatcaagcctgccaatatggaagagctaacagaggtgattacagcagcagaatttcatccaaacagctgtaacacatttgtatacagcagcagtaaaggaactattcggctatgtgacatgagggcatctgccctctgtgatagacattctaaattgtttgaagaacctgaagatcccagtaacaggtcatttttttccgaaatcatctcctctatttcggatgtaaaattcagccatagtggtcgatatatgatgactagagactatttgtcagtcaaaatttgggacttaaatatggaaaacaggcctgtggaaacataccaggtgcatgaatacctcagaagtaaactctgttcactgtatgaaaatgactgcatatttgacaaatttgaatgttgttggaatggatctgacagtgttgtcatgactggatcttacaataatttcttcagaatgtttgacagaaacacaaagcgagacataaccctagaagcatcgcgggaaaacaataagcctcgcacagttctgaagcctcgcaaagtctgtgcaagtggcaagcgaaagaaagatgaaataagtgttgacagcctagacttcaataagaaaatccttcacacagcctggcaccccaaggaaaatatcattgccgtagctactacaaacaatctgtatatatttcaagacaaagtgaattagggttggcattcctagcagaagaacccacttcctgcttagttgagatagttgaatctagcattcgttcctataaaagagagaggtccattgtggcgcccctttccagtgtttgacagtgtgccattcgacaacacattgttatagctacatggagaaagctctgtggattcatcactgttgatacagtccaatctagtccattaggcaagatgtgcagagtcatttaaattanaagtgccctacccntacctaaaagct

SEQ ID NO: 455737 - DNA, 1675 bp, Homo sapiens
agccggcgccattttgaaagtggagtcgcctgcccctgccgctgccgccgccgccgtcgctgtcgtagtcgccgccgccgctgccggagaaagagcacgagcggggaagccccagagtgaaatctagcatcctgccggctggtctgcccgcccctccttccttttccccccggcccccgtcccctccccccgcaggtgccatccgccgccatccgccctctctacccccccatccccaggtgaggggggtgagttcaggaagcggagaccccgaggaacccagcagggtcaccatttgcagcgcaacatggcaggagctggaggagggaatgatattcagtggtgtttttctcaggtgaaaggagcagtagatgatgatgtagcagaagcagatataatttctacagtagaatttaatcattctggagaattactagcaacaggagataaaggtggtagagttgtcatctttcaacaggagcaggagaacaaaatccagtctcatagcagaggagaatataatgtttacagcaccttccagagccatgaaccagagtttgactacttgaaaagtttagaaatagaagaaaagatcaacaaaattaggtggttaccccagaaaaatgctgctcagtttttattgtctaccaatgataaaacaataaaattatggaaaatcagtgaaagggacaaaagaccagaagggtataacttgaaagaggaggatggaaggtatagagatcctactacagttactacactacgagtgccagtctttaggcctatggatctaatggttgaggccagtccacgaagaatatttgccaatgctcatacatatcacatcaactcaatttctattaatagtgattatgaaacatatttatctgcagatgatttgcggattaatctttggcatctggaaattacagacaggagttttaacattgtggatatcaagcctgccaatatggaagagctaacagaggtgattacagcagcagaatttcatccaaacagctgtaacacatttgtatacagcagcagtaaaggaactattcggctatgtgacatgagggcatctgccctctgtgatagacattctaaatgtaagtttattgtatctttccttaaaatgattacatattctgtttgtctgaaataagcctcagacatgataagtacaattacagaggttcaaagtcttaaacccgtgtgtccagagccacttgtacccttggtaatctgcctacctcctcatgaggcattccaggttattcctggaagctctcttggggggcatgtctattgattgccaaggaatatatctctcatggaatgctgttgttctttggtaacttgcggttgggctctgtaaccttgtattgaagtagagctgttcctttctttcccatcctcccttcctactttgagcttcctaggaagatttcttctgaggtttccttggcttaaaaaaaaaaaaaaaaaaacaactttggtttaaaaacttcaggatacaatattcttgtcttgttgaatattaactcatgaaaattgatacatgcctgttaccaaaataattttacctggctactagaaaataagatcctggtatgaatttgggatgggcgaggatggtgtgtttctcatggtgatgatacaggcagtcagtgag

SEQ ID NO: 455738 - DNA, 2104 bp, Homo sapiens
tacccaggcagtaatgttcccgaagttttctcttcgttctatgtttcatggagctggaggagggaatgatattcagtggtgtttttctcaggtgaaaggagcagtagatgatgatgtagcagaagcagatataatttctacagtagaatttaatcattctggagaattactagcaacaggagataaaggtggtagagttgtcatctttcaacaggagcaggagaacaaaatccagtctcatagcagaggagaatataatgtttacagcaccttccagagccatgaaccagagtttgactacttgaaaagtttagaaatagaagaaaagatcaacaaaattaggtggttaccccagaaaaatgctgctcagtttttattgtctaccaatgataaaacaataaaattatggaaaatcagtgaaagggacaaaagaccagaagggtataacttgaaagaggaggatggaaggtatagagatcctactacagttactacactacgagtgccagtctttaggcctatggatctaatggttgaggccagtccacgaagaatatttgccaatgctcatacatatcacatcaactcaatttctattaatagtgattatgaaacatatttatctgcagatgatttgcggattaatctttggcatctggaaattacagacaggagttttaacattgtggatatcaagcctgccaatatggaagagctaacagaggtgattacagcagcagaatttcatccaaacagctgtaacacatttgtatacagcagcagtaaaggaactattcggctatgtgacatgagggcatctgccctctgtgatagacattctaaattgtttgaagaacctgaagatcccagtaacaggtcatttttttccgaaatcatctcctctatttcggatgtaaaattcagccatagtggtcgatatatgatgactagagactatttgtcagtcaaaatttgggacttaaatatggaaaacaggcctgtggaaacataccaggtgcatgaatacctcagaagtaaactctgttcactgtatgaaaatgactgcatatttgacaaatttgaatgttgttggaatggatctgacagtgttgtcatgactggatcttacaataatttcttcagaatgtttgacagaaacacaaagcgagacataaccctagaagcatcgcgggaaaacaataagcctcgcacagttctgaagcctcgcaaagtctgtgcaagtggcaagcgaaagaaagatgaaataagtgttgacagcctagacttcaataagaaaatccttcacacagcctggcaccccaaggaaaatatcattgccgtagctactacaaacaatctgtatatatttcaagacaaagtgaattagggttggcattcctagcagaagaacccacttcctgcttagttgagatagttgaatctagcattcgttcctataaaagagagaggtccattgtggcgcccctttccagtgtttgacagtgtgccattcgacaacacattgttatagctacatggagaaagctctgtggattcatcactgtggtgttctccatgtctgctagccatttaggtaagggtagggcacttttaatttaaatgacttcttgcaccatcttgcctaatggactagattggactgtatcaacattgatttactccactttttatgccttccattgtgatgacgtcaaacacagtgaaagccttcagtcatgctatgggatttaattgtgtatcctcattactgtatcatttgtggggtacaccccttccccctttttttaaattaaatacagctcattcttactgtggcttgtagcattcctcctcttctggcctcctggactgctccccttcatctcttacccttgccccctccacccggtcttggtggtggtatattaaaaaaagaaagaatgaaagcacacaaaatgagtcagtttggggtcagtggtataaagggggtatatgttgcaaacaaatgttttagtaacagttggctgtaatcactcctcgccgtgtctggcactgaaaataaggaaaaaaaacctactactgaataaaagtgacaaagaatgga

SEQ ID NO: 455739 - DNA, 2559 bp, Homo sapiens
agccggcgccattttgaaagtggagtcgcctgcccctgccgctgccgccgccgccgtcgctgtcgtagtcgccgccgccgctgccggagaaagagcacgagcggggaagccccagagtgaaatctagcatcctgccggctggtctgcccgcccctccttccttttccccccggcccccgtcccctccccccgcaggtgccatccgccgccatccgccctctctacccccccatccccaggtgaggggggtgagttcaggaagcggagaccccgaggaacccagcagggtcaccatttgcagcgcaacatggcaggagctggaggagggaatgatattcagtggtgtttttctcaggtgaaaggagcagtagatgatgatgtagcagaagcagatataatttctacagtagaatttaatcattctggagaattactagcaacaggagataaaggtggtagagttgtcatctttcaacaggagcaggagaacaaaatccagtctcatagcagaggagaatataatgtttacagcaccttccagagccatgaaccagagtttgactacttgaaaagtttagaaatagaagaaaagatcaacaaaattaggtggttaccccagaaaaatgctgctcagtttttattgtctaccaatgataaaacaataaaattatggaaaatcagtgaaagggacaaaagaccagaagggtataacttgaaagaggaggatggaaggtatagagatcctactacagttactacactacgagtgccagtctttaggcctatggatctaatggttgaggccagtccacgaagaatatttgccaatgctcatacatatcacatcaactcaatttctattaatagtgattatgaaacatatttatctgcagatgatttgcggattaatctttggcatctggaaattacagacaggagttttaacattgtggatatcaagcctgccaatatggaagagctaacagaggtgattacagcagcagaatttcatccaaacagctgtaacacatttgtatacagcagcagtaaaggaactattcggctatgtgacatgagggcatctgccctctgtgatagacattctaaattgtttgaagaacctgaagatcccagtaacaggtcatttttttccgaaatcatctcctctatttcggatgtaaaattcagccatagtggtcgatatatgatgactagagactatttgtcagtcaaaatttgggacttaaatatggaaaacaggcctgtggaaacataccaggtgcatgaatacctcagaagtaaactctgttcactgtatgaaaatgactgcatatttgacaaatttgaatgttgttggaatggatctgacagtgttgtcatgactggatcttacaataatttcttcagaatgtttgacagaaacacaaagcgagacataaccctagaagcatcgcgggaaaacaataagcctcgcacagttctgaagcctcgcaaagtctgtgcaagtggcaagcgaaagaaagatgaaataagtgttgacagcctagacttcaataagaaaatccttcacacagcctggcaccccaaggaaaatatcattgccgtagctactacaaacaatctgtatatatttcaagacaaagtgaattagggttggcattcctagcagaagaacccacttcctgcttagttgagatagttgaatctagcattcgttcctataaaagagagaggtccattgtggcgcccctttccagtgtttgacagtgtgccattcgacaacacattgttatagctacatggagaaagctctgtggattcatcactgtggtgttctccatgtctgctagccatttaggtaagggtagggcacttttaatttaaatgacttcttgcaccatcttgcctaatggactagattggactgtatcaacattgatttactccactttttatgccttccattgtgatgacgtcaaacacagtgaaagccttcagtcatgctatgggatttaattgtgtatcctcattactgtatcatttgtggggtacaccccttccccctttttttaaattaaatacagctcattcttactgtggcttgtagcattcctcctcttctggcctcctggactgctccccttcatctcttacccttgccccctccacccggtcttggtggtggtatattaaaaaaagaaagaatgaaagcacacaaaatgagtcagtttggggtcagtggtataaagggggtatatgttgcaaacaaatgttttagtaacagttggctgtaatcactcctcgccgtgtctggcactgaaaataaggaaaaaaaacctactactgaataaaagtgacaaagaatggagaatctggttttctttttctttttaacctacctcttgtagccaatattttgtgtcatacctttgggcacagtgaaacaaaatgggttttcattgtttattggtatttgttgttaattatttttaacaagtgttcttttacatgcaggaggagaggtattggttctctatgaacatattttgaatataggtt

SEQ ID NO: 455740 - DNA, 2094 bp, Homo sapiens
agccggcgccattttgaaagtggagtcgcctgcccctgccgctgccgccgccgccgtcgctgtcgtagtcgccgccgccgctgccggagaaagagcacgagcggggaagccccagagtgaaatctagcatcctgccggctggtctgcccgcccctccttccttttccccccggcccccgtcccctccccccgcaggtgccatccgccgccatccgccctctctacccccccatccccaggtgaggggggtgagttcaggaagcggagaccccgaggaacccagcagggtcaccatttgcagcgcaacatggcaggagctggaggagggaatgatattcagtggtgtttttctcaggtgaaaggagcagtagatgatgatgtagcagaagcagatataatttctacagtagaatttaatcattctggagaattactagcaacaggagataaaggtggtagagttgtcatctttcaacaggagcaggagaacaaaatccagtctcatagcagaggagaatataatgtttacagcaccttccagagccatgaaccagagtttgactacttgaaaagtttagaaatagaagaaaagatcaacaaaattaggtggttaccccagaaaaatgctgctcagtttttattgtctaccaatgataaaacaataaaattatggaaaatcagtgaaagggacaaaagaccagaagggtataacttgaaagaggaggatggaaggtatagagatcctactacagttactacactacgagtgccagtctttaggcctatggatctaatggttgaggccagtccacgaagaatatttgccaatgctcatacatatcacatcaactcaatttctattaatagtgattatgaaacatatttatctgcagatgatttgcggattaatctttggcatctggaaattacagacaggagttttaacattgtggatatcaagcctgccaatatggaagagctaacagaggtgattacagcagcagaatttcatccaaacagctgtaacacatttgtatacagcagcagtaaaggaactattcggctatgtgacatgagggcatctgccctctgtgatagacattctaaattgtttgaagaacctgaagatcccagtaacaggtcatttttttccgaaatcatctcctctatttcggatgtaaaattcagccatagtggtcgatatatgatgactagagactatttgtcagtcaaaatttgggacttaaatatggaaaacaggcctgtggaaacataccaggtgcatgaatacctcagaagtaaactctgttcactgtatgaaaatgactgcatatttgacaaatttgaatgttgttggaatggatctgacagtgttgtcatgactggatcttacaataatttcttcagaatgtttgacagaaacacaaagcgagacataaccctagaagcatcgcgggaaaacaataagcctcgcacagttctgaagcctcgcaaagtctgtgcaagtggcaagcgaaagaaagatgaaataagtgttgacagcctagacttcaataagaaaatccttcacacagcctggcaccccaaggaaaatatcattgccgtagctactacaaacaatctgtatatatttcaagacaaagtgaattagggttggcattcctagcagaagaacccacttcctgcttagttgagatagttgaatctagcattcgttcctataaaagagagaggtccattgtggcgcccctttccagtgtttgacagtgtgccattcgacaacacattgttatagctacatggagaaagctctgtggattcatcactgtggtgttctccatgtctgctagccatttaggtaagggtagggcacttttaatttaaatgacttcttgcaccatcttgcctaatggactagattggactgtatcaacattgatttactccactttttatgccttccattgtgatgacgtcaaacacagtgaaagccttcagtcatgctatgggatttaattgtgtatcctcattactgtatcatttgtggggtacaccccttccccctttttttaaattaaatacagctcattctta

SEQ ID NO: 455741 - DNA, 1614 bp, Homo sapiens
agccggcgccattttgaaagtggagtcgcctgcccctgccgctgccgccgccgccgtcgctgtcgtagtcgccgccgccgctgccggagaaagagcacgagcggggaagccccagagtgaaatctagcatcctgccggctggtctgcccgcccctccttccttttccccccggcccccgtcccctccccccgcaggtgccatccgccgccatccgccctctctacccccccatccccaggtgaggggggtgagttcaggaagcggagaccccgaggaacccagcagggtcaccatttgcagcgcaacatggcaggagctggaggagggaatgatattcagtggtgtttttctcaggtgaaaggagcagtagatgatgatgtagcagaagcagatataatttctacagtagaatttaatcattctggagaattactagcaacaggagataaaggtggtagagttgtcatctttcaacaggagcaggagaacaaaatccagtctcatagcagaggagaatataatgtttacagcaccttccagagccatgaaccagagtttgactacttgaaaagtttagaaatagaagaaaagatcaacaaaattaggtggttaccccagaaaaatgctgctcagtttttattgtctaccaatgataaaacaataaaattatggaaaatcagtgaaagggacaaaagaccagaagggtgccagtctttaggcctatggatctaatggttgaggccagtccacgaagaatatttgccaatgctcatacatatcacatcaactcaatttctattaatagtgattatgaaacatatttatctgcagatgatttgcggattaatctttggcatctggaaattacagacaggagttttaacattgtggatatcaagcctgccaatatggaagagctaacagaggtgattacagcagcagaatttcatccaaacagctgtaacacatttgtatacagcagcagtaaaggaactattcggctatgtgacatgagggcatctgccctctgtgatagacattctaaatgtaagtttattgtatctttccttaaaatgattacatattctgtttgtctgaaataagcctcagacatgataagtacaattacagaggttcaaagtcttaaacccgtgtgtccagagccacttgtacccttggtaatctgcctacctcctcatgaggcattccaggttattcctggaagctctcttggggggcatgtctattgattgccaaggaatatatctctcatggaatgctgttgttctttggtaacttgcggttgggctctgtaaccttgtattgaagtagagctgttcctttctttcccatcctcccttcctactttgagcttcctaggaagatttcttctgaggtttccttggcttaaaaaaaaaaaaaaaaaaacaactttggtttaaaaacttcaggatacaatattcttgtcttgttgaatattaactcatgaaaattgatacatgcctgttaccaaaataattttacctggctactagaaaataagatcctggtatgaatttgggatgggcgaggatggtgtgtttctcatggtgatgatacaggcagtcagtgag

SEQ ID NO: 455742 - DNA, 3020 bp, Homo sapiens
ggcccagtgcgtggcagcgggacctgcggccccgtcgcgaagtttccagccctgcgagcgccgccgggtcggccgatcgtcccccatacctcggccatgcggcccctgctgctactggccctgctgggctggctgctgctggccgaagcgaagggcgacgccaagccggaggacaaccttttagtcctcacggtggccactaaggagaccgagggattccgtcgcttcaagcgctcagctcagttcttcaactacaagatccaggcgcttggcctaggggaggactggaatgtggagaaggggacgtcggcaggtggagggcagaaggtccggctgctgaagaaagctctggagaagcacgcagacaaggaggatctggtcattctcttcgcagacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgggctctggaggcttcatcggttatgcccccaacctcagcaaactggtggccgagtgggagggccaggacagcgacagcgatcagctgttttacaccaagatcttcttggacccggagaagagggagcagatcaatatcaccctggaccaccgctgccgtatcttccagaacctggatggagccttggatgaggtcgtgctcaagtttgaaatgggccatgtgagagcgaggaacctggcctatgacaccctcccggtcctgatccatggcaacgggccaaccaagctgcagttgaactacctgggcaactacatcccgcgcttctggaccttcgaaacaggctgcaccgtgtgtgacgaaggcttgcgcagcctcaagggcattggggatgaagctctgcccacggtcctggtcggcgtgttcatcgaacagcccacgccgtttgtgtccctgttcttccagcggctcctgcggctccactacccccagaaacacatgcgacttttcatccacaaccacgagcagcaccacaaggctcaggtggaagagttcctggcacagcatggcagcgagtaccagtctgtgaagctggtgggccctgaggtgcggatggcgaatgcagatgccaggaacatgggcgcagacctgtgccggcaggaccgcagctgcacctactacttcagcgtggatgctgacgtggccctgaccgagcccaacagcctgcggctgctgatccaacagaacaagaacgtcattgccccgctgatgacccggcatgggaggctgtggtcgaacttctggggggctctcagtgcagatggctactatgcccgttccgaggactacgtggacattgtgcaggggcggcgtgttggtgtctggaatgtgccctatatttcaaacatctacttgatcaagggcagtgccctgcggggtgagctgcagtcctcagatctcttccaccacagcaagctggaccccgacatggccttctgtgccaacatccggcagcaggatgtgttcatgttcctgaccaaccggcacacccttggccatctgctctccctagacagctaccgcaccacccacctgcacaacgacctctgggaggtgttcagcaaccccgaggactggaaggagaagtacatccaccagaactacaccaaagccctggcagggaagctggtggagacgccctgcccggatgtctattggttccccatcttcacggaggtggcctgtgatgagctggtggaggagatggagcactttggccagtggtctctgggcaacaacaaggacaaccgcatccagggtggctacgagaacgtgccgactattgacatccacatgaaccagatcggctttgagcgggagtggcacaaattcctgctggagtacattgcgcccatgacggagaagctctaccccggctactacaccagggcccagtttgacctggcctttgtcgtccgctacaagcctgatgagcagccctcactgatgccacaccatgatgcctccaccttcaccatcaacatcgccctgaaccgagtcggggtggattacgagggcgggggctgtcggttcctgcgctacaactgttccatccgagccccaaggaagggctggaccctcatgcaccctggacgactcacgcattaccatgaggggctccccaccaccaggggcacccgctacatcgcagtctccttcgtcgatccctaattggccaggcctgaccctcttggacctttcttctttgccgacaaccactgcccagcagcctctgggacctcggggtcccagggaacccagtccagcctcctggctgttgacttcccattgctcttggagccaccaatcaaagagattcaaagagattcctgcaggccagaggcggaacacacctttatggctggggctctccgtggtgttctggacccagcccctggagacaccattcacttttactgctttgtagtgactcgtgctctccaacctgtcttcctgaaaaaccaaggcccccttcccccacctcttccatggggtgagacttgagcagaacaggggcttccccaagttgcccagaaagactgtctgggtgagaagccatggccagagcttctccccaggcacaggtgttgcaccagggacttctgcttcaagttttggggtaaagacacctggatcagactccaagggctgccctgagtctgggacttctgcctccatggctggtcatgagagcaaaccgtagtcccctggagacagcgactccagagaacctcttgggagacagaagaggcatctgtgcacagctcgatcttctacttgcctgtggggaggggagtgacaggtccacacaccacactgggtcaccctgtcctggatgcctctgaagagagggacagaccgtcagaaactggagagtttctattaaaggtcatttaaaccactgaagggaa

SEQ ID NO: 455743 - DNA, 2967 bp, Homo sapiens
ggcccagtgcgtggcagcgggacctgcggccccgtcgcgaagtttccagccctgcgagcgccgccgggtcggccgatcgtcccccatacctcggccatgcggcccctgctgctactggccctgctgggctggctgctgctggccgaagcgaagggcgacgccaagccggaggacaaccttttagtcctcacggtggccactaaggagaccgagggattccgtcgcttcaagcgctcagctcagttcttcaactacaagatccaggcgcttggcctaggggaggactggaatgtggagaaggggacgtcggcaggtggagggcagaaggtccggctgctgaagaaagctctggagaagcacgcagacaaggaggatctggtcattctcttcgcagacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgggctctggaggcttcatcggttatgcccccaacctcagcaaactggtggccgagtgggagggccaggacagcgacagcgatcagctgttttacaccaagatcttcttggacccggagaagagggagcagatcaatatcaccctggaccaccgctgccgtatcttccagaacctggatggagccttggatgaggtcgtgctcaagtttgaaatgggccatgtgagagcgaggaacctggcctatgacaccctcccggtcctgatccatggcaacgggccaaccaagctgcagttgaactacctgggcaactacatcccgcgcttctggaccttcgaaacaggctgcaccgtgtgtgacgaaggcttgcgcagcctcaagggcattggggatgaagctctgcccacggtcctggtcggcgtgttcatcgaacagcccacgccgtttgtgtccctgttcttccagcggctcctgcggctccactacccccagaaacacatgcgacttttcatccacaaccacgagcagcaccacaaggctcaggtggaagagttcctggcacagcatggcagcgagtaccagtctgtgaagctggtgggccctgaggtgcggatggcgaatgcagatgccaggaacatgggcgcagacctgtgccggcaggaccgcagctgcacctactacttcagcgtggatgctgacgtggccctgaccgagcccaacagcctgcggctgctgatccaacagaacaagaacgtcattgccccgctgatgacccggcatgggaggctgtggtcgaacttctggggggctctcagtgcagatggctactatgcccgttccgaggactacgtggacattgtgcaggggcggcgtgttggtgtctggaatgtgccctatatttcaaacatctacttgatcaagggcagtgccctgcggggtgagctgcagtcctcagatctcttccaccacagcaagctggaccccgacatggccttctgtgccaacatccggcagcaggatgtgttcatgttcctgaccaaccggcacacccttggccatctgctctccctagacagctaccgcaccacccacctgcacaacgacctctgggaggtgttcagcaaccccgaggactggaaggagaagtacatccaccagaactacaccaaagccctggcagggaagctggtggagacgccctgcccggatgtctattggttccccatcttcacggaggtggcctgtgatgagctggtggaggagatggagcactttggccagtggtctctgggcaacaacaaggacaaccgcatccagggtggctacgagaacgtgccgactattgacatccacatgaaccagatcggctttgagcgggagtggcacaaattcctgctggagtacattgcgcccatgacggagaagctctaccccggctactacaccagggcccagtttgacctggcctttgtcgtccgctacaagcctgatgagcagccctcactgatgccacaccatgatgcctccaccttcaccatcaacatcgccctgaaccgagtcggggtggattacgagggcgggggctgtcggttcctgcgctacaactgttccatccgagccccaaggaagggctggaccctcatgcaccctggacgactcacgcattaccatgaggggctccccaccaccaggggcacccgctacatcgcagtctccttcgtcgatccctaattggccaggcctgaccctcttggacctttcttctttgccgacaaccactgcccagcagcctctgggacctcggggtcccagggaacccagtccagcctcctggctgttgacttcccattgctcttggagccaccaatcaaagagattcaaagagattcctgcaggccagaggcggaacacacctttatggctggggctctccgtggtgttctggacccagcccctggagacaccattcacttttactgctttgtagtgactcgtgctctccaacctgtcttcagaacaggggcttccccaagttgcccagaaagactgtctgggtgagaagccatggccagagcttctccccaggcacaggtgttgcaccagggacttctgcttcaagttttggggtaaagacacctggatcagactccaagggctgccctgagtctgggacttctgcctccatggctggtcatgagagcaaaccgtagtcccctggagacagcgactccagagaacctcttgggagacagaagaggcatctgtgcacagctcgatcttctacttgcctgtggggaggggagtgacaggtccacacaccacactgggtcaccctgtcctggatgcctctgaagagagggacagaccgtcagaaactggagagtttctattaaaggtcatttaaaccactgaagggaa

SEQ ID NO: 455744 - DNA, 2951 bp, Homo sapiens
  misc_feature (2910)..(2910): n is a, c, g, or t
ggcccagtgcgtggcagcgggacctgcggccccgtcgcgaagtttccagccctgcgagcgccgccgggtcggccgatcgtcccccatacctcggccatgcggcccctgctgctactggccctgctgggctggctgctgctggccgaagcgaagggcgacgccaagccggaggacaaccttttagtcctcacggtggccactaaggagaccgagggattccgtcgcttcaagcgctcagctcagttcttcaactacaagatccaggcgcttggcctaggggaggactggaatgtggagaaggggacgtcggcaggtggagggcagaaggtccggctgctgaagaaagctctggagaagcacgcagacaaggaggatctggtcattctcttcgcagacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgggctctggaggcttcatcggttatgcccccaacctcagcaaactggtggccgagtgggagggccaggacagcgacagcgatcagctgttttacaccaagatcttcttggacccggagaagagggagcagatcaatatcaccctggaccaccgctgccgtatcttccagaacctggatggagccttggatgaggtcgtgctcaagtttgaaatgggccatgtgagagcgaggaacctggcctatgacaccctcccggtcctgatccatggcaacgggccaaccaagctgcagttgaactacctgggcaactacatcccgcgcttctggaccttcgaaacaggctgcaccgtgtgtgacgaaggcttgcgcagcctcaagggcattggggatgaagctctgcccacggtcctggtcggcgtgttcatcgaacagcccacgccgtttgtgtccctgttcttccagcggctcctgcggctccactacccccagaaacacatgcgacttttcatccacaaccacgagcagcaccacaaggctcaggtggaagagttcctggcacagcatggcagcgagtaccagtctgtgaagctggtgggccctgaggtgcggatggcgaatgcagatgccaggaacatgggcgcagacctgtgccggcaggaccgcagctgcacctactacttcagcgtggatgctgacgtggccctgaccgagcccaacagcctgcggctgctgatccaacagaacaagaacgtcattgccccgctgatgacccggcatgggaggctgtggtcgaacttctggggggctctcagtgcagatggctactatgcccgttccgaggactacgtggacattgtgcaggggcggcgtgttggtgtctggaatgtgccctatatttcaaacatctacttgatcaagggcagtgccctgcggggtgagctgcagtcctcagatctcttccaccacagcaagctggaccccgacatggccttctgtgccaacatccggcagcaggatgtgttcatgttcctgaccaaccggcacacccttggccatctgctctccctagacagctaccgcaccacccacctgcacaacgacctctgggaggtgttcagcaaccccgaggactggaaggagaagtacatccaccagaactacaccaaagccctggcagggaagctggtggagacgccctgcccggatgtctattggttccccatcttcacggaggtggcctgtgatgagctggtggaggagatggagcactttggccagtggtctctgggcaacaacaaggacaaccgcatccagggtggctacgagaacgtgccgactattgacatccacatgaaccagatcggctttgagcgggagtggcacaaattcctgctggagtacattgcgcccatgacggagaagctctaccccggctactacaccagggcccagtttgacctggcctttgtcgtccgctacaagcctgatgagcagccctcactgatgccacaccatgatgcctccaccttcaccatcaacatcgccctgaaccgagtcggggtggattacgagggcgggggctgtcggttcctgcgctacaactgttccatccgagccccaaggaagggctggaccctcatgcaccctggacgactcacgcattaccatgaggggctccccaccaccaggggcacccgctacatcgcagtctccttcgtcgatccctaattggccaggcctgaccctcttggacctttcttctttgccgacaaccactgcccagcagcctctgggacctcggggtcccagggaacccagtccagcctcctggctgttgacttcccattgctcttggagccaccaatcaaagagattcaaagagattcctgcaggccagaggcggaacacacctttatggctggggctctccgtggtgttctggacccagcccctggagacaccattcacttttactgctttgtagtgactcgtgctctccaacctgtcttcctgaaaaaccaaggcccccttcccccacctcttccatggggtgagacttgagcagaacaggggcttccccaagttgcccagaaagactgtctgggtgagaagccatggccagagcttctccccaggcacaggtgttgcaccagggacttctgcttcaagttttggggtaaagacacctggatcagactccaagggctgccctgagtctgggacttctgcctccatggctggtccatttggggaaaaagggggcaaaaaaaagggggggggccccccaaaaaaaataacccccggtaggggttttcccccccccccctttttggggggggcaagggaaccaggcgtacnttcccagagaacctcttgggagacagaagaggcatctgtgc

SEQ ID NO: 455745 - DNA, 1107 bp, Homo sapiens
ccaccatatcggtcccgtatttcacattgataaggtcctgtttcatttctcgtgacattgggtagaatgaggatcctgttttcaatgggtcgctttaccctgggactgacagggaggctctgaccatttagccaccaaatgtaggtgtagttctcactcttaggttcaccccggggtcggccgatcgtcccccatacctcggccatgcggcccctgctgctactggccctgctgggctggctgctgctggccgaagcgaagggcgacgccaagccggaggacaaccttttagtcctcacggtggccactaaggagaccgagggattccgtcgcttcaagcgctcagctcagttcttcaactacaagatccagcaggcctgaccctcttggacctttcttctttgccgacaaccactgcccagcagcctctgggacctcggggtcccagggaacccagtccagcctcctggctgttgacttcccattgctcttggagccaccaatcaaagagattcaaagagattcctgcaggccagaggcggaacacacctttatggctggggctctccgtggtgttctggacccagcccctggagacaccattcacttttactgctttgtagtgactcgtgctctccaacctgtcttcctgaaaaaccaaggcccccttcccccacctcttccatggggtgagacttgagcagaacaggggcttccccaagttgcccagaaagactgtctgggtgagaagccatggccagagcttctccccaggcacaggtgttgcaccagggacttctgcttcaagttttggggtaaagacacctggatcagactccaagggctgccctgagtctgggacttctgcctccatggctggtcatgagagcaaaccgtagtcccctggagacagcgactccagagaacctcttgggagacagaagaggcatctgtgcacagctcgatcttctacttgcctgtggggaggggagtgacaggtccacacaccacactgggtcaccctgtcctggatgcctctgaagagagggacagaccgtcagaaactggagagtttctattaaaggtcatttaaaccactgaagggaa

SEQ ID NO: 455746 - DNA, 2045 bp, Homo sapiens
ggcccagtgcgtggcagcgggacctgcggccccgtcgcgaagtttccagccctgcgagcgccgccgggtcggccgatcgtcccccatacctcggccatgcggcccctgctgctactggccctgctgggctggctgctgctggccgaagcgaagggcgacgccaagccggaggacaaccttttagtcctcacggtggccactaaggagaccgagggattccgtcgcttcaagcgctcagctcagttcttcaactacaagatccaggcgcttggcctaggggaggactggaatgtggagaaggggacgtcggcaggtggagggcagaaggtccggctgctgaagaaagctctggagaagcacgcagacaaggaggatctggtcattctcttcgcagacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgggctctggaggcttcatcggttatgcccccaacctcagcaaactggtggccgagtgggagggccaggacagcgacagcgatcagctgttttacaccaagatcttcttggacccggagaagagggagcagatcaatatcaccctggaccaccgctgccgtatcttccagaacctggatggagccttggatgaggtcgtgctcaagtttgaaatgggccatgtgagagcgaggaacctggcctatgacaccctcccggtcctgatccatggcaacgggccaaccaagctgcagttgaactacctgggcaactacatcccgcgcttctggaccttcgaaacaggctgcaccgtgtgtgacgaaggcttgcgcagcctcaagggcattggggatgaagctctgcccacggtcctggtcggcgtgttcatcgaacagcccacgccgtttgtgtccctgttcttccagcggctcctgcggctccactacccccagaaacacatgcgacttttcatccacaaccacgagcagcaccacaaggctcaggtggaagagttcctggcacagcatggcagcgagtaccagtctgtgaagctggtgggccctgaggtgcggatggcgaatgcagatgccaggaacatgggcgcagacctgtgccggcaggaccgcagctgcacctactacttcagcgtggatgctgacgtggccctgaccgagcccaacagcctgcggctgctgatccaacagaacaagaacgtcattgccccgctgatgacccggcatgggaggctgtggtcgaacttctggggggctctcagtgcagatggctactatgcccgttccgaggactacgtggacattgtgcaggggcggcgtgttggtgtctggaatgtgccctatatttcaaacatctacttgatcaagggcagtgccctgcggggtgagctgcagtcctcagatctcttccaccacagcaagctggaccccgacatggccttctgtgccaacatccggcagcaggatgtgttcatgttcctgaccaaccggcacacccttggccatctgctctccctagacagctaccgcaccacccacctgcacaacgacctctgggaggtgttcagcaaccccgaggactggaaggagaagtacatccaccagaactacaccaaagccctggcagggaagctggtggagacgccctgcccggatgtctattggttccccatcttcacggaggtggcctgtgatgagctggtggaggagatggagcactttggccagtggtctctgggcaacaacaagcgactccagagaacctcttgggagacagaagaggcatctgtgcacagctcgatcttctacttgcctgtggggaggggagtgacaggtccacacaccacactgggtcaccctgtcctggatgcctctgaagagagggacagaccgtcagaaactggagagtttctattaaaggtcatttaaaccactgaagggaa

SEQ ID NO: 455747 - DNA, 1855 bp, Homo sapiens
ggcccagtgcgtggcagcgggacctgcggccccgtcgcgaagtttccagccctgcgagcgccgccgggtcggccgatcgtcccccatacctcggccatgcggcccctgctgctactggccctgctgggctggctgctgctggccgaagcgaagggcgacgccaagccggaggacaaccttttagtcctcacggtggccactaaggagaccgagggattccgtcgcttcaagcgctcagctcagttcttcaactacaagatccaggcgcttggcctaggggaggactggaatgtggagaaggggacgtcggcaggtggagggcagaaggtccggctgctgaagaaagctctggagaagcacgcagacaaggaggatctggtcattctcttcgcagacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgggctctggaggcttcatcggttatgcccccaacctcagcaaactggtggccgagtgggagggccaggacagcgacagcgatcagctgttttacaccaagatcttcttggacccggagaagagggagcagatcaatatcaccctggaccaccgctgccgtatcttccagaacctggatggagccttggatgaggtcgtgctcaagtttgaaatgggccatgtgagagcgaggaacctggcctatgacaccctcccggtcctgatccatggcaacgggccaaccaagctgcagttgaactacctgggcaactacatcccgcgcttctggaccttcgaaacaggctgcaccgtgtgtgacgaaggcttgcgcagcctcaagggcattggggatgaagctctgcccacggtcctggtcggcgtgttcatcgaacagcccacgccgtttgtgtccctgttcttccagcggctcctgcggctccactacccccagaaacacatgcgacttttcatccacaaccacgagcagcaccacaaggctcaggtggaagagttcctggcacagcatggcagcgagtaccagtctgtgaagctggtgggccctgaggtgcggatggcgaatgcagatgccaggaacatgggcgcagacctgtgccggcaggaccgcagctgcacctactacttcagcgtggatgctgacgtggccctgaccgagcccaacagcctgcggctgctgatccaacagaacaagaacgtcattgccccgctgatgacccggcatgggaggctgtggtcgaacttctggggggctctcagtgcagatggctactatgcccgttccgaggactacgtggacattgtgcaggggcggcgtgttggtgtctggaatgtgccctatatttcaaacatctacttgatcaagggcagtgccctgcggggtgagctgcagtcctcagatctcttccaccacagcaagctggaccccgacatggccttctgtgccaacatccggcagcaggatgtgttcatgttcctgaccaaccggcacacccttggccatctgctctccctagacagctaccgcaccacccacctgcacaacgacctctgggaggtgttcagcaaccccgaggactggaaggagaagtacatccaccagaactacaccaaagccctggcagggaagctggtggagacggtaagggccatggacaccctcttggaccagccttgcctgctgcagggggcagggcacagaagggaaactgcttgccctggggagtgggggacagcaggatgggagttgg

SEQ ID NO: 455748 - DNA, 830 bp, Homo sapiens
ggcccagtgcgtggcagcgggacctgcggccccgtcgcgaagtttccagccctgcgagcgccgccgggtcggccgatcgtcccccatacctcggccatgcggcccctgctgctactggccctgctgggctggctgctgctggccgaagcgaagggcgacgccaagccggaggacaaccttttagtcctcacggtggccactaaggagaccgagggattccgtcgcttcaagcgctcagctcagttcttcaactacaagatccaggcgcttggcctaggggaggactggaatgtggagaaggggacgtcggcaggtggagggcagaaggtccggctgctgaagaaagctctggagaagcacgcagacaaggaggatctggtcattctcttcgcagacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgggctctggaggcttcatcggttatgcccccaacctcagcaaactggtggccgagtgggagggccaggacagcgacagcgatcagctgttttacaccaagatcttcttggacccggagaagagggagcagatcaatatcaccctggaccaccgctgccgtatcttccagaacctggatggagccttggcccaaggacctgccagtgggtggctggtgatggagatgctgcaacgtgaccatggaatgctagtgatgaatgatgcaaactcacttcatcc

SEQ ID NO: 455749 - DNA, 715 bp, Homo sapiens
ccaccatatcggtcccgtatttcacattgataaggtcctgtttcatttctcgtgacattgggtagaatgaggatcctgttttcaatgggtcgctttaccctgggactgacagggaggctctgaccatttagccaccaaatgtaggtgtagttctcactcttaggttcaccccggggtcggccgatcgtcccccatacctcggccatgcggcccctgctgctactggccctgctgggctggctgctgctggccgaagcgaagggcgacgccaagccggaggacaaccttttagtcctcacggtggccactaaggagaccgagggattccgtcgcttcaagcgctcagctcagttcttcaactacaagatccaggcgcttggcctaggggaggactggaatgtggagaaggggacgtcggcaggtggagggcagaaggtccggctgctgaagaaagctctggagtctgggacttctgcctccatggctggtcatgagagcaaaccgtagtcccctggagacagcgactccagagaacctcttgggagacagaagaggcatctgtgcacagctcgatcttctacttgcctgtggggaggggagtgacaggtccacacaccacactgggtcaccctgtcctggatgcctctgaagagagggacagaccgtcagaaactggagagtttctattaaaggtcatttaaaccactgaagggaa

SEQ ID NO: 455750 - DNA, 3128 bp, Homo sapiens
ccaccatatcggtcccgtatttcacattgataaggtcctgtttcatttctcgtgacattgggtagaatgaggatcctgttttcaatgggtcgctttaccctgggactgacagggaggctctgaccatttagccaccaaatgtaggtgtagttctcactcttaggttcaccccggggtcggccgatcgtcccccatacctcggccatgcggcccctgctgctactggccctgctgggctggctgctgctggccgaagcgaagggcgacgccaagccggaggacaaccttttagtcctcacggtggccactaaggagaccgagggattccgtcgcttcaagcgctcagctcagttcttcaactacaagatccaggcgcttggcctaggggaggactggaatgtggagaaggggacgtcggcaggtggagggcagaaggtccggctgctgaagaaagctctggagaagcacgcagacaaggaggatctggtcattctcttcgcagacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgggctctggaggcttcatcggttatgcccccaacctcagcaaactggtggccgagtgggagggccaggacagcgacagcgatcagctgttttacaccaagatcttcttggacccggagaagagggagcagatcaatatcaccctggaccaccgctgccgtatcttccagaacctggatggagccttggatgaggtcgtgctcaagtttgaaatgggccatgtgagagcgaggaacctggcctatgacaccctcccggtcctgatccatggcaacgggccaaccaagctgcagttgaactacctgggcaactacatcccgcgcttctggaccttcgaaacaggctgcaccgtgtgtgacgaaggcttgcgcagcctcaagggcattggggatgaagctctgcccacggtcctggtcggcgtgttcatcgaacagcccacgccgtttgtgtccctgttcttccagcggctcctgcggctccactacccccagaaacacatgcgacttttcatccacaaccacgagcagcaccacaaggctcaggtggaagagttcctggcacagcatggcagcgagtaccagtctgtgaagctggtgggccctgaggtgcggatggcgaatgcagatgccaggaacatgggcgcagacctgtgccggcaggaccgcagctgcacctactacttcagcgtggatgctgacgtggccctgaccgagcccaacagcctgcggctgctgatccaacagaacaagaacgtcattgccccgctgatgacccggcatgggaggctgtggtcgaacttctggggggctctcagtgcagatggctactatgcccgttccgaggactacgtggacattgtgcaggggcggcgtgttggtgtctggaatgtgccctatatttcaaacatctacttgatcaagggcagtgccctgcggggtgagctgcagtcctcagatctcttccaccacagcaagctggaccccgacatggccttctgtgccaacatccggcagcaggatgtgttcatgttcctgaccaaccggcacacccttggccatctgctctccctagacagctaccgcaccacccacctgcacaacgacctctgggaggtgttcagcaaccccgaggactggaaggagaagtacatccaccagaactacaccaaagccctggcagggaagctggtggagacgccctgcccggatgtctattggttccccatcttcacggaggtggcctgtgatgagctggtggaggagatggagcactttggccagtggtctctgggcaacaacaaggacaaccgcatccagggtggctacgagaacgtgccgactattgacatccacatgaaccagatcggctttgagcgggagtggcacaaattcctgctggagtacattgcgcccatgacggagaagctctaccccggctactacaccagggcccagtttgacctggcctttgtcgtccgctacaagcctgatgagcagccctcactgatgccacaccatgatgcctccaccttcaccatcaacatcgccctgaaccgagtcggggtggattacgagggcgggggctgtcggttcctgcgctacaactgttccatccgagccccaaggaagggctggaccctcatgcaccctggacgactcacgcattaccatgaggggctccccaccaccaggggcacccgctacatcgcagtctccttcgtcgatccctaattggccaggcctgaccctcttggacctttcttctttgccgacaaccactgcccagcagcctctgggacctcggggtcccagggaacccagtccagcctcctggctgttgacttcccattgctcttggagccaccaatcaaagagattcaaagagattcctgcaggccagaggcggaacacacctttatggctggggctctccgtggtgttctggacccagcccctggagacaccattcacttttactgctttgtagtgactcgtgctctccaacctgtcttcctgaaaaaccaaggcccccttcccccacctcttccatggggtgagacttgagcagaacaggggcttccccaagttgcccagaaagactgtctgggtgagaagccatggccagagcttctccccaggcacaggtgttgcaccagggacttctgcttcaagttttggggtaaagacacctggatcagactccaagggctgccctgagtctgggacttctgcctccatggctggtcatgagagcaaaccgtagtcccctggagacagcgactccagagaacctcttgggagacagaagaggcatctgtgcacagctcgatcttctacttgcctgtggggaggggagtgacaggtccacacaccacactgggtcaccctgtcctggatgcctctgaagagagggacagaccgtcagaaactggagagtttctattaaaggtcatttaaaccactgaagggaa

SEQ ID NO: 455751 - DNA, 2945 bp, Homo sapiens
ggcccagtgcgtggcagcgggacctgcggccccgtcgcgaagtttccagccctgcgagcgccgccgggtcggccgatcgtcccccatacctcggccatgcggcccctgctgctactggccctgctgggctggctgctgctggccgaagcgaagggcgacgccaagccggaggacaaccttttagtcctcacggtggccactaaggagaccgagggattccgtcgcttcaagcgctcagctcagttcttcaactacaagatccaggcgcttggcctaggggaggactggaatgtggagaaggggacgtcggcaggtggagggcagaaggtccggctgctgaagaaagctctggagaagcacgcagacaaggaggatctggtcattctcttcgcagacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgggctctggaggcttcatcggttatgcccccaacctcagcaaactggtggccgagtgggagggccaggacagcgacagcgatcagctgttttacaccaagatcttcttggacccggagaagagggagcagatcaatatcaccctggaccaccgctgccgtatcttccagaacctggatggagccttggatgaggtcgtgctcaagtttgaaatgggccatgtgagagcgaggaacctggcctatgacaccctcccggtcctgatccatggcaacgggccaaccaagctgcagttgaactacctgggcaactacatcccgcgcttctggaccttcgaaacaggctgcaccgtgtgtgacgaaggcttgcgcagcctcaagggcattgggcggctcctgcggctccactacccccagaaacacatgcgacttttcatccacaaccacgagcagcaccacaaggctcaggtggaagagttcctggcacagcatggcagcgagtaccagtctgtgaagctggtgggccctgaggtgcggatggcgaatgcagatgccaggaacatgggcgcagacctgtgccggcaggaccgcagctgcacctactacttcagcgtggatgctgacgtggccctgaccgagcccaacagcctgcggctgctgatccaacagaacaagaacgtcattgccccgctgatgacccggcatgggaggctgtggtcgaacttctggggggctctcagtgcagatggctactatgcccgttccgaggactacgtggacattgtgcaggggcggcgtgttggtgtctggaatgtgccctatatttcaaacatctacttgatcaagggcagtgccctgcggggtgagctgcagtcctcagatctcttccaccacagcaagctggaccccgacatggccttctgtgccaacatccggcagcaggatgtgttcatgttcctgaccaaccggcacacccttggccatctgctctccctagacagctaccgcaccacccacctgcacaacgacctctgggaggtgttcagcaaccccgaggactggaaggagaagtacatccaccagaactacaccaaagccctggcagggaagctggtggagacgccctgcccggatgtctattggttccccatcttcacggaggtggcctgtgatgagctggtggaggagatggagcactttggccagtggtctctgggcaacaacaaggacaaccgcatccagggtggctacgagaacgtgccgactattgacatccacatgaaccagatcggctttgagcgggagtggcacaaattcctgctggagtacattgcgcccatgacggagaagctctaccccggctactacaccagggcccagtttgacctggcctttgtcgtccgctacaagcctgatgagcagccctcactgatgccacaccatgatgcctccaccttcaccatcaacatcgccctgaaccgagtcggggtggattacgagggcgggggctgtcggttcctgcgctacaactgttccatccgagccccaaggaagggctggaccctcatgcaccctggacgactcacgcattaccatgaggggctccccaccaccaggggcacccgctacatcgcagtctccttcgtcgatccctaattggccaggcctgaccctcttggacctttcttctttgccgacaaccactgcccagcagcctctgggacctcggggtcccagggaacccagtccagcctcctggctgttgacttcccattgctcttggagccaccaatcaaagagattcaaagagattcctgcaggccagaggcggaacacacctttatggctggggctctccgtggtgttctggacccagcccctggagacaccattcacttttactgctttgtagtgactcgtgctctccaacctgtcttcctgaaaaaccaaggcccccttcccccacctcttccatggggtgagacttgagcagaacaggggcttccccaagttgcccagaaagactgtctgggtgagaagccatggccagagcttctccccaggcacaggtgttgcaccagggacttctgcttcaagttttggggtaaagacacctggatcagactccaagggctgccctgagtctgggacttctgcctccatggctggtcatgagagcaaaccgtagtcccctggagacagcgactccagagaacctcttgggagacagaagaggcatctgtgcacagctcgatcttctacttgcctgtggggaggggagtgacaggtccacacaccacactgggtcaccctgtcctggatgcctctgaagagagggacagaccgtcagaaactggagagtttctattaaaggtcatttaaaccactgaagggaa

SEQ ID NO: 455752 - DNA, 2345 bp, Homo sapiens
ggcccagtgcgtggcagcgggacctgcggccccgtcgcgaagtttccagccctgcgagcgccgccgggtcggccgatcgtcccccatacctcggccatgcggcccctgctgctactggccctgctgggctggctgctgctggccgaagcgaagggcgacgccaagccggaggacaaccttttagtcctcacggtggccactaaggagaccgagggattccgtcgcttcaagcgctcagctcagttcttcaactacaagatccaggcgcttggcctaggggaggactggaatgtggagaaggggacgtcggcaggtggagggcagaaggtccggctgctgaagaaagctctggagaagcacgcagacaaggaggatctggtcattctcttcgcagacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgggctctggaggcttcatcggttatgcccccaacctcagcaaactggtggccgagtgggagggccaggacagcgacagcgatcagctgttttacaccaagatcttcttggacccggagaagagggagcagatcaatatcaccctggaccaccgctgccgtatcttccagaacctggatggagccttggatgaggtcgtgctcaagtttgaaatgggccatgtgagagcgaggaacctggcctatgacaccctcccggtcctgatccatggcaacgggccaaccaagctgcagttgaactacctgggcaactacatcccgcgcttctggaccttcgaaacaggctgcaccgtgtgtgacgaaggcttgcgcagcctcaagggcattggggatgaagctctgcccacggtcctggtcggcgtgttcatcgaacagcccacgccgtttgtgtccctgttcttccagcggctcctgcggctccactacccccagaaacacatgcgacttttcatccacaaccacgagcagcaccacaaggctcaggtggaagagttcctggcacagcatggcagcgagtaccagtctgtgaagctggtgggccctgaggtgcggatggcgaatgcagatgccaggaacatgggcgcagacctgtgccggcaggaccgcagctgcacctactacttcagcgtggatgctgacgtggccctgaccgagcccaacagcctgcggctgctgatccaacagaacaagaacgtcattgccccgctgatgacccggcatgggaggctgtggtcgaacttctggggggctctcagtgcagatggctactatgcccgttccgaggactacgtggacattgtgcaggggcggcgtgttggtgtctggaatgtgccctatatttcaaacatctacttgatcaagggcagtgccctgcggggtgagctgcagtcctcagatctcttccaccacagcaagctggaccccgacatggccttctgtgccaacatccggcagcaggatgtgttcatgttcctgaccaaccggcacacccttggccatctgctctccctagacagctaccgcaccacccacctgcacaacgacctctgggaggtgttcagcaaccccgaggactggaaggagaagtacatccaccagaactacaccaaagccctggcagggaagctggtggagacgccctgcccggatgtctattggttccccatcttcacggaggtggcctgtgatgagctggtggaggagatggagcactttggccagtggtctctgggcaacaacaaggacaaccgcatccagggtggctacgagaacgtgccgactattgacatccacatgaaccagatcggctttgagcgggagtggcacaaattcctgctggagtacattgcgcccatgacggagaagctctaccccggctactacaccagggcccagtttgacctggcctttgtcgtccgctacaagcctgatgagcagccctcactgatgccacaccatgatgcctccaccttcaccatcaacatcgccctgaaccgagtcggggtggattacgagggcgggggctgtcggttcctgcgctacaactgttccatccgagccccaaggaagggctggaccctcatgcaccctggacgactcacgcattaccatgaggggctccccaccaccaggggcacccgctacatcgcagtctccttcgtcgatccctaattggcggacagaccgtcagaaactggagagtttctattaaaggtcatttaaaccactgaagggaa

SEQ ID NO: 455753 - DNA, 1661 bp, Homo sapiens
ggcccagtgcgtggcagcgggacctgcggccccgtcgcgaagtttccagccctgcgagcgccgccgggtcggccgatcgtcccccatacctcggccatgcggcccctgctgctactggccctgctgggctggctgctgctggccgaagcgaagggcgacgccaagccggaggacaaccttttagtcctcacggtggccactaaggagaccgagggattccgtcgcttcaagcgctcagctcagttcttcaactacaagatccaggcgcttggcctaggggaggactggaatgtggagaaggggacgtcggcaggtggagggcagaaggtccggctgctgaagaaagctctggagaagcacgcagacaaggaggatctggtcattctcttcgcagacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgggctctggaggcttcatcggttatgcccccaacctcagcaaactggtggccgagtgggagggccaggacagcgacagcgatcagctgttttacaccaagatcttcttggacccggagaagagggagcagatcaatatcaccctggaccaccgctgccgtatcttccagaacctggatggagccttggatgaggtcgtgctcaagtttgaaatgggccatgtgagagcgaggaacctggcctatgacaccctcccggtcctgatccatggcaacgggccaaccaagctgcagttgaactacctgggcaactacatcccgcgcttctggaccttcgaaacaggctgcaccgtgtgtgacgaaggcttgcgcagcctcaagggcattggggatgaagctctgcccacggtcctggtcggcgtgttcatcgaacagcccacgccgtttgtgtccctgttcttccagcggctcctgcggctccactacccccagaaacacatgcgacttttcatccacaaccacgagcagcaccacaaggctcaggtggaagagttcctggcacagcatggcagcgagtaccagtctgtgaagctggtgggccctgaggtgcggatggcgaatgcagatgccaggaacatgggcgcagacctgtgccggcaggaccgcagctgcacctactacttcagcgtggatgctgacgtggccctgaccgagcccaacagcctgcggctgctgatccaacagaacaagaacgtcattgccccgctgatgacccggcatgggaggctgtggtcgaacttctggggggctctcagtgcagatggctactatgcccgttccgaggactacgtggacattgtgcaggggcggcgtgttggtgtctggaatgtgccctatatttcaaacatctacttgatcacttcagcgtggatgctgacgtggccctgaccgagcccaacagcctgcggctgctgatccaacagaacaagaacgtcattgccccgctgatgacccggcatgggaggctgtggtcgaacttctggggggctctcagtgcagatggctactatgcccgttccgaggactacgtggacattgtgcaggggcggcgt

SEQ ID NO: 455754 - DNA, 869 bp, Homo sapiens
ggcccagtgcgtggcagcgggacctgcggccccgtcgcgaagtttccagccctgcgagcgccgccgggtcggccgatcgtcccccatacctcggccatgcggcccctgctgctactggccctgctgggctggctgctgctggccgaagcgaagggcgacgccaagccggaggacaaccttttagtcctcacggtggccactaaggagaccgagggattccgtcgcttcaagcgctcagctcagttcttcaactacaagatccaggcgcttggcctaggggaggactggaatgtggagaaggggacgtcggcaggtggagggcagaaggtccggctgctgaagaaagctctggagaagcacgcagacaaggaggatctggtcattctcttcgcagacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgggctctggaggcttcatcggttatgcccccaacctcagcaaactggtggccgagtgggagggccaggacagcgacagcgatcagctgttttacaccaagatcttcttggacccggagaagagggtgagccggctgcattcttagattccttccagttcagagtccctggttttctgtgagtagagccactagactgtagaccccaggagcttggctgctggccttctctgggcacctagctgccctgatgtgacgtggcagagtcggtgtggggaatgagggctgaacttggggacagattccccacactgggtgag

SEQ ID NO: 455755 - DNA, 608 bp, Homo sapiens
tgcccctgataaggtaagagatggagcaggagatgggaggcagaggaagatgatgaacaggcccctggcacagagggagacacacactaaaggagaaagagtaattcacacagagccggctgtgcgggagaccggagttttattattacttaaatcggttctccccagtcatgtggggatcagagttcttaaatataatttggcaggtaggggcttggaaagtggaaaatgctgattggtcagattggagatggaatcataggaggtggaagttaggtattcttaatgtcttctgttcctgggtgcgatggtagaactggttgggccagattactggtctggctggtgtcagctgatccatcgggtgcagggtctgcagaatatctcaagcactgactttaggttttacaatagtgatgttaccccaggagcaatttggggaggacccaaaggctgcatgacccctaaattgtaatttctaatcttatagctactttgccagtcctgcaaaggcagactggaccccaggcaagaagaagggtctttttgggaaagggctgttataaattttgtttcagagtcaaaccatgaactgaattccttcccaa

SEQ ID NO: 455756 - DNA, 5202 bp, Homo sapiens
gggcagagatgcctccagctgggctttgagggtgtcagtcttccctcaaataggaaagatgaggggcaggggaggatattggggacaagcctctgctcagccctgggtcctcttggaaccgggcttggagccggaggtggggagggtgtccaagctgagctcctggattcccatctgccgaactgcacccagaaccaggagtggggtgcgggcccatcctctggccaggatcctgggctcccttggccacaaagcaggacaggggaccagagatcccccaactcaggagacgtgaagctggcagctgggccgctggcctagaaatggcctcaaatggaagctgccacccgatcctggtggaggctttgagctaggctagagatcaggactccagggttcagtgcgcacgtgctgcccctgcactagggccgaagcaatgcgggtgctggcgaccgacgcaaggaggtgacgcacaggggacttaaggagcggaccgccgcgggaggacgcgcccagctcagggggactccctctgcgccccccacgctgggtctccggcccacgcgtggcccggctggtctgcggagctagcgccagggccgccagagggcgcccggggcggaggatggggcgggagccggggaagcccgggaggtggtggccgagtgggcgccgcccctctgggtctgcggctcaggtcgaagagtcggctgcgtgggccggggaatccggattccgggggttcaacgcccaggggttccatgagcccctactgttctcggacgcccggccggccccgacgcactcgtcctagcacccctcccctgtccggtcctccggcccctccgccgtcgcccctccggggtccagccgggcggggctgctccagggtcgcggctggcgcgggtccccgggccctggccctccggtgccccgggccaaggagagaaaacttgagcatccacgcacaggggtggggagcaggatcccactctgagggtgcactgccccgccctctccgggtctgcctcggccccgcccgggccccaggccccgccccctcccctcggccggcccgagagctccgggggccgctgcagccgcccaagcgcccgccatgcgcgctgcccgcgccgcgccgctgctccagctgctgctcctgctggggccgtggctggaggctgcgggcgttgcggagtcgccgctgcccgccgtggtccttgccatcctggcccgcaatgccgaacactcgctgccccactacctgggcgctctggagcggctggactacccccgggccaggatggccctctggtgagagacccgggcattggcaccgagtgggcacctaacccccagcttcgcagatggcccccgcccccggcggccctgtctgctcgctccctgcccagacaccacctagacaggcccctcccctcacagacggccctgccagcccgagccgccagagaggaccccgagccccctgctgggagacgacagacctctgaggccacaggccgacgcgggacacccacccctccttctggtcccctactccttcctcttggggccttccctgggtgtaggttgggcccagccagcccttttcaccccagccttcagggcccagctcaaccccagtgggacctgtggttggctggatttgaagaggagcagacaggaacctctgaagtccactggggcccaacgtggcagggatcgaccacgctggaggcttccgggcacaggttgggggtgccatcagcactgggctccgggctgtgcaggggagtcagaccggcccccccaccgcccccgtgctggggccagctctcttggtagatcttggtagaggggcgggatcctgtcagccaagggcagtcccccttcctggagcctctcccctctggcatctctgtacccccagggcactgggatcgaaggccacaacccctggtctgtagacaccagaacagggaggagtccctggctgaggttgggggtaaactgagaaaaatgacaagccaccctcttcaacacaccacagttgggctgggggggtggagccctggcctggggaggccgcccacaattaccacagtttgggagtttgttagttcccacccctgtaagacttgacacgtagtcttcatttctggggaattggcttaaaggggcagcatcacccaaaacctgggcacttggctaaacccccacctctgttatgggggccccttccccaggagaggggaggctgtgccccatgacagcagagcttggacccatctgcattcttagggacgcttagagcatggtttggtccttattacaacctgggggtggaggaaagcagcagctcttctgtctagtccccattcagagagggacaggggctggcctgtggtcacacagccacaggtcacataggtaggtatctgcccacctaacgaaggtaaccagggaatgcaccaggtgtgatccttaaagtcgaggtacttttcatctttcaaaatgcattcgttggccaggtgtggtggctcacgcctgtaatttcagcactttgggaggccgaagtgggcagatcacctgaggtgaggagttcaagaccagcctggctaacatggtgaaaccccatctctactaaacaaacaaaaattagccgggcatggtggtgcacacctgtaatcccaggtactcaggaggctgaggcaggagaatcacttgaacccgggaggcggaggttgcagtgagtcgagatcataccactgcactacagcctgggcgacagagcaagattccatctcaaaaaaaatgcattattcttctcttatctttgtccatgacataagcaggacagcttaagttatagagggaggacgtgaagcccagagaaagatgggacttgcctgaggtcacacagcaggtcacagaactgtggtggggacctggctgtgctgcctccagcctctctgctgtagcacacctacccttcactgttccaaggagagctcgacctcaaaggtgttagtgctttggggtcaaggctgccttggggttcaatcctgtggctgtgccccctcagccttttttcttcccgtccccaggtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggcctttcgacgacatcatcgtcttcgcctatgcctgccaggctgctggggtctccgtccacgtgtgcaatgagcaccgttatgggtacatgaatgtgccggtgaaatcccaccaggggctggaagacgagagggtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatggctggatgctcaacagcagtgccatcaggaacctcggcgtagacctgctcccgggctaccaggacccttactcgggccgcactctgaccaagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgatctacctcggacggaagcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaacgagcagtacaaggcacacttctggccacgggacctggtggccttctccgcccagcccctgctcgctgcccctacccactatgccggggacgccgagtggctcagtgacacggagacatcctctccatgggatgatgacagcggccgcctcatcagctggagcggctcccaaaagaccctgcgcagcccccgcctggacctgactggcagcagcgggcacagcctccaaccccagccccgagatgagctctaggtccaggtgatgactgcaaagcagtgtccaggagcaggccactactgcccagagagcagaggaggaggttgttggcagggactgcagatcctgtcagacctggccaccaccttgggcatggccactctgccctctggacctgtctttcatcgggagaaaccactcagagatggatcccattccctaaaggtctcacagcaaaggagcaggactcccaggcccctgtaccctgcctggcctgatttcagggccttgtggcccccagcttctgtttcaagctgggcagaccccaggatcccttccctccctaaggactcagctgaggggcccctctgcccccttctacctccacctcagcaccctcccccagcttgatgtttgggtctccccagcaccctcctccctggccggtgcaaagtacagggaggtaaagcaggacccttgcagacatgttgcccagcacacagtaggccctcaataaaagccatttgcactttaaatata

SEQ ID NO: 455757 - DNA, 5247 bp, Homo sapiens
gggcagagatgcctccagctgggctttgagggtgtcagtcttccctcaaataggaaagatgaggggcaggggaggatattggggacaagcctctgctcagccctgggtcctcttggaaccgggcttggagccggaggtggggagggtgtccaagctgagctcctggattcccatctgccgaactgcacccagaaccaggagtggggtgcgggcccatcctctggccaggatcctgggctcccttggccacaaagcaggacaggggaccagagatcccccaactcaggagacgtgaagctggcagctgggccgctggcctagaaatggcctcaaatggaagctgccacccgatcctggtggaggctttgagctaggctagagatcaggactccagggttcagtgcgcacgtgctgcccctgcactagggccgaagcaatgcgggtgctggcgaccgacgcaaggaggtgacgcacaggggacttaaggagcggaccgccgcgggaggacgcgcccagctcagggggactccctctgcgccccccacgctgggtctccggcccacgcgtggcccggctggtctgcggagctagcgccagggccgccagagggcgcccggggcggaggatggggcgggagccggggaagcccgggaggtggtggccgagtgggcgccgcccctctgggtctgcggctcaggtcgaagagtcggctgcgtgggccggggaatccggattccgggggttcaacgcccaggggttccatgagcccctactgttctcggacgcccggccggccccgacgcactcgtcctagcacccctcccctgtccggtcctccggcccctccgccgtcgcccctccggggtccagccgggcggggctgctccagggtcgcggctggcgcgggtccccgggccctggccctccggtgccccgggccaaggagagaaaacttgagcatccacgcacaggggtggggagcaggatcccactctgagggtgcactgccccgccctctccgggtctgcctcggccccgcccgggccccaggccccgccccctcccctcggccggcccgagagctccgggggccgctgcagccgcccaagcgcccgccatgcgcgctgcccgcgccgcgccgctgctccagctgctgctcctgctggggccgtggctggaggctgcgggcgttgcggagtcgccgctgcccgccgtggtccttgccatcctggcccgcaatgccgaacactcgctgccccactacctgggcgctctggagcggctggactacccccgggccaggatggccctctggtgagagacccgggcattggcaccgagtgggcacctaacccccagcttcgcagatggcccccgcccccggcggccctgtctgctcgctccctgcccagacaccacctagacaggcccctcccctcacagacggccctgccagcccgagccgccagagaggaccccgagccccctgctgggagacgacagacctctgaggccacaggccgacgcgggacacccacccctccttctggtcccctactccttcctcttggggccttccctgggtgtaggttgggcccagccagcccttttcaccccagccttcagggcccagctcaaccccagtgggacctgtggttggctggatttgaagaggagcagacaggaacctctgaagtccactggggcccaacgtggcagggatcgaccacgctggaggcttccgggcacaggttgggggtgccatcagcactgggctccgggctgtgcaggggagtcagaccggcccccccaccgcccccgtgctggggccagctctcttggtagatcttggtagaggggcgggatcctgtcagccaagggcagtcccccttcctggagcctctcccctctggcatctctgtacccccagggcactgggatcgaaggccacaacccctggtctgtagacaccagaacagggaggagtccctggctgaggttgggggtaaactgagaaaaatgacaagccaccctcttcaacacaccacagttgggctgggggggtggagccctggcctggggaggccgcccacaattaccacagtttgggagtttgttagttcccacccctgtaagacttgacacgtagtcttcatttctggggaattggcttaaaggggcagcatcacccaaaacctgggcacttggctaaacccccacctctgttatgggggccccttccccaggagaggggaggctgtgccccatgacagcagagcttggacccatctgcattcttagggacgcttagagcatggtttggtccttattacaacctgggggtggaggaaagcagcagctcttctgtctagtccccattcagagagggacaggggctggcctgtggtcacacagccacaggtcacataggtaggtatctgcccacctaacgaaggtaaccagggaatgcaccaggtgtgatccttaaagtcgaggtacttttcatctttcaaaatgcattcgttggccaggtgtggtggctcacgcctgtaatttcagcactttgggaggccgaagtgggcagatcacctgaggtgaggagttcaagaccagcctggctaacatggtgaaaccccatctctactaaacaaacaaaaattagccgggcatggtggtgcacacctgtaatcccaggtactcaggaggctgaggcaggagaatcacttgaacccgggaggcggaggttgcagtgagtcgagatcataccactgcactacagcctgggcgacagagcaagattccatctcaaaaaaaatgcattattcttctcttatctttgtccatgacataagcaggacagcttaagttatagagggaggacgtgaagcccagagaaagatgggacttgcctgaggtcacacagcaggtcacagaactgtggtggggacctggctgtgctgcctccagcctctctgctgtagcacacctacccttcactgttccaaggagagctcgacctcaaaggtgttagtgctttggggtcaaggctgccttggggttcaatcctgtggctgtgccccctcagccttttttcttcccgtccccaggtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggcctttcgacgacatcatcgtcttcgcctatgcctgccaggctgctggggtctccgtccacgtgtgcaatgagcaccgttatgggtacatgaatgtgccggtgaaatcccaccaggggctggaagacgagagggtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatggctggatgctcaacagcagtgccatcaggaacctcggcgtagacctgctcccgggctaccaggacccttactcgggccgcactctgaccaagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgatctacctcggacggaagcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaacgagcagtacaaggcacacttctggccacgggacctggtggccttctccgcccagcccctgctcgctgcccctacccactatgccggggacgccgagtggctcagtgacacggagacatcctctccatgggatgatgacagcggccgcctcatcagctggagcggctcccaaaagaccctgcgcagcccccgcctggacctgactggcagcagcgggcacagcctccaaccccagccccgagatgagctctaggtccaggtgatgactgcaaagcagtgtccaggagcaggccactactgcccagagagcagaggaggaggttgttggcagggactgcagatcctgtcagacctggccaccaccttgggcatggccactctgccctctggacctgtctttcatcgggagaaaccactcagagatggatcccattccctaaaggtctcacagcaaaggagcaggactcccaggcccctgtaccctgcctggcctgatttcagggccttgtggcccccagcttctgtttcaagctgggcagaccccaggatcccttccctccctaaggactcagctgaggggcccctctgcccccttctacctccacctcagcaccctcccccagcttgatgtttgggtctccccagcaccctcctccctggccggtgcaaagtacagggaggtaaagcaggacccttgcagacatgttgcccagcacacagtaggccctcaataaaagccatttgcactttaaatatatatatgtatgtatatatatgtatatatatatatatatatatatgt

SEQ ID NO: 455758 - DNA, 2190 bp, Homo sapiens
  misc_feature (18)..(19): n is a, c, g, or t
  misc_feature (44)..(44): n is a, c, g, or t
cccggatcacagtcaaanntacggctaggtacgaggctgggtgntggtcaatcctgtggctgtgccccctcagccttttttcttcccgtccccaggtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggcctttcgacgacatcatcgtcttcgcctatgcctgccaggctgctggggtctccgtccacgtgtgcaatgagcaccgttatgggtacatgaatgtgccggtgaaatcccaccaggggctggaagacgagagggtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatggctggatgctcaacagcagtgccatcaggaacctcggcgtagacctgctcccgggctaccaggacccttactcgggccgcactctgaccaagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgatctacctcggacggaagcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaacgagcagtacaaggcacacttctggccacgggacctggtggccttctccgcccagcccctgctcgctgcccctacccactatgccggggacgccgagtggctcagtgacacggagacatcctctccatgggatgatgacagcggccgcctcatcagctggagcggctcccaaaagaccctgcgcagcccccgcctggacctgactggcagcagcgggcacagcctccaaccccagccccgagatgagctctaggtccaggtgatgactgcaaagcagtgtccaggagcaggccactactgcccagagagcagaggaggaggttgttggcagggactgcagatcctgtcagacctggccaccaccttgggcatggccactctgccctctggacctgtctttcatcgggagaaaccactcagagatggatcccattccctaaaggtctcacagcaaaggagcaggactcccaggcccctgtaccctgcctggcctgatttcagggccttgtggcccccagcttctgtttcaagctgggcagaccccaggatcccttccctccctaaggactcagctgaggggcccctctgcccccttctacctccacctcagcaccctcccccagcttgatgtttgggtctccccagcaccctcctccctggccggtgcaaagtacagggaggtaaagcaggacccttgcagacatgttgcccagcacacagtaggccctcaataaaagccatttgcactttaaatata

SEQ ID NO: 455759 - DNA, 5121 bp, Homo sapiens
gggcagagatgcctccagctgggctttgagggtgtcagtcttccctcaaataggaaagatgaggggcaggggaggatattggggacaagcctctgctcagccctgggtcctcttggaaccgggcttggagccggaggtggggagggtgtccaagctgagctcctggattcccatctgccgaactgcacccagaaccaggagtggggtgcgggcccatcctctggccaggatcctgggctcccttggccacaaagcaggacaggggaccagagatcccccaactcaggagacgtgaagctggcagctgggccgctggcctagaaatggcctcaaatggaagctgccacccgatcctggtggaggctttgagctaggctagagatcaggactccagggttcagtgcgcacgtgctgcccctgcactagggccgaagcaatgcgggtgctggcgaccgacgcaaggaggtgacgcacaggggacttaaggagcggaccgccgcgggaggacgcgcccagctcagggggactccctctgcgccccccacgctgggtctccggcccacgcgtggcccggctggtctgcggagctagcgccagggccgccagagggcgcccggggcggaggatggggcgggagccggggaagcccgggaggtggtggccgagtgggcgccgcccctctgggtctgcggctcaggtcgaagagtcggctgcgtgggccggggaatccggattccgggggttcaacgcccaggggttccatgagcccctactgttctcggacgcccggccggccccgacgcactcgtcctagcacccctcccctgtccggtcctccggcccctccgccgtcgcccctccggggtccagccgggcggggctgctccagggtcgcggctggcgcgggtccccgggccctggccctccggtgccccgggccaaggagagaaaacttgagcatccacgcacaggggtggggagcaggatcccactctgagggtgcactgccccgccctctccgggtctgcctcggccccgcccgggccccaggccccgccccctcccctcggccggcccgagagctccgggggccgctgcagccgcccaagcgcccgccatgcgcgctgcccgcgccgcgccgctgctccagctgctgctcctgctggggccgtggctggaggctgcgggcgttgcggagtcgccgctgcccgccgtggtccttgccatcctggcccgcaatgccgaacactcgctgccccactacctgggcgctctggagcggctggactacccccgggccaggatggccctctggtgagagacccgggcattggcaccgagtgggcacctaacccccagcttcgcagatggcccccgcccccggcggccctgtctgctcgctccctgcccagacaccacctagacaggcccctcccctcacagacggccctgccagcccgagccgccagagaggaccccgagccccctgctgggagacgacagacctctgaggccacaggccgacgcgggacacccacccctccttctggtcccctactccttcctcttggggccttccctgggtgtaggttgggcccagccagcccttttcaccccagccttcagggcccagctcaaccccagtgggacctgtggttggctggatttgaagaggagcagacaggaacctctgaagtccactggggcccaacgtggcagggatcgaccacgctggaggcttccgggcacaggttgggggtgccatcagcactgggctccgggctgtgcaggggagtcagaccggcccccccaccgcccccgtgctggggccagctctcttggtagatcttggtagaggggcgggatcctgtcagccaagggcagtcccccttcctggagcctctcccctctggcatctctgtacccccagggcactgggatcgaaggccacaacccctggtctgtagacaccagaacagggaggagtccctggctgaggttgggggtaaactgagaaaaatgacaagccaccctcttcaacacaccacagttgggctgggggggtggagccctggcctggggaggccgcccacaattaccacagtttgggagtttgttagttcccacccctgtaagacttgacacgtagtcttcatttctggggaattggcttaaaggggcagcatcacccaaaacctgggcacttggctaaacccccacctctgttatgggggccccttccccaggagaggggaggctgtgccccatgacagcagagcttggacccatctgcattcttagggacgcttagagcatggtttggtccttattacaacctgggggtggaggaaagcagcagctcttctgtctagtccccattcagagagggacaggggctggcctgtggtcacacagccacaggtcacataggtaggtatctgcccacctaacgaaggtaaccagggaatgcaccaggtgtgatccttaaagtcgaggtacttttcatctttcaaaatgcattcgttggccaggtgtggtggctcacgcctgtaatttcagcactttgggaggccgaagtgggcagatcacctgaggtgaggagttcaagaccagcctggctaacatggtgaaaccccatctctactaaacaaacaaaaattagccgggcatggtggtgcacacctgtaatcccaggtactcaggaggctgaggcaggagaatcacttgaacccgggaggcggaggttgcagtgagtcgagatcataccactgcactacagcctgggcgacagagcaagattccatctcaaaaaaaatgcattattcttctcttatctttgtccatgacataagcaggacagcttaagttatagagggaggacgtgaagcccagagaaagatgggacttgcctgaggtcacacagcaggtcacagaactgtggtggggacctggctgtgctgcctccagcctctctgctgtagcacacctacccttcactgttccaaggagagctcgacctcaaaggtgtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggcctttcgacgacatcatcgtcttcgcctatgcctgccaggctgctggggtctccgtccacgtgtgcaatgagcaccgttatgggtacatgaatgtgccggtgaaatcccaccaggggctggaagacgagagggtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatggctggatgctcaacagcagtgccatcaggaacctcggcgtagacctgctcccgggctaccaggacccttactcgggccgcactctgaccaagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgatctacctcggacggaagcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaacgagcagtacaaggcacacttctggccacgggacctggtggccttctccgcccagcccctgctcgctgcccctacccactatgccggggacgccgagtggctcagtgacacggagacatcctctccatgggatgatgacagcggccgcctcatcagctggagcggctcccaaaagaccctgcgcagcccccgcctggacctgactggcagcagcgggcacagcctccaaccccagccccgagatgagctctaggtccaggtgatgactgcaaagcagtgtccaggagcaggccactactgcccagagagcagaggaggaggttgttggcagggactgcagatcctgtcagacctggccaccaccttgggcatggccactctgccctctggacctgtctttcatcgggagaaaccactcagagatggatcccattccctaaaggtctcacagcaaaggagcaggactcccaggcccctgtaccctgcctggcctgatttcagggccttgtggcccccagcttctgtttcaagctgggcagaccccaggatcccttccctccctaaggactcagctgaggggcccctctgcccccttctacctccacctcagcaccctcccccagcttgatgtttgggtctccccagcaccctcctccctggccggtgcaaagtacagggaggtaaagcaggacccttgcagacatgttgcccagcacacagtaggccctcaataaaagccatttgcactttaaatata

SEQ ID NO: 455760 - DNA, 2285 bp, Homo sapiens
ggacctgtctgaggttggtgacagacacccagttcgatcccatctgtggtgccgccaggccgctcccttttctgctcctctcccgagaggctgcagagttctttccctcccagcagggtcctaaggaccccggcggtgctccaggggagccaacatcccctgctttggaggacggacgggtcgggtcgcagtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggcctttcgacgacatcatcgtcttcgcctatgcctgccaggctgctggggtctccgtccacgtgtgcaatgagcaccgttatgggtacatgaatgtgccggtgaaatcccaccaggggctggaagacgagagggtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatggctggatgctcaacagcagtgccatcaggaacctcggcgtagacctgctcccgggctaccaggacccttactcgggccgcactctgaccaagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgatctacctcggacggaagcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaacgagcagtacaaggcacacttctggccacgggacctggtggccttctccgcccagcccctgctcgctgcccctacccactatgccggggacgccgagtggctcagtgacacggagacatcctctccatgggatgatgacagcggccgcctcatcagctggagcggctcccaaaagaccctgcgcagcccccgcctggacctgactggcagcagcgggcacagcctccaaccccagccccgagatgagctctaggtccaggtgatgactgcaaagcagtgtccaggagcaggccactactgcccagagagcagaggaggaggttgttggcagggactgcagatcctgtcagacctggccaccaccttgggcatggccactctgccctctggacctgtctttcatcgggagaaaccactcagagatggatcccattccctaaaggtctcacagcaaaggagcaggactcccaggcccctgtaccctgcctggcctgatttcagggccttgtggcccccagcttctgtttcaagctgggcagaccccaggatcccttccctccctaaggactcagctgaggggcccctctgcccccttctacctccacctcagcaccctcccccagcttgatgtttgggtctccccagcaccctcctccctggccggtgcaaagtacagggaggtaaagcaggacccttgcagacatgttgcccagcacacagtaggccctcaataaaagccatttgcactttaaatata

SEQ ID NO: 455761 - DNA, 5103 bp, Homo sapiens
gggcagagatgcctccagctgggctttgagggtgtcagtcttccctcaaataggaaagatgaggggcaggggaggatattggggacaagcctctgctcagccctgggtcctcttggaaccgggcttggagccggaggtggggagggtgtccaagctgagctcctggattcccatctgccgaactgcacccagaaccaggagtggggtgcgggcccatcctctggccaggatcctgggctcccttggccacaaagcaggacaggggaccagagatcccccaactcaggagacgtgaagctggcagctgggccgctggcctagaaatggcctcaaatggaagctgccacccgatcctggtggaggctttgagctaggctagagatcaggactccagggttcagtgcgcacgtgctgcccctgcactagggccgaagcaatgcgggtgctggcgaccgacgcaaggaggtgacgcacaggggacttaaggagcggaccgccgcgggaggacgcgcccagctcagggggactccctctgcgccccccacgctgggtctccggcccacgcgtggcccggctggtctgcggagctagcgccagggccgccagagggcgcccggggcggaggatggggcgggagccggggaagcccgggaggtggtggccgagtgggcgccgcccctctgggtctgcggctcaggtcgaagagtcggctgcgtgggccggggaatccggattccgggggttcaacgcccaggggttccatgagcccctactgttctcggacgcccggccggccccgacgcactcgtcctagcacccctcccctgtccggtcctccggcccctccgccgtcgcccctccggggtccagccgggcggggctgctccagggtcgcggctggcgcgggtccccgggccctggccctccggtgccccgggccaaggagagaaaacttgagcatccacgcacaggggtggggagcaggatcccactctgagggtgcactgccccgccctctccgggtctgcctcggccccgcccgggccccaggccccgccccctcccctcggccggcccgagagctccgggggccgctgcagccgcccaagcgcccgccatgcgcgctgcccgcgccgcgccgctgctccagctgctgctcctgctggggccgtggctggaggctgcgggcgttgcggagtcgccgctgcccgccgtggtccttgccatcctggcccgcaatgccgaacactcgctgccccactacctgggcgctctggagcggctggactacccccgggccaggatggccctctggtgagagacccgggcattggcaccgagtgggcacctaacccccagcttcgcagatggcccccgcccccggcggccctgtctgctcgctccctgcccagacaccacctagacaggcccctcccctcacagacggccctgccagcccgagccgccagagaggaccccgagccccctgctgggagacgacagacctctgaggccacaggccgacgcgggacacccacccctccttctggtcccctactccttcctcttggggccttccctgggtgtaggttgggcccagccagcccttttcaccccagccttcagggcccagctcaaccccagtgggacctgtggttggctggatttgaagaggagcagacaggaacctctgaagtccactggggcccaacgtggcagggatcgaccacgctggaggcttccgggcacaggttgggggtgccatcagcactgggctccgggctgtgcaggggagtcagaccggcccccccaccgcccccgtgctggggccagctctcttggtagatcttggtagaggggcgggatcctgtcagccaagggcagtcccccttcctggagcctctcccctctggcatctctgtacccccagggcactgggatcgaaggccacaacccctggtctgtagacaccagaacagggaggagtccctggctgaggttgggggtaaactgagaaaaatgacaagccaccctcttcaacacaccacagttgggctgggggggtggagccctggcctggggaggccgcccacaattaccacagtttgggagtttgttagttcccacccctgtaagacttgacacgtagtcttcatttctggggaattggcttaaaggggcagcatcacccaaaacctgggcacttggctaaacccccacctctgttatgggggccccttccccaggagaggggaggctgtgccccatgacagcagagcttggacccatctgcattcttagggacgcttagagcatggtttggtccttattacaacctgggggtggaggaaagcagcagctcttctgtctagtccccattcagagagggacaggggctggcctgtggtcacacagccacaggtcacataggtaggtatctgcccacctaacgaaggtaaccagggaatgcaccaggtgtgatccttaaagtcgaggtacttttcatctttcaaaatgcattcgttggccaggtgtggtggctcacgcctgtaatttcagcactttgggaggccgaagtgggcagatcacctgaggtgaggagttcaagaccagcctggctaacatggtgaaaccccatctctactaaacaaacaaaaattagccgggcatggtggtgcacacctgtaatcccaggtactcaggaggctgaggcaggagaatcacttgaacccgggaggcggaggttgcagtgagtcgagatcataccactgcactacagcctgggcgacagagcaagattccatctcaaaaaaaatgcattattcttctcttatctttgtccatgacataagcaggacagcttaagttatagagggaggacgtgaagcccagagaaagatgggacttgcctgaggtcacacagcaggtcacagaactgtggtggggacctggctgtgctgcctccagcctctctgctgtagcacacctacccttcactgttccaaggagagctcgacctcaaaggtgttagtgctttggggtcaaggctgccttggggttcaatcctgtggctgtgccccctcagccttttttcttcccgtccccaggtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggcctttcgacgacatcatcgtcttcgcctatgcctgccaggctgctggggtctccgtccacgtgtgcaatgagcaccgttatgggtacatgaatgtgccggtgaaatcccaccaggggctggaagacgagagggtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatggctggatgctcaacagcagtgccatcaggaacctcggcgtagacctgctcccgggctaccaggacccttactcgggccgcactctgaccaagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgatctacctcggacggaagcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaacgagcagtacaaggcacacttctggccacgggacctggtggccttctccgcccagcccctgctcgctgcccctacccactatgccggggacgccgagtggctcagtgacacggagacatcctctccatgggatgatgacagcggccgcctcatcagctggagcggctcccaaaagaccctgcgcagcccccgcctggacctgactggcagcagcgggcacagcctccaaccccagccccgagatgagctctaggtccaggtgatgactgcaaagcagtgtccaggagcaggccactactgcccagagagcagaggaggaggttgttggcagggactgcagatcctgtcagacctggccaccaccttgggcatggccactctgccctctggacctgtctttcatcgggagaaaccactcagagatggatcccattccctaaaggtctcacagcaaaggagcaggactcccaggcccctgtaccctgcctggcctgatttcagggccttgtggcccccagcttctgtttcaagctgggcagaccccagcaccctcctccctggccggtgcaaagtacagggaggtaaagcaggacccttgcagacatgttgcccagcacacagtaggccctcaataaaagccatttgcactttaaatata

SEQ ID NO: 455762 - DNA, 5330 bp, Homo sapiens
gggcagagatgcctccagctgggctttgagggtgtcagtcttccctcaaataggaaagatgaggggcaggggaggatattggggacaagcctctgctcagccctgggtcctcttggaaccgggcttggagccggaggtggggagggtgtccaagctgagctcctggattcccatctgccgaactgcacccagaaccaggagtggggtgcgggcccatcctctggccaggatcctgggctcccttggccacaaagcaggacaggggaccagagatcccccaactcaggagacgtgaagctggcagctgggccgctggcctagaaatggcctcaaatggaagctgccacccgatcctggtggaggctttgagctaggctagagatcaggactccagggttcagtgcgcacgtgctgcccctgcactagggccgaagcaatgcgggtgctggcgaccgacgcaaggaggtgacgcacaggggacttaaggagcggaccgccgcgggaggacgcgcccagctcagggggactccctctgcgccccccacgctgggtctccggcccacgcgtggcccggctggtctgcggagctagcgccagggccgccagagggcgcccggggcggaggatggggcgggagccggggaagcccgggaggtggtggccgagtgggcgccgcccctctgggtctgcggctcaggtcgaagagtcggctgcgtgggccggggaatccggattccgggggttcaacgcccaggggttccatgagcccctactgttctcggacgcccggccggccccgacgcactcgtcctagcacccctcccctgtccggtcctccggcccctccgccgtcgcccctccggggtccagccgggcggggctgctccagggtcgcggctggcgcgggtccccgggccctggccctccggtgccccgggccaaggagagaaaacttgagcatccacgcacaggggtggggagcaggatcccactctgagggtgcactgccccgccctctccgggtctgcctcggccccgcccgggccccaggccccgccccctcccctcggccggcccgagagctccgggggccgctgcagccgcccaagcgcccgccatgcgcgctgcccgcgccgcgccgctgctccagctgctgctcctgctggggccgtggctggaggctgcgggcgttgcggagtcgccgctgcccgccgtggtccttgccatcctggcccgcaatgccgaacactcgctgccccactacctgggcgctctggagcggctggactacccccgggccaggatggccctctggtgagagacccgggcattggcaccgagtgggcacctaacccccagcttcgcagatggcccccgcccccggcggccctgtctgctcgctccctgcccagacaccacctagacaggcccctcccctcacagacggccctgccagcccgagccgccagagaggaccccgagccccctgctgggagacgacagacctctgaggccacaggccgacgcgggacacccacccctccttctggtcccctactccttcctcttggggccttccctgggtgtaggttgggcccagccagcccttttcaccccagccttcagggcccagctcaaccccagtgggacctgtggttggctggatttgaagaggagcagacaggaacctctgaagtccactggggcccaacgtggcagggatcgaccacgctggaggcttccgggcacaggttgggggtgccatcagcactgggctccgggctgtgcaggggagtcagaccggcccccccaccgcccccgtgctggggccagctctcttggtagatcttggtagaggggcgggatcctgtcagccaagggcagtcccccttcctggagcctctcccctctggcatctctgtacccccagggcactgggatcgaaggccacaacccctggtctgtagacaccagaacagggaggagtccctggctgaggttgggggtaaactgagaaaaatgacaagccaccctcttcaacacaccacagttgggctgggggggtggagccctggcctggggaggccgcccacaattaccacagtttgggagtttgttagttcccacccctgtaagacttgacacgtagtcttcatttctggggaattggcttaaaggggcagcatcacccaaaacctgggcacttggctaaacccccacctctgttatgggggccccttccccaggagaggggaggctgtgccccatgacagcagagcttggacccatctgcattcttagggacgcttagagcatggtttggtccttattacaacctgggggtggaggaaagcagcagctcttctgtctagtccccattcagagagggacaggggctggcctgtggtcacacagccacaggtcacataggtaggtatctgcccacctaacgaaggtaaccagggaatgcaccaggtgtgatccttaaagtcgaggtacttttcatctttcaaaatgcattcgttggccaggtgtggtggctcacgcctgtaatttcagcactttgggaggccgaagtgggcagatcacctgaggtgaggagttcaagaccagcctggctaacatggtgaaaccccatctctactaaacaaacaaaaattagccgggcatggtggtgcacacctgtaatcccaggtactcaggaggctgaggcaggagaatcacttgaacccgggaggcggaggttgcagtgagtcgagatcataccactgcactacagcctgggcgacagagcaagattccatctcaaaaaaaatgcattattcttctcttatctttgtccatgacataagcaggacagcttaagttatagagggaggacgtgaagcccagagaaagatgggacttgcctgaggtcacacagcaggtcacagaactgtggtggggacctggctgtgctgcctccagcctctctgctgtagcacacctacccttcactgttccaaggagagctcgacctcaaaggtgttagtgctttggggtcaaggctgccttggggttcaatcctgtggctgtgccccctcagccttttttcttcccgtccccaggtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggcctttcgacgacatcatcgtcttcgcctatgcctgccaggctgctgctactcaggaggctgaggcaggagaattgctcaaacctgggagacagaggttgtaatgagccaagatcgcaccattgcactccagcctcggtgacagagcaggactccatctcaaaaaaaaaaaaaaggggtctccgtccacgtgtgcaatgagcaccgttatgggtacatgaatgtgccggtgaaatcccaccaggggctggaagacgagagggtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatggctggatgctcaacagcagtgccatcaggaacctcggcgtagacctgctcccgggctaccaggacccttactcgggccgcactctgaccaagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgatctacctcggacggaagcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaacgagcagtacaaggcacacttctggccacgggacctggtggccttctccgcccagcccctgctcgctgcccctacccactatgccggggacgccgagtggctcagtgacacggagacatcctctccatgggatgatgacagcggccgcctcatcagctggagcggctcccaaaagaccctgcgcagcccccgcctggacctgactggcagcagcgggcacagcctccaaccccagccccgagatgagctctaggtccaggtgatgactgcaaagcagtgtccaggagcaggccactactgcccagagagcagaggaggaggttgttggcagggactgcagatcctgtcagacctggccaccaccttgggcatggccactctgccctctggacctgtctttcatcgggagaaaccactcagagatggatcccattccctaaaggtctcacagcaaaggagcaggactcccaggcccctgtaccctgcctggcctgatttcagggccttgtggcccccagcttctgtttcaagctgggcagaccccaggatcccttccctccctaaggactcagctgaggggcccctctgcccccttctacctccacctcagcaccctcccccagcttgatgtttgggtctccccagcaccctcctccctggccggtgcaaagtacagggaggtaaagcaggacccttgcagacatgttgcccagcacacagtaggccctcaataaaagccatttgcactttaaatata

SEQ ID NO: 455763 - DNA, 4699 bp, Homo sapiens
  misc_feature (4611)..(4611): n is a, c, g, or t
  misc_feature (4619)..(4619): n is a, c, g, or t
  misc_feature (4623)..(4623): n is a, c, g, or t
  misc_feature (4642)..(4643): n is a, c, g, or t
  misc_feature (4646)..(4646): n is a, c, g, or t
gggcagagatgcctccagctgggctttgagggtgtcagtcttccctcaaataggaaagatgaggggcaggggaggatattggggacaagcctctgctcagccctgggtcctcttggaaccgggcttggagccggaggtggggagggtgtccaagctgagctcctggattcccatctgccgaactgcacccagaaccaggagtggggtgcgggcccatcctctggccaggatcctgggctcccttggccacaaagcaggacaggggaccagagatcccccaactcaggagacgtgaagctggcagctgggccgctggcctagaaatggcctcaaatggaagctgccacccgatcctggtggaggctttgagctaggctagagatcaggactccagggttcagtgcgcacgtgctgcccctgcactagggccgaagcaatgcgggtgctggcgaccgacgcaaggaggtgacgcacaggggacttaaggagcggaccgccgcgggaggacgcgcccagctcagggggactccctctgcgccccccacgctgggtctccggcccacgcgtggcccggctggtctgcggagctagcgccagggccgccagagggcgcccggggcggaggatggggcgggagccggggaagcccgggaggtggtggccgagtgggcgccgcccctctgggtctgcggctcaggtcgaagagtcggctgcgtgggccggggaatccggattccgggggttcaacgcccaggggttccatgagcccctactgttctcggacgcccggccggccccgacgcactcgtcctagcacccctcccctgtccggtcctccggcccctccgccgtcgcccctccggggtccagccgggcggggctgctccagggtcgcggctggcgcgggtccccgggccctggccctccggtgccccgggccaaggagagaaaacttgagcatccacgcacaggggtggggagcaggatcccactctgagggtgcactgccccgccctctccgggtctgcctcggccccgcccgggccccaggccccgccccctcccctcggccggcccgagagctccgggggccgctgcagccgcccaagcgcccgccatgcgcgctgcccgcgccgcgccgctgctccagctgctgctcctgctggggccgtggctggaggctgcgggcgttgcggagtcgccgctgcccgccgtggtccttgccatcctggcccgcaatgccgaacactcgctgccccactacctgggcgctctggagcggctggactacccccgggccaggatggccctctggtgagagacccgggcattggcaccgagtgggcacctaacccccagcttcgcagatggcccccgcccccggcggccctgtctgctcgctccctgcccagacaccacctagacaggcccctcccctcacagacggccctgccagcccgagccgccagagaggaccccgagccccctgctgggagacgacagacctctgaggccacaggccgacgcgggacacccacccctccttctggtcccctactccttcctcttggggccttccctgggtgtaggttgggcccagccagcccttttcaccccagccttcagggcccagctcaaccccagtgggacctgtggttggctggatttgaagaggagcagacaggaacctctgaagtccactggggcccaacgtggcagggatcgaccacgctggaggcttccgggcacaggttgggggtgccatcagcactgggctccgggctgtgcaggggagtcagaccggcccccccaccgcccccgtgctggggccagctctcttggtagatcttggtagaggggcgggatcctgtcagccaagggcagtcccccttcctggagcctctcccctctggcatctctgtacccccagggcactgggatcgaaggccacaacccctggtctgtagacaccagaacagggaggagtccctggctgaggttgggggtaaactgagaaaaatgacaagccaccctcttcaacacaccacagttgggctgggggggtggagccctggcctggggaggccgcccacaattaccacagtttgggagtttgttagttcccacccctgtaagacttgacacgtagtcttcatttctggggaattggcttaaaggggcagcatcacccaaaacctgggcacttggctaaacccccacctctgttatgggggccccttccccaggagaggggaggctgtgccccatgacagcagagcttggacccatctgcattcttagggacgcttagagcatggtttggtccttattacaacctgggggtggaggaaagcagcagctcttctgtctagtccccattcagagagggacaggggctggcctgtggtcacacagccacaggtcacataggtaggtatctgcccacctaacgaaggtaaccagggaatgcaccaggtgtgatccttaaagtcgaggtacttttcatctttcaaaatgcattcgttggccaggtgtggtggctcacgcctgtaatttcagcactttgggaggccgaagtgggcagatcacctgaggtgaggagttcaagaccagcctggctaacatggtgaaaccccatctctactaaacaaacaaaaattagccgggcatggtggtgcacacctgtaatcccaggtactcaggaggctgaggcaggagaatcacttgaacccgggaggcggaggttgcagtgagtcgagatcataccactgcactacagcctgggcgacagagcaagattccatctcaaaaaaaatgcattattcttctcttatctttgtccatgacataagcaggacagcttaagttatagagggaggacgtgaagcccagagaaagatgggacttgcctgaggtcacacagcaggtcacagaactgtggtggggacctggctgtgctgcctccagcctctctgctgtagcacacctacccttcactgttccaaggagagctcgacctcaaaggtgttagtgctttggggtcaaggctgccttggggttcaatcctgtggctgtgccccctcagccttttttcttcccgtccccaggtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggcctttcgacgacatcatcgtcttcgcctatgcctgccaggctgctggggtctccgtccacgtgtgcaatgagcaccgttatgggtacatgaatgtgccggtgaaatcccaccaggggctggaagacgagagggtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatggctggatgctcaacagcagtgccatcaggaacctcggcgtagacctgctcccgggctaccaggacccttactcgggccgcactctgaccaagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgatctacctcggacggaagcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaacgagcagtacaaggcacacttctggccacgggacctggtggccttctccgcccagcccctgctcgctgcccctacccactatgccggggacgccgagtggctcagtgacacggagacatcctctccatgggatgatgacagcggccgcctcatcagctggagcgtncaaagacntggngcccgctgactgatggagnnggnaagctcacaaccagccgaaggactagtcaggaagatggaagcggcggcagcga

SEQ ID NO: 455764 - DNA, 3330 bp, Homo sapiens
gggcagagatgcctccagctgggctttgagggtgtcagtcttccctcaaataggaaagatgaggggcaggggaggatattggggacaagcctctgctcagccctgggtcctcttggaaccgggcttggagccggaggtggggagggtgtccaagctgagctcctggattcccatctgccgaactgcacccagaaccaggagtggggtgcgggcccatcctctggccaggatcctgggctcccttggccacaaagcaggacaggggaccagagatcccccaactcaggagacgtgaagctggcagctgggccgctggcctagaaatggcctcaaatggaagctgccacccgatcctggtggaggctttgagctaggctagagatcaggactccagggttcagtgcgcacgtgctgcccctgcactagggccgaagcaatgcgggtgctggcgaccgacgcaaggaggtgacgcacaggggacttaaggagcggaccgccgcgggaggacgcgcccagctcagggggactccctctgcgccccccacgctgggtctccggcccacgcgtggcccggctggtctgcggagctagcgccagggccgccagagggcgcccggggcggaggatggggcgggagccggggaagcccgggaggtggtggccgagtgggcgccgcccctctgggtctgcggctcaggtcgaagagtcggctgcgtgggccggggaatccggattccgggggttcaacgcccaggggttccatgagcccctactgttctcggacgcccggccggccccgacgcactcgtcctagcacccctcccctgtccggtcctccggcccctccgccgtcgcccctccggggtccagccgggcggggctgctccagggtcgcggctggcgcgggtccccgggccctggccctccggtgccccgggccaaggagagaaaacttgagcatccacgcacaggggtggggagcaggatcccactctgagggtgcactgccccgccctctccgggtctgcctcggccccgcccgggccccaggccccgccccctcccctcggccggcccgagagctccgggggccgctgcagccgcccaagcgcccgccatgcgcgctgcccgcgccgcgccgctgctccagctgctgctcctgctggggccgtggctggaggctgcgggcgttgcggagtcgccgctgcccgccgtggtccttgccatcctggcccgcaatgccgaacactcgctgccccactacctgggcgctctggagcggctggactacccccgggccaggatggccctctggtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggcctttcgacgacatcatcgtcttcgcctatgcctgccaggctgctggggtctccgtccacgtgtgcaatgagcaccgttatgggtacatgaatgtgccggtgaaatcccaccaggggctggaagacgagagggtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatggctggatgctcaacagcagtgccatcaggaacctcggcgtagacctgctcccgggctaccaggacccttactcgggccgcactctgaccaagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgattcctactggacgctggcctatgccctgcgtctggcgggtgcccgcaagctgctggcctcacagcctctgcgccgcatgctgcccgtggacgagttcctgcccatcatgttcgaccagcaccccaacgagcagtacaaggcacacttctggccacgggacctggtggccttctccgcccagcccctgctcgctgcccctacccactatgccggggacgccgagtggctcagtgacacggagacatcctctccatgggatgatgacagcggccgcctcatcagctggagcggctcccaaaagaccctgcgcagcccccgcctggacctgactggcagcagcgggcacagcctccaaccccagccccgagatgagctctaggtccaggtgatgactgcaaagcagtgtccaggagcaggccactactgcccagagagcagaggaggaggttgttggcagggactgcagatcctgtcagacctggccaccaccttgggcatggccactctgccctctggacctgtctttcatcgggagaaaccactcagagatggatcccattccctaaaggtctcacagcaaaggagcaggactcccaggcccctgtaccctgcctggcctgatttcagggccttgtggcccccagcttctgtttcaagctgggcagaccccaggatcccttccctccctaaggactcagctgaggggcccctctgcccccttctacctccacctcagcaccctcccccagcttgatgtttgggtctccccagcaccctcctccctggccggtgcaaagtacagggaggtaaagcaggacccttgcagacatgttgcccagcacacagtaggccctcaataaaagccatttgcactttaaatata

SEQ ID NO: 455765 - DNA, 4391 bp, Homo sapiens
gggcagagatgcctccagctgggctttgagggtgtcagtcttccctcaaataggaaagatgaggggcaggggaggatattggggacaagcctctgctcagccctgggtcctcttggaaccgggcttggagccggaggtggggagggtgtccaagctgagctcctggattcccatctgccgaactgcacccagaaccaggagtggggtgcgggcccatcctctggccaggatcctgggctcccttggccacaaagcaggacaggggaccagagatcccccaactcaggagacgtgaagctggcagctgggccgctggcctagaaatggcctcaaatggaagctgccacccgatcctggtggaggctttgagctaggctagagatcaggactccagggttcagtgcgcacgtgctgcccctgcactagggccgaagcaatgcgggtgctggcgaccgacgcaaggaggtgacgcacaggggacttaaggagcggaccgccgcgggaggacgcgcccagctcagggggactccctctgcgccccccacgctgggtctccggcccacgcgtggcccggctggtctgcggagctagcgccagggccgccagagggcgcccggggcggaggatggggcgggagccggggaagcccgggaggtggtggccgagtgggcgccgcccctctgggtctgcggctcaggtcgaagagtcggctgcgtgggccggggaatccggattccgggggttcaacgcccaggggttccatgagcccctactgttctcggacgcccggccggccccgacgcactcgtcctagcacccctcccctgtccggtcctccggcccctccgccgtcgcccctccggggtccagccgggcggggctgctccagggtcgcggctggcgcgggtccccgggccctggccctccggtgccccgggccaaggagagaaaacttgagcatccacgcacaggggtggggagcaggatcccactctgagggtgcactgccccgccctctccgggtctgcctcggccccgcccgggccccaggccccgccccctcccctcggccggcccgagagctccgggggccgctgcagccgcccaagcgcccgccatgcgcgctgcccgcgccgcgccgctgctccagctgctgctcctgctggggccgtggctggaggctgcgggcgttgcggagtcgccgctgcccgccgtggtccttgccatcctggcccgcaatgccgaacactcgctgccccactacctgggcgctctggagcggctggactacccccgggccaggatggccctctggtgagagacccgggcattggcaccgagtgggcacctaacccccagcttcgcagatggcccccgcccccggcggccctgtctgctcgctccctgcccagacaccacctagacaggcccctcccctcacagacggccctgccagcccgagccgccagagaggaccccgagccccctgctgggagacgacagacctctgaggccacaggccgacgcgggacacccacccctccttctggtcccctactccttcctcttggggccttccctgggtgtaggttgggcccagccagcccttttcaccccagccttcagggcccagctcaaccccagtgggacctgtggttggctggatttgaagaggagcagacaggaacctctgaagtccactggggcccaacgtggcagggatcgaccacgctggaggcttccgggcacaggttgggggtgccatcagcactgggctccgggctgtgcaggggagtcagaccggcccccccaccgcccccgtgctggggccagctctcttggtagatcttggtagaggggcgggatcctgtcagccaagggcagtcccccttcctggagcctctcccctctggcatctctgtacccccagggcactgggatcgaaggccacaacccctggtctgtagacaccagaacagggaggagtccctggctgaggttgggggtaaactgagaaaaatgacaagccaccctcttcaacacaccacagttgggctgggggggtggagccctggcctggggaggccgcccacaattaccacagtttgggagtttgttagttcccacccctgtaagacttgacacgtagtcttcatttctggggaattggcttaaaggggcagcatcacccaaaacctgggcacttggctaaacccccacctctgttatgggggccccttccccaggagaggggaggctgtgccccatgacagcagagcttggacccatctgcattcttagggacgcttagagcatggtttggtccttattacaacctgggggtggaggaaagcagcagctcttctgtctagtccccattcagagagggacaggggctggcctgtggtcacacagccacaggtcacataggtaggtatctgcccacctaacgaaggtaaccagggaatgcaccaggtgtgatccttaaagtcgaggtacttttcatctttcaaaatgcattcgttggccaggtgtggtggctcacgcctgtaatttcagcactttgggaggccgaagtgggcagatcacctgaggtgaggagttcaagaccagcctggctaacatggtgaaaccccatctctactaaacaaacaaaaattagccgggcatggtggtgcacacctgtaatcccaggtactcaggaggctgaggcaggagaatcacttgaacccgggaggcggaggttgcagtgagtcgagatcataccactgcactacagcctgggcgacagagcaagattccatctcaaaaaaaatgcattattcttctcttatctttgtccatgacataagcaggacagcttaagttatagagggaggacgtgaagcccagagaaagatgggacttgcctgaggtcacacagcaggtcacagaactgtggtggggacctggctgtgctgcctccagcctctctgctgtagcacacctacccttcactgttccaaggagagctcgacctcaaaggtgttagtgctttggggtcaaggctgccttggggttcaatcctgtggctgtgccccctcagccttttttcttcccgtccccaggtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccctacctcggacggaagcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaacgagcagtacaaggcacacttctggccacgggacctggtggccttctccgcccagcccctgctcgctgcccctacccactatgccggggacgccgagtggctcagtgacacggagacatcctctccatgggatgatgacagcggccgcctcatcagctggagcggctcccaaaagaccctgcgcagcccccgcctggacctgactggcagcagcgggcacagcctccaaccccagccccgagatgagctctaggtccaggtgatgactgcaaagcagtgtccaggagcaggccactactgcccagagagcagaggaggaggttgttggcagggactgcagatcctgtcagacctggccaccaccttgggcatggccactctgccctctggacctgtctttcatcgggagaaaccactcagagatggatcccattccctaaaggtctcacagcaaaggagcaggactcccaggcccctgtaccctgcctggcctgatttcagggccttgtggcccccagcttctgtttcaagctgggcagaccccaggatcccttccctccctaaggactcagctgaggggcccctctgcccccttctacctccacctcagcaccctcccccagcttgatgtttgggtctccccagcaccctcctccctggccggtgcaaagtacagggaggtaaagcaggacccttgcagacatgttgcccagcacacagtaggccctcaataaaagccatttgcactttaaatata

SEQ ID NO: 455766 - DNA, 2647 bp, Homo sapiens
gggcagagatgcctccagctgggctttgagggtgtcagtcttccctcaaataggaaagatgaggggcaggggaggatattggggacaagcctctgctcagccctgggtcctcttggaaccgggcttggagccggaggtggggagggtgtccaagctgagctcctggattcccatctgccgaactgcacccagaaccaggagtggggtgcgggcccatcctctggccaggatcctgggctcccttggccacaaagcaggacaggggaccagagatcccccaactcaggagacgtgaagctggcagctgggccgctggcctagaaatggcctcaaatggaagctgccacccgatcctggtggaggctttgagctaggctagagatcaggactccagggttcagtgcgcacgtgctgcccctgcactagggccgaagcaatgcgggtgctggcgaccgacgcaaggaggtgacgcacaggggacttaaggagcggaccgccgcgggaggacgcgcccagctcagggggactccctctgcgccccccacgctgggtctccggcccacgcgtggcccggctggtctgcggagctagcgccagggccgccagagggcgcccggggcggaggatggggcgggagccggggaagcccgggaggtggtggccgagtgggcgccgcccctctgggtctgcggctcaggtcgaagagtcggctgcgtgggccggggaatccggattccgggggttcaacgcccaggggttccatgagcccctactgttctcggacgcccggccggccccgacgcactcgtcctagcacccctcccctgtccggtcctccggcccctccgccgtcgcccctccggggtccagccgggcggggctgctccagggtcgcggctggcgcgggtccccgggccctggccctccggtgccccgggccaaggagagaaaacttgagcatccacgcacaggggtggggagcaggatcccactctgagggtgcactgccccgccctctccgggtctgcctcggccccgcccgggccccaggccccgccccctcccctcggccggcccgagagctccgggggccgctgcagccgcccaagcgcccgccatgcgcgctgcccgcgccgcgccgctgctccagctgctgctcctgctggggccgtggctggaggctgcgggcgttgcggagtcgccgctgcccgccgtggtccttgccatcctggcccgcaatgccgaacactcgctgccccactacctgggcgctctggagcggctggactacccccgggccaggatggccctctggtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggcctttcgacgacatcatcgtcttcgcctatgcctgccaggctgctggggtctccgtccacgtgtgcaatgagcaccgttatgggtacatgaatgtgccggtgaaatcccaccaggggctggaagacgagagggtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatggctggatgctcaacagcagtgccatcaggaacctcggcgtagacctgctcccgggctaccaggacccttactcgggccgcactctgaccaagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatcgccacgccccctaaccccccttgctccccgatctacccctgccctccacgcgcccctctcatacccagaccgcccccgcaccccctgccccccaccggcttctctcacgccacctcctcctcgccccctcccctcctcccctaccctctcctcctctccccccctcacgctccctccccctcccactctccggtccccttcttaccctccccccctactcctcttcccct

SEQ ID NO: 455767 - DNA, 1948 bp, Homo sapiens
gggcagagatgcctccagctgggctttgagggtgtcagtcttccctcaaataggaaagatgaggggcaggggaggatattggggacaagcctctgctcagccctgggtcctcttggaaccgggcttggagccggaggtggggagggtgtccaagctgagctcctggattcccatctgccgaactgcacccagaaccaggagtggggtgcgggcccatcctctggccaggatcctgggctcccttggccacaaagcaggacaggggaccagagatcccccaactcaggagacgtgaagctggcagctgggccgctggcctagaaatggcctcaaatggaagctgccacccgatcctggtggaggctttgagctaggctagagatcaggactccagggttcagtgcgcacgtgctgcccctgcactagggccgaagcaatgcgggtgctggcgaccgacgcaaggaggtgacgcacaggggacttaaggagcggaccgccgcgggaggacgcgcccagctcagggggactccctctgcgccccccacgctgggtctccggcccacgcgtggcccggctggtctgcggagctagcgccagggccgccagagggcgcccggggcggaggatggggcgggagccggggaagcccgggaggtggtggccgagtgggcgccgcccctctgggtctgcggctcaggtcgaagagtcggctgcgtgggccggggaatccggattccgggggttcaacgcccaggggttccatgagcccctactgttctcggacgcccggccggccccgacgcactcgtcctagcacccctcccctgtccggtcctccggcccctccgccgtcgcccctccggggtccagccgggcggggctgctccagggtcgcggctggcgcgggtccccgggccctggccctccggtgccccgggccaaggagagaaaacttgagcatccacgcacaggggtggggagcaggatcccactctgagggtgcactgccccgccctctccgggtctgcctcggccccgcccgggccccaggccccgccccctcccctcggccggcccgagagctccgggggccgctgcagccgcccaagcgcccgccatgcgcgctgcccgcgccgcgccgctgctccagctgctgctcctgctggggccgtggctggaggctgcgggcgttgcggagtcgccgctgcccgccgtggtccttgccatcctggcccgcaatgccgaacactcgctgccccactacctgggcgctctggagcggctggactacccccgggccaggatggccctctggtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggccatcacagaagaacgatcactcccgcctccgccctattgccttgcaaggcctgaatggagagtatcccgtcccaccggtgatccaaccgacagacccgataatagggtag

SEQ ID NO: 455768 - DNA, 348 bp, Homo sapiens
ccagggtataaattgagcctggatctctgaactagagctcagagtaggtgtttggatccattttctaagccagatcccagataaaggtcttagatcagtaactcaggtataatctctggacccagtccctgagtcagtgccccagactagagccttggtccagaaacagatgtactgagtttgtgagacctctgtaagagcattcccactggatcctaggagccacgctgggtctctggcaggaccactcagtgaactccttggggggctgcagcccaggcagggctggagcctgtgacgtcccctcctcaaagtttgcagacacagacaacattctgaccaacaatc

SEQ ID NO: 455769 - DNA, 697 bp, Homo sapiens
gtaatttctaatcttatagctactttgccagtcctgcaaaggcagactggaccccaggcaagaagaagggtctttttgggaaagggctgttataaattttgtttcagagtcaaaccatgaactgaattccttcccaaagttagttcagcctacgcccaggagtgaacaaggacagcttaagggttagaagcaagacagaatcagttaggtctgatttgttccgctgtcataatttcctgagttacaaatttgcaaaggcggtttcacaggggccgttctgttgaggaggggtgtgcctcctgaggctggctgagggcagaggtggaaggttggaggctagaaatgagagttcccaggtaatggcttctattttctccaaaaagtagtagagagatctttgctgggggagaggggcggtggaatgggggcttgagaagactggaggctttgttttgttttgttttgttttgttttgttgagacagaatctcactctgtcacccaggctgtagtgcagtggcgtgatctcaggtcactgcaactcccacctcctaggttcaagtgattcttctgcctcagaatcccaagtggctggggctacaggcatgtgccaccacacctggctaatttttttttgtattattactatttttttttttttgagacggagtttcgcctttgttgcccaggctggaatg

SEQ ID NO: 455770 - DNA, 958 bp, Homo sapiens
  misc_feature (18)..(19): n is a, c, g, or t
  misc_feature (44)..(44): n is a, c, g, or t
  misc_feature (887)..(887): n is a, c, g, or t
  misc_feature (889)..(889): n is a, c, g, or t
  misc_feature (892)..(892): n is a, c, g, or t
  misc_feature (900)..(900): n is a, c, g, or t
  misc_feature (908)..(908): n is a, c, g, or t
  misc_feature (911)..(912): n is a, c, g, or t
  misc_feature (922)..(922): n is a, c, g, or t
cccggatcacagtcaaanntacggctaggtacgaggctgggtgntggatcggccgagggtcacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatggctggatgctcaacagcagtgccatcaggaacctcggcgtagacctgctcccgggctaccaggacccttactcgggccgcactctgaccaagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgatctacctcggacggaagcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaacgagcagtacaaggcacacttctggccacgggacctggtggccttctccgcccagcccctgctcgctgcccctacccactatgccggggacgccgagtggctcagtgacacggagacatcctctccatgggatgatgacagcggccnanaanggagggtncaaaaacntgnngcccgcgacnatggaggggaagcaccaacgaaaaagcgggatgaaa

SEQ ID NO: 455771 - DNA, 3409 bp, Homo sapiens
gggcagagatgcctccagctgggctttgagggtgtcagtcttccctcaaataggaaagatgaggggcaggggaggatattggggacaagcctctgctcagccctgggtcctcttggaaccgggcttggagccggaggtggggagggtgtccaagctgagctcctggattcccatctgccgaactgcacccagaaccaggagtggggtgcgggcccatcctctggccaggatcctgggctcccttggccacaaagcaggacaggggaccagagatcccccaactcaggagacgtgaagctggcagctgggccgctggcctagaaatggcctcaaatggaagctgccacccgatcctggtggaggctttgagctaggctagagatcaggactccagggttcagtgcgcacgtgctgcccctgcactagggccgaagcaatgcgggtgctggcgaccgacgcaaggaggtgacgcacaggggacttaaggagcggaccgccgcgggaggacgcgcccagctcagggggactccctctgcgccccccacgctgggtctccggcccacgcgtggcccggctggtctgcggagctagcgccagggccgccagagggcgcccggggcggaggatggggcgggagccggggaagcccgggaggtggtggccgagtgggcgccgcccctctgggtctgcggctcaggtcgaagagtcggctgcgtgggccggggaatccggattccgggggttcaacgcccaggggttccatgagcccctactgttctcggacgcccggccggccccgacgcactcgtcctagcacccctcccctgtccggtcctccggcccctccgccgtcgcccctccggggtccagccgggcggggctgctccagggtcgcggctggcgcgggtccccgggccctggccctccggtgccccgggccaaggagagaaaacttgagcatccacgcacaggggtggggagcaggatcccactctgagggtgcactgccccgccctctccgggtctgcctcggccccgcccgggccccaggccccgccccctcccctcggccggcccgagagctccgggggccgctgcagccgcccaagcgcccgccatgcgcgctgcccgcgccgcgccgctgctccagctgctgctcctgctggggccgtggctggaggctgcgggcgttgcggagtcgccgctgcccgccgtggtccttgccatcctggcccgcaatgccgaacactcgctgccccactacctgggcgctctggagcggctggactacccccgggccaggatggccctctggtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggcctttcgacgacatcatcgtcttcgcctatgcctgccaggctgctggggtctccgtccacgtgtgcaatgagcaccgttatgggtacatgaatgtgccggtgaaatcccaccaggggctggaagacgagagggtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatggctggatgctcaacagcagtgccatcaggaacctcggcgtagacctgctcccgggctaccaggacccttactcgggccgcactctgaccaagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgatctacctcggacggaagcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaacgagcagtacaaggcacacttctggccacgggacctggtggccttctccgcccagcccctgctcgctgcccctacccactatgccggggacgccgagtggctcagtgacacggagacatcctctccatgggatgatgacagcggccgcctcatcagctggagcggctcccaaaagaccctgcgcagcccccgcctggacctgactggcagcagcgggcacagcctccaaccccagccccgagatgagctctaggtccaggtgatgactgcaaagcagtgtccaggagcaggccactactgcccagagagcagaggaggaggttgttggcagggactgcagatcctgtcagacctggccaccaccttgggcatggccactctgccctctggacctgtctttcatcgggagaaaccactcagagatggatcccattccctaaaggtctcacagcaaaggagcaggactcccaggcccctgtaccctgcctggcctgatttcagggccttgtggcccccagcttctgtttcaagctgggcagaccccaggatcccttccctccctaaggactcagctgaggggcccctctgcccccttctacctccacctcagcaccctcccccagcttgatgtttgggtctccccagcaccctcctccctggccggtgcaaagtacagggaggtaaagcaggacccttgcagacatgttgcccagcacacagtaggccctcaataaaagccatttgcactttaaatata

SEQ ID NO: 455772 - DNA, 5143 bp, Homo sapiens
gggcagagatgcctccagctgggctttgagggtgtcagtcttccctcaaataggaaagatgaggggcaggggaggatattggggacaagcctctgctcagccctgggtcctcttggaaccgggcttggagccggaggtggggagggtgtccaagctgagctcctggattcccatctgccgaactgcacccagaaccaggagtggggtgcgggcccatcctctggccaggatcctgggctcccttggccacaaagcaggacaggggaccagagatcccccaactcaggagacgtgaagctggcagctgggccgctggcctagaaatggcctcaaatggaagctgccacccgatcctggtggaggctttgagctaggctagagatcaggactccagggttcagtgcgcacgtgctgcccctgcactagggccgaagcaatgcgggtgctggcgaccgacgcaaggaggtgacgcacaggggacttaaggagcggaccgccgcgggaggacgcgcccagctcagggggactccctctgcgccccccacgctgggtctccggcccacgcgtggcccggctggtctgcggagctagcgccagggccgccagagggcgcccggggcggaggatggggcgggagccggggaagcccgggaggtggtggccgagtgggcgccgcccctctgggtctgcggctcaggtcgaagagtcggctgcgtgggccggggaatccggattccgggggttcaacgcccaggggttccatgagcccctactgttctcggacgcccggccggccccgacgcactcgtcctagcacccctcccctgtccggtcctccggcccctccgccgtcgcccctccggggtccagccgggcggggctgctccagggtcgcggctggcgcgggtccccgggccctggccctccggtgccccgggccaaggagagaaaacttgagcatccacgcacaggggtggggagcaggatcccactctgagggtgcactgccccgccctctccgggtctgcctcggccccgcccgggccccaggccccgccccctcccctcggccggcccgagagctccgggggccgctgcagccgcccaagcgcccgccatgcgcgctgcccgcgccgcgccgctgctccagctgctgctcctgctggggccgtggctggaggctgcgggcgttgcggagtcgccgctgcccgccgtggtccttgccatcctggcccgcaatgccgaacactcgctgccccactacctgggcgctctggagcggctggactacccccgggccaggatggccctctggtgagagacccgggcattggcaccgagtgggcacctaacccccagcttcgcagatggcccccgcccccggcggccctgtctgctcgctccctgcccagacaccacctagacaggcccctcccctcacagacggccctgccagcccgagccgccagagaggaccccgagccccctgctgggagacgacagacctctgaggccacaggccgacgcgggacacccacccctccttctggtcccctactccttcctcttggggccttccctgggtgtaggttgggcccagccagcccttttcaccccagccttcagggcccagctcaaccccagtgggacctgtggttggctggatttgaagaggagcagacaggaacctctgaagtccactggggcccaacgtggcagggatcgaccacgctggaggcttccgggcacaggttgggggtgccatcagcactgggctccgggctgtgcaggggagtcagaccggcccccccaccgcccccgtgctggggccagctctcttggtagatcttggtagaggggcgggatcctgtcagccaagggcagtcccccttcctggagcctctcccctctggcatctctgtacccccagggcactgggatcgaaggccacaacccctggtctgtagacaccagaacagggaggagtccctggctgaggttgggggtaaactgagaaaaatgacaagccaccctcttcaacacaccacagttgggctgggggggtggagccctggcctggggaggccgcccacaattaccacagtttgggagtttgttagttcccacccctgtaagacttgacacgtagtcttcatttctggggaattggcttaaaggggcagcatcacccaaaacctgggcacttggctaaacccccacctctgttatgggggccccttccccaggagaggggaggctgtgccccatgacagcagagcttggacccatctgcattcttagggacgcttagagcatggtttggtccttattacaacctgggggtggaggaaagcagcagctcttctgtctagtccccattcagagagggacaggggctggcctgtggtcacacagccacaggtcacataggtaggtatctgcccacctaacgaaggtaaccagggaatgcaccaggtgtgatccttaaagtcgaggtacttttcatctttcaaaatgcattcgttggccaggtgtggtggctcacgcctgtaatttcagcactttgggaggccgaagtgggcagatcacctgaggtgaggagttcaagaccagcctggctaacatggtgaaaccccatctctactaaacaaacaaaaattagccgggcatggtggtgcacacctgtaatcccaggtactcaggaggctgaggcaggagaatcacttgaacccgggaggcggaggttgcagtgagtcgagatcataccactgcactacagcctgggcgacagagcaagattccatctcaaaaaaagggaggacgtgaagcccagagaaagatgggacttgcctgaggtcacacagcaggtcacagaactgtggtggggacctggctgtgctgcctccagcctctctgctgtagcacacctacccttcactgttccaaggagagctcgacctcaaaggtgttagtgctttggggtcaaggctgccttggggttcaatcctgtggctgtgccccctcagccttttttcttcccgtccccaggtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggcctttcgacgacatcatcgtcttcgcctatgcctgccaggctgctggggtctccgtccacgtgtgcaatgagcaccgttatgggtacatgaatgtgccggtgaaatcccaccaggggctggaagacgagagggtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatggctggatgctcaacagcagtgccatcaggaacctcggcgtagacctgctcccgggctaccaggacccttactcgggccgcactctgaccaagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgatctacctcggacggaagcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaacgagcagtacaaggcacacttctggccacgggacctggtggccttctccgcccagcccctgctcgctgcccctacccactatgccggggacgccgagtggctcagtgacacggagacatcctctccatgggatgatgacagcggccgcctcatcagctggagcggctcccaaaagaccctgcgcagcccccgcctggacctgactggcagcagcgggcacagcctccaaccccagccccgagatgagctctaggtccaggtgatgactgcaaagcagtgtccaggagcaggccactactgcccagagagcagaggaggaggttgttggcagggactgcagatcctgtcagacctggccaccaccttgggcatggccactctgccctctggacctgtctttcatcgggagaaaccactcagagatggatcccattccctaaaggtctcacagcaaaggagcaggactcccaggcccctgtaccctgcctggcctgatttcagggccttgtggcccccagcttctgtttcaagctgggcagaccccaggatcccttccctccctaaggactcagctgaggggcccctctgcccccttctacctccacctcagcaccctcccccagcttgatgtttgggtctccccagcaccctcctccctggccggtgcaaagtacagggaggtaaagcaggacccttgcagacatgttgcccagcacacagtaggccctcaataaaagccatttgcactttaaatata

SEQ ID NO: 455773 - DNA, 3717 bp, Homo sapiens
gggcagagatgcctccagctgggctttgagggtgtcagtcttccctcaaataggaaagatgaggggcaggggaggatattggggacaagcctctgctcagccctgggtcctcttggaaccgggcttggagccggaggtggggagggtgtccaagctgagctcctggattcccatctgccgaactgcacccagaaccaggagtggggtgcgggcccatcctctggccaggatcctgggctcccttggccacaaagcaggacaggggaccagagatcccccaactcaggagacgtgaagctggcagctgggccgctggcctagaaatggcctcaaatggaagctgccacccgatcctggtggaggctttgagctaggctagagatcaggactccagggttcagtgcgcacgtgctgcccctgcactagggccgaagcaatgcgggtgctggcgaccgacgcaaggaggtgacgcacaggggacttaaggagcggaccgccgcgggaggacgcgcccagctcagggggactccctctgcgccccccacgctgggtctccggcccacgcgtggcccggctggtctgcggagctagcgccagggccgccagagggcgcccggggcggaggatggggcgggagccggggaagcccgggaggtggtggccgagtgggcgccgcccctctgggtctgcggctcaggtcgaagagtcggctgcgtgggccggggaatccggattccgggggttcaacgcccaggggttccatgagcccctactgttctcggacgcccggccggccccgacgcactcgtcctagcacccctcccctgtccggtcctccggcccctccgccgtcgcccctccggggtccagccgggcggggctgctccagggtcgcggctggcgcgggtccccgggccctggccctccggtgccccgggccaaggagagaaaacttgagcatccacgcacaggggtggggagcaggatcccactctgagggtgcactgccccgccctctccgggtctgcctcggccccgcccgggccccaggccccgccccctcccctcggccggcccgagagctccgggggccgctgcagccgcccaagcgcccgccatgcgcgctgcccgcgccgcgccgctgctccagctgctgctcctgctggggccgtggctggaggctgcgggcgttgcggagtcgccgctgcccgccgtggtccttgccatcctggcccgcaatgccgaacactcgctgccccactacctgggcgctctggagcggctggactacccccgggccaggatggccctctgacggccctgccagcccgagccgccagagaggaccccgagccccctgctgggagacgacagacctctgaggccacaggccgacgcgggacacccacccctccttctggtcccctactccttcctcttggggccttccctgggtgtaggttgggcccagccagcccttttcaccccagccttcagggcccagctcaaccccagtgggacctgtggttggctggatttgaagaggagcagacaggaacctctgaagtccactggggcccaacgtggcagggatcgaccacgctggaggcttccgggcacaggtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggcctttcgacgacatcatcgtcttcgcctatgcctgccaggctgctggggtctccgtccacgtgtgcaatgagcaccgttatgggtacatgaatgtgccggtgaaatcccaccaggggctggaagacgagagggtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatggctggatgctcaacagcagtgccatcaggaacctcggcgtagacctgctcccgggctaccaggacccttactcgggccgcactctgaccaagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgatctacctcggacggaagcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaacgagcagtacaaggcacacttctggccacgggacctggtggccttctccgcccagcccctgctcgctgcccctacccactatgccggggacgccgagtggctcagtgacacggagacatcctctccatgggatgatgacagcggccgcctcatcagctggagcggctcccaaaagaccctgcgcagcccccgcctggacctgactggcagcagcgggcacagcctccaaccccagccccgagatgagctctaggtccaggtgatgactgcaaagcagtgtccaggagcaggccactactgcccagagagcagaggaggaggttgttggcagggactgcagatcctgtcagacctggccaccaccttgggcatggccactctgccctctggacctgtctttcatcgggagaaaccactcagagatggatcccattccctaaaggtctcacagcaaaggagcaggactcccaggcccctgtaccctgcctggcctgatttcagggccttgtggcccccagcttctgtttcaagctgggcagaccccaggatcccttccctccctaaggactcagctgaggggcccctctgcccccttctacctccacctcagcaccctcccccagcttgatgtttgggtctccccagcaccctcctccctggccggtgcaaagtacagggaggtaaagcaggacccttgcagacatgttgcccagcacacagtaggccctcaataaaagccatttgcactttaaatata

SEQ ID NO: 455774 - DNA, 2161 bp, Homo sapiens
gtgtgcctcctgaggctggctgagggcagaggtggaaggttggaggctagaaatgagagttcccaggtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggcctttcgacgacatcatcgtcttcgcctatgcctgccaggctgctggggtctccgtccacgtgtgcaatgagcaccgttatgggtacatgaatgtgccggtgaaatcccaccaggggctggaagacgagagggtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatggctggatgctcaacagcagtgccatcaggaacctcggcgtagacctgctcccgggctaccaggacccttactcgggccgcactctgaccaagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgatctacctcggacggaagcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaacgagcagtacaaggcacacttctggccacgggacctggtggccttctccgcccagcccctgctcgctgcccctacccactatgccggggacgccgagtggctcagtgacacggagacatcctctccatgggatgatgacagcggccgcctcatcagctggagcggctcccaaaagaccctgcgcagcccccgcctggacctgactggcagcagcgggcacagcctccaaccccagccccgagatgagctctaggtccaggtgatgactgcaaagcagtgtccaggagcaggccactactgcccagagagcagaggaggaggttgttggcagggactgcagatcctgtcagacctggccaccaccttgggcatggccactctgccctctggacctgtctttcatcgggagaaaccactcagagatggatcccattccctaaaggtctcacagcaaaggagcaggactcccaggcccctgtaccctgcctggcctgatttcagggccttgtggcccccagcttctgtttcaagctgggcagaccccaggatcccttccctccctaaggactcagctgaggggcccctctgcccccttctacctccacctcagcaccctcccccagcttgatgtttgggtctccccagcaccctcctccctggccggtgcaaagtacagggaggtaaagcaggacccttgcagacatgttgcccagcacacagtaggccctcaataaaagccatttgcactttaaatata

SEQ ID NO: 455775 - DNA, 1829 bp, Homo sapiens
tcgtgatggtagatctagagtatcacgggggcgaaaagctagtacatcatctggttcagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggcctttcgacgacatcatcgtcttcgcctatgcctgccaggctgctggggtctccgtccacgtgtgcaatgagcaccgttatgggtacatgaatgtgccggtgaaatcccaccaggggctggaagacgagagggtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatggctggatgctcaacagcagtgccatcaggaacctcggcgtagacctgctcccgggctaccaggacccttactcgggccgcactctgaccaagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgatctacctcggacggaagcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaacgagcagtacaaggcacacttctggccacgggacctggtggccttctccgcccagcccctgctcgctgcccctacccactatgccggggacgccgagtggctcagtgacacggagacatcctctccatgggatgatgacagcggccgcctcatcagctggagcggctcccaaaagaccctgcgcagcccccgcctggacctgactggcagcagcgggcacagcctccaaccccagccccgagatgagctctaggtccaggtgatgactgcaaagcagtgtccaggagcaggccactactgcccagagagcagaggaggaggttgttggcagggactgcagatcctgtcagacctggccaccaccttgggcatggccactctgccctctggacctgtctttcatcgggagaaaccactcagagatggatcccattccctaaaggtctcacagcaaaggagcaggactcccaggcccctgtaccctgcctggcctgatttcagggccttgtggcccccagcttctgtttcaagctgggcagaccccaggatcccttccctccctaaggactcagctgaggggcccctctgcccccttctacctccacctcagcaccctcccccagcttgatgtttgggtctccccagcaccctcctccctggccggtgcaaagtacagggaggtaaagcaggacccttgcagacatgttgcccagcacacagtaggccctcaataaaagccatttgcactttaaatata

SEQ ID NO: 455776 - DNA, 2870 bp, Homo sapiens
  misc_feature (2799)..(2799): n is a, c, g, or t
  misc_feature (2801)..(2801): n is a, c, g, or t
  misc_feature (2804)..(2804): n is a, c, g, or t
  misc_feature (2812)..(2812): n is a, c, g, or t
  misc_feature (2820)..(2820): n is a, c, g, or t
  misc_feature (2823)..(2824): n is a, c, g, or t
  misc_feature (2834)..(2834): n is a, c, g, or t
gggcagagatgcctccagctgggctttgagggtgtcagtcttccctcaaataggaaagatgaggggcaggggaggatattggggacaagcctctgctcagccctgggtcctcttggaaccgggcttggagccggaggtggggagggtgtccaagctgagctcctggattcccatctgccgaactgcacccagaaccaggagtggggtgcgggcccatcctctggccaggatcctgggctcccttggccacaaagcaggacaggggaccagagatcccccaactcaggagacgtgaagctggcagctgggccgctggcctagaaatggcctcaaatggaagctgccacccgatcctggtggaggctttgagctaggctagagatcaggactccagggttcagtgcgcacgtgctgcccctgcactagggccgaagcaatgcgggtgctggcgaccgacgcaaggaggtgacgcacaggggacttaaggagcggaccgccgcgggaggacgcgcccagctcagggggactccctctgcgccccccacgctgggtctccggcccacgcgtggcccggctggtctgcggagctagcgccagggccgccagagggcgcccggggcggaggatggggcgggagccggggaagcccgggaggtggtggccgagtgggcgccgcccctctgggtctgcggctcaggtcgaagagtcggctgcgtgggccggggaatccggattccgggggttcaacgcccaggggttccatgagcccctactgttctcggacgcccggccggccccgacgcactcgtcctagcacccctcccctgtccggtcctccggcccctccgccgtcgcccctccggggtccagccgggcggggctgctccagggtcgcggctggcgcgggtccccgggccctggccctccggtgccccgggccaaggagagaaaacttgagcatccacgcacaggggtggggagcaggatcccactctgagggtgcactgccccgccctctccgggtctgcctcggccccgcccgggccccaggccccgccccctcccctcggccggcccgagagctccgggggccgctgcagccgcccaagcgcccgccatgcgcgctgcccgcgccgcgccgctgctccagctgctgctcctgctggggccgtggctggaggctgcgggcgttgcggagtcgccgctgcccgccgtggtccttgccatcctggcccgcaatgccgaacactcgctgccccactacctgggcgctctggagcggctggactacccccgggccaggatggccctctggtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggcctttcgacgacatcatcgtcttcgcctatgcctgccaggctgctggggtctccgtccacgtgtgcaatgagcaccgttatgggtacatgaatgtgccggtgaaatcccaccaggggctggaagacgagagggtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatggctggatgctcaacagcagtgccatcaggaacctcggcgtagacctgctcccgggctaccaggacccttactcgggccgcactctgaccaagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgatctacctcggacggaagcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaacgagcagtacaaggcacacttctggccacgggacctggtggccttctccgcccagcccctgctcgctgcccctacccactatgccggggacgccgagtggctcagtgacacggagacatcctctccatgggatgatgacagcggccnanaanggagggtncaaaaacntgnngcccgcgacnatggaggggaagcaccaacgaaaaagcgggatgaaa

SEQ ID NO: 455777 - DNA, 3077 bp, Homo sapiens
gggcagagatgcctccagctgggctttgagggtgtcagtcttccctcaaataggaaagatgaggggcaggggaggatattggggacaagcctctgctcagccctgggtcctcttggaaccgggcttggagccggaggtggggagggtgtccaagctgagctcctggattcccatctgccgaactgcacccagaaccaggagtggggtgcgggcccatcctctggccaggatcctgggctcccttggccacaaagcaggacaggggaccagagatcccccaactcaggagacgtgaagctggcagctgggccgctggcctagaaatggcctcaaatggaagctgccacccgatcctggtggaggctttgagctaggctagagatcaggactccagggttcagtgcgcacgtgctgcccctgcactagggccgaagcaatgcgggtgctggcgaccgacgcaaggaggtgacgcacaggggacttaaggagcggaccgccgcgggaggacgcgcccagctcagggggactccctctgcgccccccacgctgggtctccggcccacgcgtggcccggctggtctgcggagctagcgccagggccgccagagggcgcccggggcggaggatggggcgggagccggggaagcccgggaggtggtggccgagtgggcgccgcccctctgggtctgcggctcaggtcgaagagtcggctgcgtgggccggggaatccggattccgggggttcaacgcccaggggttccatgagcccctactgttctcggacgcccggccggccccgacgcactcgtcctagcacccctcccctgtccggtcctccggcccctccgccgtcgcccctccggggtccagccgggcggggctgctccagggtcgcggctggcgcgggtccccgggccctggccctccggtgccccgggccaaggagagaaaacttgagcatccacgcacaggggtggggagcaggatcccactctgagggtgcactgccccgccctctccgggtctgcctcggccccgcccgggccccaggccccgccccctcccctcggccggcccgagagctccgggggccgctgcagccgcccaagcgcccgccatgcgcgctgcccgcgccgcgccgctgctccagctgctgctcctgctggggccgtggctggaggctgcgggcgttgcggagtcgccgctgcccgccgtggtccttgccatcctggcccgcaatgccgaacactcgctgccccactacctgggcgctctggagcggctggactacccccgggccaggatggccctctggtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggcctttcgacgacatcatcgtcttcgcctatgcctgccaggctgctggggtctccgtccacgtgtgcaatgagcaccgttatgggtacatgaatgtgccggtgaaatcccaccaggggctggaagacgagagggtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatggctggatgctcaacagcagtgccatcaggaacctcggcgtagacctgctcccgggctaccaggacccttactcgggccgcactctgaccaagggcgaggtgggctgcttcctcagccattactccatctgggaagagcgagcagtacaaggcacacttctggccacgggacctggtggccttctccgcccagcccctgctcgctgcccctacccactatgccggggacgccgagtggctcagtgacacggagacatcctctccatgggatgatgacagcggccgcctcatcagctggagcggctcccaaaagaccctgcgcagcccccgcctggacctgactggcagcagcgggcacagcctccaaccccagccccgagatgagctctaggtccaggtgatgactgcaaagcagtgtccaggagcaggccactactgcccagagagcagaggaggaggttgttggcagggactgcagatcctgtcagacctggccaccaccttgggcatggccactctgccctctggacctgtctttcatcgggagaaaccactcagagatggatcccattccctaaaggtctcacagcaaaggagcaggactcccaggcccctgtaccctgcctggcctgatttcagggccttgtggcccccagcttctgtttcaagctgggcagaccccaggatcccttccctccctaaggactcagctgaggggcccctctgcccccttctacctccacctcagcaccctcccccagcttgatgtttgggtctccccagcaccctcctccctggccggtgcaaagtacagggaggtaaagcaggacccttgcagacatgttgcccagcacacagtaggccctcaataaaagccatttgcactttaaatata

SEQ ID NO: 455778 - DNA, 2801 bp, Homo sapiens
gggcagagatgcctccagctgggctttgagggtgtcagtcttccctcaaataggaaagatgaggggcaggggaggatattggggacaagcctctgctcagccctgggtcctcttggaaccgggcttggagccggaggtggggagggtgtccaagctgagctcctggattcccatctgccgaactgcacccagaaccaggagtggggtgcgggcccatcctctggccaggatcctgggctcccttggccacaaagcaggacaggggaccagagatcccccaactcaggagacgtgaagctggcagctgggccgctggcctagaaatggcctcaaatggaagctgccacccgatcctggtggaggctttgagctaggctagagatcaggactccagggttcagtgcgcacgtgctgcccctgcactagggccgaagcaatgcgggtgctggcgaccgacgcaaggaggtgacgcacaggggacttaaggagcggaccgccgcgggaggacgcgcccagctcagggggactccctctgcgccccccacgctgggtctccggcccacgcgtggcccggctggtctgcggagctagcgccagggccgccagagggcgcccggggcggaggatggggcgggagccggggaagcccgggaggtggtggccgagtgggcgccgcccctctgggtctgcggctcaggtcgaagagtcggctgcgtgggccggggaatccggattccgggggttcaacgcccaggggttccatgagcccctactgttctcggacgcccggccggccccgacgcactcgtcctagcacccctcccctgtccggtcctccggcccctccgccgtcgcccctccggggtccagccgggcggggctgctccagggtcgcggctggcgcgggtccccgggccctggccctccggtgccccgggccaaggagagaaaacttgagcatccacgcacaggggtggggagcaggatcccactctgagggtgcactgccccgccctctccgggtctgcctcggccccgcccgggccccaggccccgccccctcccctcggccggcccgagagctccgggggccgctgcagccgcccaagcgcccgccatgcgcgctgcccgcgccgcgccgctgctccagctgctgctcctgctggggccgtggctggaggctgcgggcgttgcggagtcgccgctgcccgccgtggtccttgccatcctggcccgcaatgccgaacactcgctgccccactacctgggcgctctggagcggctggactacccccgggccaggatggccctctggtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggcctttcgacgacatcatcgtcttcgcctatgcctgccaggctgctggggtctccgtccacgtgtgcaatgagcaccgttatgggtacatgaatgtgccggtgaaatcccaccaggggctggaagacgagagggtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatggctggatgctcaacagcagtgccatcaggaacctcggcgtagacctgctcccgggctaccaggacccttactcgggccgcactctgaccaagggcgaggtgggctgcttcctcagccattactccatctgggaagaggttgcccatggggccctgggaccgtggtcctgtgctgctgtcgagagactgacgatgccgcttattgagagcaatactttcaggggtgcgtactgagagtcggcttgcattggacggatgtgagcacggcagtagaaaaagtgcttgtaggggggagcgctgattcttagatatcagagacctcgaaaagagacgagtgatatacgctgcaagtaaggaacaccggacggagtgatgccggggctcgacgggtggtccttgtgagtgcgaatggacatcggtggagtacattgcctaccatggtaacggcgtgagccgtaactgacccctgctgtgactcgcgagggggtggcacactgggaaaggcttggcctgtgcccatcaaaagcaggacatagaggcaaccgggcaatttgtatcacatcgggaagcatacagaagcattcgcctgaaccagaagagtggtaacagagaaccacgg

SEQ ID NO: 455779 - DNA, 461 bp, Homo sapiens
cggaagcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaagtgaggctctgatgggggccgggcatggcagggcagaggcgtcccctccaggaactcacctcagtcagcaggaagtcccctcacctggcagatggggagactgggactggcaaggccaagccacttggcccaggtcaccaaggagtggctcagcctagccttagagtcagtccattctcggtgtgtactttgcacagtgcatgcaggcttttttttgaaatggagtcttgctctgttgcccaggctagaatgcagtggcatgatttt

SEQ ID NO: 455780 - DNA, 3919 bp, Homo sapiens
gcgggggcgggctttgccgagcgcagagctgcagccgccgagccggacgtgtgcgcgaagatggcgggccggagcatgcaagcggcaagatgtcctacagatgaattatctttaaccaattgtgcagttgtgaatgaaaaggatttccagtctggccagcatgtgattgtgaggacctctcccaatcacaggtacacatttacactgaagacacatccatcggtggttccagggagcattgcattcagtttacctcagagaaaatgggctgggctttctattgggcaagaaatagaagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacagcttgtctttagcttcaatgaaaagctttttggcttactggtgaaggacattgaatccatggatcctagcatcctgaagggagagcctgcgacagggaaaaggcagaagattgaagtaggactggttgttggaaacagtcaagttgcatttgaaaaagcagaaaattcgtcacttaatcttattggcaaagctaaaaccaaggaaaatcgccaatcaattatcaatcctgactggaactttgaaaaaatgggaataggaggtctagacaaggaattttcagatattttccgacgagcatttgccttcccgagtatttcctccagagattgtggagcagatgggttgtatacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggaggcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggaatgaccaatagaccagatctgatagatgaggctcttcttagacctggaagactggaagttaaaatggagataggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggccagtactaaagtggaagtggacatggagaaagcagaaagcctgcaagtgacgagaggagacttccttgcttctttggagaatgatatcaaaccagcctttggcacaaaccaagaagattatgcaagttacattatgaacggtatcatcaaatggggtgacccagttactcgagttctagatgatggggagctgctggtgcagcagactaagaacagtgaccgcacaccattggtcagcgtgcttctggaaggccctcctcacagtgggaagactgctttagctgcaaaaattgcagaggaatccaacttcccgttcatcaagatctgttctcctgataaaatgattggcttttctgaaacagccaaatgtcaggccatgaagaagatctttgatgatgcgtacaaatcccagctcagttgtgtggttgtggatgacattgagagattgcttgattacgtccctattggccctcgattttcaaatcttgtattacaggctcttctcgttttactgaaaaaggcacctcctcagggccgcaagcttcttatcattgggaccactagccgcaaagatgtccttcaggagatggaaatgcttaacgctttcagcaccaccatccacgtgcccaacattgccacaggagagcagctgttggaagctttggagcttttgggcaacttcaaggataaggaacgcaccacaattgcacagcaagtcaaagggaagaaggtctggataggaatcaagaagttactaatgctgatcgagatgtccctacagatggatcctgaataccgtgtgagaaaattcttggccctcttaagagaagaaggagctagcccccttgattttgattgaaaatgaactatttgaaacacacagtgaccaagggaagtgaccaaggtgaagatggcctaggatcttcactgtcttactcaagatactggactaagtggaacgttctctaccttcaacatgtgctcgctctgcatgattagtgcaataaaactcccttccttatgcatactgagatagcttagtgtctcgtggaaggtgtcaatttggtttagaatgctgcgcttaccttcccatgcaggctaaagtgattccttcttgctcagtccctctgggtgggaaccatccagtacttgtggacactacacgtttcaacctctctactagcaccatcacccttgaaaactctcagtcagtgtcatgaatgttgcatgacaacagttggccgattagaaggcagactttctacatgcaaatctggcttagtaaatcgaggtgtgggccagagatcctctgacagctgtcctgagctaacactaaaagtcactgggtatttggttaaaggtctcccacaagactggtattctctttgcctgaagaaacaaggcattgaatctctaaaatgctgttctcaatcattgtcagagatgttttcaagttgcagtcagaagatctttcttaatagaaagtcagatgactaccgtgttggttgtgacttccccttaagtataactaatttgctctgtggtaagagatatgctcattattaccacttagaagatgttgttaaaaacatgtgaaagataggtatggaaaaagcatacacccccaaacagaaaggagttattaaagtaatttacaaacctctcagcactaattagtgtccaactccaagtgggtcaattccttagtataatattaaggcttactagtatcactgctttttccttagcttaatgacttacttagaatttatcctttattttaaatgatctgtactatctagtgtctaaaacactattctccagaaaaatcaatcattttctagccctctccctcagtcctttattgtccattccaatacattgaacacatttcctttaccctccacacacttcttccaaaaggaagcacccgttgagtccttttgagggtgatttgtcttacaactgactgacttagcaggaatttaattaggtcatatttggtgatgagacttatggagtgtgcctctctctcccaactgctgcttaaaatgcaaggacaagcaattagaagccatcctaaggtgcttacctcacacgccacccatgaggcttgtggccacagtggcacttgggtgtggctcctctgttatttgtcctcatgtgagaaagcagatcatctccaaatcttgccatttgtatacttttggtggagacttggatgtcatatcttctttgttttgggttttcttccctagcttattttgtggcttttaaagaagtggattgtattgtgagatcctgtgattcctggtggccagtatcctggattcctctaagatcttgcctctttcctcctcatgaaagcagcacacattgtgttaacttatgtctcttgttaaatgagcttaatgtctttgtgttttgtccaaaactgtattgaaaaaatattgtttaatgcaaatgaaggaatgcaataaag

SEQ ID NO: 455781 - DNA, 1842 bp, Homo sapiens
  misc_feature (1427)..(1427): n is a, c, g, or t
  misc_feature (1610)..(1610): n is a, c, g, or t
  misc_feature (1622)..(1622): n is a, c, g, or t
  misc_feature (1628)..(1630): n is a, c, g, or t
  misc_feature (1633)..(1633): n is a, c, g, or t
  misc_feature (1639)..(1639): n is a, c, g, or t
  misc_feature (1646)..(1647): n is a, c, g, or t
  misc_feature (1654)..(1654): n is a, c, g, or t
  misc_feature (1659)..(1659): n is a, c, g, or t
  misc_feature (1661)..(1661): n is a, c, g, or t
  misc_feature (1666)..(1666): n is a, c, g, or t
  misc_feature (1670)..(1670): n is a, c, g, or t
  misc_feature (1676)..(1676): n is a, c, g, or t
  misc_feature (1682)..(1682): n is a, c, g, or t
  misc_feature (1687)..(1688): n is a, c, g, or t
  misc_feature (1696)..(1696): n is a, c, g, or t
  misc_feature (1701)..(1701): n is a, c, g, or t
  misc_feature (1703)..(1705): n is a, c, g, or t
  misc_feature (1710)..(1710): n is a, c, g, or t
  misc_feature (1720)..(1720): n is a, c, g, or t
  misc_feature (1724)..(1724): n is a, c, g, or t
  misc_feature (1728)..(1728): n is a, c, g, or t
  misc_feature (1731)..(1731): n is a, c, g, or t
  misc_feature (1739)..(1739): n is a, c, g, or t
  misc_feature (1750)..(1751): n is a, c, g, or t
  misc_feature (1756)..(1756): n is a, c, g, or t
  misc_feature (1758)..(1759): n is a, c, g, or t
  misc_feature (1766)..(1766): n is a, c, g, or t
  misc_feature (1769)..(1770): n is a, c, g, or t
  misc_feature (1777)..(1777): n is a, c, g, or t
  misc_feature (1782)..(1782): n is a, c, g, or t
  misc_feature (1788)..(1788): n is a, c, g, or t
  misc_feature (1794)..(1795): n is a, c, g, or t
  misc_feature (1799)..(1799): n is a, c, g, or t
  misc_feature (1801)..(1801): n is a, c, g, or t
  misc_feature (1807)..(1807): n is a, c, g, or t
  misc_feature (1823)..(1824): n is a, c, g, or t
  misc_feature (1830)..(1830): n is a, c, g, or t
atttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctngtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccactcatgcctgtaatcccancactttgggagnctgagnnnggnggatcntttgagnncaggagntcaanancagcntggncaacanagtganacccnntctctacnaaaantnnnaaaantagctgcgtntgtngtcncanctactcangaggctgaggnnggagnanngcttganccnnggaggtngaggntgcagngagccnngatngngccacngcactccagcctgggnnacagancgagattgtctc

SEQ ID NO: 455782 - DNA, 3994 bp, Homo sapiens
  misc_feature (3952)..(3952): n is a, c, g, or t
  misc_feature (3956)..(3956): n is a, c, g, or t
gcgggggcgggctttgccgagcgcagagctgcagccgccgagccggacgtgtgcgcgaagatggcgggccggagcatgcaagcggcaagatgtcctacagatgaattatctttaaccaattgtgcagttgtgaatgaaaaggatttccagtctggccagcatgtgattgtgaggacctctcccaatcacaggtacacatttacactgaagacacatccatcggtggttccagggagcattgcattcagtttacctcagagaaaatgggctgggctttctattgggcaagaaatagaagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacagcttgtctttagcttcaatgaaaagctttttggcttactggtgaaggacattgaatccatggatcctagcatcctgaagggagagcctgcgacagggaaaaggcagaagattgaagtaggactggttgttggaaacagtcaagttgcatttgaaaaagcagaaaattcgtcacttaatcttattggcaaagctaaaaccaaggaaaatcgccaatcaattatcaatcctgactggaactttgaaaaaatgggaataggaggtctagacaaggaattttcagatattttccgacgagcatttgccttcccgagtatttcctccagagattgtggagcagatgggttgtatacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggaggcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggaatgaccaatagaccagatctgatagatgaggctcttcttagacctggaagactggaagttaaaatggagataggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggccagtactaaagtggaagtggacatggagaaagcagaaagcctgcaagtgacgagaggagacttccttgcttctttggagaatgatatcaaaccagcctttggcacaaaccaagaagattatgcaagttacattatgaacggtatcatcaaatggggtgacccagttactcgagttctagatgatggggagctgctggtgcagcagactaagaacagtgaccgcacaccattggtcagcgtgcttctggaaggccctcctcacagtgggaagactgctttagctgcaaaaattgcagaggaatccaacttcccgttcatcaagatctgttctcctgataaaatgattggcttttctgaaacagccaaatgtcaggccatgaagaagatctttgatgatgcgtacaaatcccagctcagttgtgtggttgtggatgacattgagagattgcttgattacgtccctattggccctcgattttcaaatcttgtattacaggctcttctcgttttactgaaaaaggcacctcctcagggccgcaagcttcttatcattgggaccactagccgcaaagatgtccttcaggagatggaaatgcttaacgctttcagcaccaccatccacgtgcccaacattgccacaggagagcagctgttggaagctttggagcttttgggcaacttcaaggataaggaacgcaccacaattgcacagcaagtcaaagggaagaaggtctggataggaatcaagaagttactaatgctgatcgagatgtccctacagatggatcctgaataccgtgtgagaaaattcttggccctcttaagagaagaaggagctagcccccttgattttgattgaaaatgaactatttgaaacacacagtgaccaagggaagtgaccaaggtgaagatggcctaggatcttcactgtcttactcaagatactggactaagtggaacgttctctaccttcaacatgtgctcgctctgcatgattagtgcaataaaactcccttccttatgcatactgagatagcttagtgtctcgtggaaggtgtcaatttggtttagaatgctgcgcttaccttcccatgcaggctaaagtgattccttcttgctcagtccctctgggtgggaaccatccagtacttgtggacactacacgtttcaacctctctactagcaccatcacccttgaaaactctcagtcagtgtcatgaatgttgcatgacaacagttggccgattagaaggcagactttctacatgcaaatctggcttagtaaatcgaggtgtgggccagagatcctctgacagctgtcctgagctaacactaaaagtcactgggtatttggttaaaggtctcccacaagactggtattctctttgcctgaagaaacaaggcattgaatctctaaaatgctgttctcaatcattgtcagagatgttttcaagttgcagtcagaagatctttcttaatagaaagtcagatgactaccgtgttggttgtgacttccccttaagtataactaatttgctctgtggtaagagatatgctcattattaccacttagaagatgttgttaaaaacatgtgaaagataggtatggaaaaagcatacacccccaaacagaaaggagttattaaagtaatttacaaacctctcagcactaattagtgtccaactccaagtgggtcaattccttagtataatattaaggcttactagtatcactgctttttccttagcttaatgacttacttagaatttatcctttattttaaatgatctgtactatctagtgtctaaaacactattctccagaaaaatcaatcattttctagccctctccctcagtcctttattgtccattccaatacattgaacacatttcctttaccctccacacacttcttccaaaaggaagcacccgttgagtccttttgagggtgatttgtcttacaactgactgacttagcaggaatttaattaggtcatatttggtgatgagacttatggagtgtgcctctctctcccaactgctgcttaaaatgcaaggacaagcaattagaagccatcctaaggtgcttacctcacacgccacccatgaggcttgtggccacagtggcacttgggtgtggctcctctgttatttgtcctcatgtgagaaagcagatcatctccaaatcttgccatttgtatacttttggtggagacttggatgtcatatcttctttgttttgggttttcttccctagcttattttgtggcttttaaagaagtggattgtattgtgagatcctgtgattcctggtggccagtatcctggattcctctaagatcttgcctctttcctcctcatgaaagcagcacacattgtgttaacttatgtctcttgttaaatgagcttaatgtctttgtgttttgtccaaaactgtattgaaaaaatattgtttaatgcaaatgaaggaatgcaataaaggcctcgttggcctcagcggtggagctctgcgcnaagnctataaaaattataatctcttactattacttatcacaa

SEQ ID NO: 455783 - DNA, 3997 bp, Homo sapiens
  misc_feature (3956)..(3956): n is a, c, g, or t
gcgggggcgggctttgccgagcgcagagctgcagccgccgagccggacgtgtgcgcgaagatggcgggccggagcatgcaagcggcaagatgtcctacagatgaattatctttaaccaattgtgcagttgtgaatgaaaaggatttccagtctggccagcatgtgattgtgaggacctctcccaatcacaggtacacatttacactgaagacacatccatcggtggttccagggagcattgcattcagtttacctcagagaaaatgggctgggctttctattgggcaagaaatagaagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacagcttgtctttagcttcaatgaaaagctttttggcttactggtgaaggacattgaatccatggatcctagcatcctgaagggagagcctgcgacagggaaaaggcagaagattgaagtaggactggttgttggaaacagtcaagttgcatttgaaaaagcagaaaattcgtcacttaatcttattggcaaagctaaaaccaaggaaaatcgccaatcaattatcaatcctgactggaactttgaaaaaatgggaataggaggtctagacaaggaattttcagatattttccgacgagcatttgccttcccgagtatttcctccagagattgtggagcagatgggttgtatacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggaggcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggaatgaccaatagaccagatctgatagatgaggctcttcttagacctggaagactggaagttaaaatggagataggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggccagtactaaagtggaagtggacatggagaaagcagaaagcctgcaagtgacgagaggagacttccttgcttctttggagaatgatatcaaaccagcctttggcacaaaccaagaagattatgcaagttacattatgaacggtatcatcaaatggggtgacccagttactcgagttctagatgatggggagctgctggtgcagcagactaagaacagtgaccgcacaccattggtcagcgtgcttctggaaggccctcctcacagtgggaagactgctttagctgcaaaaattgcagaggaatccaacttcccgttcatcaagatctgttctcctgataaaatgattggcttttctgaaacagccaaatgtcaggccatgaagaagatctttgatgatgcgtacaaatcccagctcagttgtgtggttgtggatgacattgagagattgcttgattacgtccctattggccctcgattttcaaatcttgtattacaggctcttctcgttttactgaaaaaggcacctcctcagggccgcaagcttcttatcattgggaccactagccgcaaagatgtccttcaggagatggaaatgcttaacgctttcagcaccaccatccacgtgcccaacattgccacaggagagcagctgttggaagctttggagcttttgggcaacttcaaggataaggaacgcaccacaattgcacagcaagtcaaagggaagaaggtctggataggaatcaagaagttactaatgctgatcgagatgtccctacagatggatcctgaataccgtgtgagaaaattcttggccctcttaagagaagaaggagctagcccccttgattttgattgaaaatgaactatttgaaacacacagtgaccaagggaagtgaccaaggtgaagatggcctaggatcttcactgtcttactcaagatactggactaagtggaacgttctctaccttcaacatgtgctcgctctgcatgattagtgcaataaaactcccttccttatgcatactgagatagcttagtgtctcgtggaaggtgtcaatttggtttagaatgctgcgcttaccttcccatgcaggctaaagtgattccttcttgctcagtccctctgggtgggaaccatccagtacttgtggacactacacgtttcaacctctctactagcaccatcacccttgaaaactctcagtcagtgtcatgaatgttgcatgacaacagttggccgattagaaggcagactttctacatgcaaatctggcttagtaaatcgaggtgtgggccagagatcctctgacagctgtcctgagctaacactaaaagtcactgggtatttggttaaaggtctcccacaagactggtattctctttgcctgaagaaacaaggcattgaatctctaaaatgctgttctcaatcattgtcagagatgttttcaagttgcagtcagaagatctttcttaatagaaagtcagatgactaccgtgttggttgtgacttccccttaagtataactaatttgctctgtggtaagagatatgctcattattaccacttagaagatgttgttaaaaacatgtgaaagataggtatggaaaaagcatacacccccaaacagaaaggagttattaaagtaatttacaaacctctcagcactaattagtgtccaactccaagtgggtcaattccttagtataatattaaggcttactagtatcactgctttttccttagcttaatgacttacttagaatttatcctttattttaaatgatctgtactatctagtgtctaaaacactattctccagaaaaatcaatcattttctagccctctccctcagtcctttattgtccattccaatacattgaacacatttcctttaccctccacacacttcttccaaaaggaagcacccgttgagtccttttgagggtgatttgtcttacaactgactgacttagcaggaatttaattaggtcatatttggtgatgagacttatggagtgtgcctctctctcccaactgctgcttaaaatgcaaggacaagcaattagaagccatcctaaggtgcttacctcacacgccacccatgaggcttgtggccacagtggcacttgggtgtggctcctctgttatttgtcctcatgtgagaaagcagatcatctccaaatcttgccatttgtatacttttggtggagacttggatgtcatatcttctttgttttgggttttcttccctagcttattttgtggcttttaaagaagtggattgtattgtgagatcctgtgattcctggtggccagtatcctggattcctctaagatcttgcctctttcctcctcatgaaagcagcacacattgtgttaacttatgtctcttgttaaatgagcttaatgtctttgtgttttgtccaaaactgtattgaaaaaatattgtttaatgcaaatgaaggaatgcaataaagtggcctcgttggcctcagcggtggagctctgcggcanagaaattaatataaaaataaataatcgatattatcaataat

SEQ ID NO: 455784 - DNA, 1284 bp, Homo sapiens
gcgggggcgggctttgccgagcgcagagctgcagccgccgagccggacgtgtgcgcgaagatggcgggccggagcatgcaagcggcaagatgtcctacagatgaattatctttaaccaattgtgcagttgtgaatgaaaaggatttccagtctggccagcatgtgattgtgaggacctctcccaatcacaggtacacatttacactgaagacacatccatcggtggttccagggagcattgcattcagtttacctcagatgactaccgtgttggttgtgacttccccttaagtataactaatttgctctgtggtaagagatatgctcattattaccacttagaagatgttgttaaaaacatgtgaaagataggtatggaaaaagcatacacccccaaacagaaaggagttattaaagtaatttacaaacctctcagcactaattagtgtccaactccaagtgggtcaattccttagtataatattaaggcttactagtatcactgctttttccttagcttaatgacttacttagaatttatcctttattttaaatgatctgtactatctagtgtctaaaacactattctccagaaaaatcaatcattttctagccctctccctcagtcctttattgtccattccaatacattgaacacatttcctttaccctccacacacttcttccaaaaggaagcacccgttgagtccttttgagggtgatttgtcttacaactgactgacttagcaggaatttaattaggtcatatttggtgatgagacttatggagtgtgcctctctctcccaactgctgcttaaaatgcaaggacaagcaattagaagccatcctaaggtgcttacctcacacgccacccatgaggcttgtggccacagtggcacttgggtgtggctcctctgttatttgtcctcatgtgagaaagcagatcatctccaaatcttgccatttgtatacttttggtggagacttggatgtcatatcttctttgttttgggttttcttccctagcttattttgtggcttttaaagaagtggattgtattgtgagatcctgtgattcctggtggccagtatcctggattcctctaagatcttgcctctttcctcctcatgaaagcagcacacattgtgttaacttatgtctcttgttaaatgagcttaatgtctttgtgttttgtccaaaactgtattgaaaaaatattgtttaatgcaaatgaaggaatgcaataaagagtaaatatacttgaaaaaaaaaaaagaccagt

SEQ ID NO: 455785 - DNA, 2643 bp, Homo sapiens
  misc_feature (2602)..(2602): n is a, c, g, or t
gcgggggcgggctttgccgagcgcagagctgcagccgccgagccggacgtgtgcgcgaagatggcgggccggagcatgcaagcggcaagatgtcctacagatgaattatctttaaccaattgtgcagttgtgaatgaaaaggatttccagtctggccagcatgtgattgtgaggacctctcccaatcacaggtacacatttacactgaagacacatccatcggtggttccagggagcattgcattcagtttacctcagagaaaatgggctgggctttctattgggcaagaaatagaagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacagcttgtctttagcttcaatgaaaagctttttggcttactggtgaaggacattgaatccatggatcctagcatcctgaagggagagcctgcgacagggaaaaggcagaagattgaagtaggactggttgttggaaacagtcaagttgcatttgaaaaagcagaaaattcgtcacttaatcttattggcaaagctaaaaccaaggaaaatcgccaatcaattatcaatcctgactggaactttgaaaaaatgggaataggaggtctagacaaggaattttcagatattttccgacgagcatttgccttcccgagtatttcctccagagattgtggagcagatgggttgtatacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggaggcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggaatgaccaatagaccagatctgatagatgaggctcttcttagacctggaagactggaagttaaaatggagataggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggccagtactaaagtggaagtggacatggagaaagcagaaagcctgcaagtgacgagaggagacttccttgcttctttggagaatgatatcaaaccagcctttggcacaaaccaagaagattatgcaagttacattatgaacggtatcatcaaatggggtgacccagttactcgagttctagatgatggggagctgctggtgcagcagactaagaacagtgaccgcacaccattggtcagcgtgcttctggaaggccctcctcacagtgggaagactgctttagctgcaaaaattgcagaggaatccaacttcccgttcatcaagatctgttctcctgataaaatgattggcttttctgaaacagccaaatgtcaggccatgaagaagatctttgatgatgcgtacaaatcccagctcagttgtgtggttgtggatgacattgagagattgcttgattacgtccctattggccctcgattttcaaatcttgtattacaggctcttctcgttttactgaaaaaggcacctcctcagggccgcaagcttcttatcattgggaccactagccgcaaagatgtccttcaggagatggaaatgcttaacgctttcagcaccaccatccacgtgcccaacattgccacaggagagcagctgttggaagctttggagcttttgggcaacttcaaggataaggaacgcaccacaattgcacagcaagtcaaagggaagaaggtctggataggaatcaagaagttactaatgctgatcgagatgtccctacagatggatcctgaataccgtgtgagaaaattcttggccctcttaagagaagaaggagctagcccccttgattttgattgaaaatgaactatttgaaacacacagtgaccaagggaagtgaccaagcttattttgtggcttttaaagaagtggattgtattgtgagatcctgtgattcctggtggccagtatcctggattcctctaagatcttgcctctttcctcctcatgaaagcagcacacattgtgttaacttatgtctcttgttaaatgagcttaatgtctttgtgttttgtccaaaactgtattgaaaaaatattgtttaatgcaaatgaaggaatgcaataaagtggcctcgttggcctcagcggtggagctctgcggcanagaaattaatataaaaataaataatcgatattatcaataat

SEQ ID NO: 455786 - DNA, 353 bp, Homo sapiens
cttttctgaaacagccaaatgtcaggccatgaagaaggtatcaagattttactttcattttaatttcctatctcttaaatgtgtgtgtgtgtgcacatatatatgcctttgtacatgtatacatataaacccatagcaactatgttcttctcaagtggaaccaaattatcagcagaatatgggggaagcagtgactgttttagattttctaactttgtaatgtattttattgagtacctttaccttctaaattatgctttgtttaatacatattaagtttcattgcctagttttgtatcaatttgattaaaagagttatagttgaaagtgtttgaataaagtggacaaattca

SEQ ID NO: 455787 - DNA, 3952 bp, Homo sapiens
gcgggggcgggctttgccgagcgcagagctgcagccgccgagccggacgtgtgcgcgaagatggcgggccggagcatgcaagcggcaagatgtcctacagatgaattatctttaaccaattgtgcagttgtgaatgaaaaggatttccagtctggccagcatgtgattgtgaggacctctcccaatcacaggtacacatttacactgaagacacatccatcggtggttccagggagcattgcattcagtttacctcagagaaaatgggctgggctttctattgggcaagaaatagaagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacagcttgtctttagcttcaatgaaaagctttttggcttactggtgaaggacattgaatccatggatcctagcatcctgaagggagagcctgcgacagggaaaaggcagaagattgaagtaggactggttgttggaaacagtcaagttgcatttgaaaaagcagaaaattcgtcacttaatcttattggcaaagctaaaaccaaggaaaatcgccaatcaattatcaatcctgactggaactttgaaaaaatgggaataggaggtctagacaaggaattttcagatattttccgacgagcatttgccttcccgagtatttcctccagagattgtggagcagatgggttgtatacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggaggcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggaatgaccaatagaccagatctgatagatgaggctcttcttagacctggaagactggaagttaaaatggagataggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggccagtactaaagtggaagtggacatggagaaagcagaaagcctgcaagtgacgagaggagacttccttgcttctttggagaatgatatcaaaccagcctttggcacaaaccaagaagattatgcaagttacattatgaacggtatcatcaaatggggtgacccagttactcgagttctagatgatggggagctgctggtgcagcagactaagaacagtgaccgcacaccattggtcagcgtgcttctggaaggccctcctcacagtgggaagactgctttagctgcaaaaattgcagaggaatccaacttcccgttcatcaagatctgttctcctgataaaatgattggcttttctgaaacagccaaatgtcaggccatgaagaagatctttgatgatgcgtacaaatcccagctcagttgtgtggttgtggatgacattgagagattgcttgattacgtccctattggccctcgattttcaaatcttgtattacaggctcttctcgttttactgaaaaaggcacctcctcagggccgcaagcttcttatcattgggaccactagccgcaaagatgtccttcaggagatggaaatgcttaacgctttcagcaccaccatccacgtgcccaacattgccacaggagagcagctgttggaagctttggagcttttgggcaacttcaaggataaggaacgcaccacaattgcacagcaagtcaaagggaagaaggtctggataggaatcaagaagttactaatgctgatcgagatgtccctacagatggatcctgaataccgtgtgagaaaattcttggccctcttaagagaagaaggagctagcccccttgattttgattgaaaatgaactatttgaaacacacagtgaccaagggaagtgaccaaggtgaagatggcctaggatcttcactgtcttactcaagatactggactaagtggaacgttctctaccttcaacatgtgctcgctctgcatgattagtgcaataaaactcccttccttatgcatactgagatagcttagtgtctcgtggaaggtgtcaatttggtttagaatgctgcgcttaccttcccatgcaggctaaagtgattccttcttgctcagtccctctgggtgggaaccatccagtacttgtggacactacacgtttcaacctctctactagcaccatcacccttgaaaactctcagtcagtgtcatgaatgttgcatgacaacagttggccgattagaaggcagactttctacatgcaaatctggcttagtaaatcgaggtgtgggccagagatcctctgacagctgtcctgagctaacactaaaagtcactgggtatttggttaaaggtctcccacaagactggtattctctttgcctgaagaaacaaggcattgaatctctaaaatgctgttctcaatcattgtcagagatgttttcaagttgcagtcagaagatctttcttaatagaaagtcagatgactaccgtgttggttgtgacttccccttaagtataactaatttgctctgtggtaagagatatgctcattattaccacttagaagatgttgttaaaaacatgtgaaagataggtatggaaaaagcatacacccccaaacagaaaggagttattaaagtaatttacaaacctctcagcactaattagtgtccaactccaagtgggtcaattccttagtataatattaaggcttactagtatcactgctttttccttagcttaatgacttacttagaatttatcctttattttaaatgatctgtactatctagtgtctaaaacactattctccagaaaaatcaatcattttctagccctctccctcagtcctttattgtccattccaatacattgaacacatttcctttaccctccacacacttcttccaaaaggaagcacccgttgagtccttttgagggtgatttgtcttacaactgactgacttagcaggaatttaattaggtcatatttggtgatgagacttatggagtgtgcctctctctcccaactgctgcttaaaatgcaaggacaagcaattagaagccatcctaaggtgcttacctcacacgccacccatgaggcttgtggccacagtggcacttgggtgtggctcctctgttatttgtcctcatgtgagaaagcagatcatctccaaatcttgccatttgtatacttttggtggagacttggatgtcatatcttctttgttttgggttttcttccctagcttattttgtggcttttaaagaagtggattgtattgtgagatcctgtgattcctggtggccagtatcctggattcctctaagatcttgcctctttcctcctcatgaaagcagcacacattgtgttaacttatgtctcttgttaaatgagcttaatgtctttgtgttttgtccaaaactgtattgaaaaaatattgtttaatgcaaatgaaggaatgcaataaagagtaaatatacttgaaaaaaaaaaaagaccagt

SEQ ID NO: 455788 - DNA, 3898 bp, Homo sapiens
gcgggggcgggctttgccgagcgcagagctgcagccgccgagccggacgtgtgcgcgaagatggcgggccggagcatgcaagcggcaagatgtcctacagatgaattatctttaaccaattgtgcagttgtgaatgaaaaggatttccagtctggccagcatgtgattgtgaggacctctcccaatcacaggtacacatttacactgaagacacatccatcggtggttccagggagcattgcattcagtttacctcagagaaaatgggctgggctttctattgggcaagaaatagaagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacagcttgtctttagcttcaatgaaaagctttttggcttactggtgaaggacattgaatccatggatcctagcatcctgaagggagagcctgcgacagggaaaaggcagaagattgaagtaggactggttgttggaaacagtcaagttgcatttgaaaaagcagaaaattcgtcacttaatcttattggcaaagctaaaaccaaggaaaatcgccaatcaattatcaatcctgactggaactttgaaaaaatgggaataggaggtctagacaaggaattttcagatattttccgacgagcatttgccttcccgagtatttcctccagagattgtggagcagatgggttgtatacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggaggcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggaatgaccaatagaccagatctgatagatgaggctcttcttagacctggaagactggaagttaaaatggagataggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggccagtactaaagtggaagtggacatggagaaagcagaaagcctgcaagtgacgagaggagacttccttgcttctttggagaatgatatcaaaccagcctttggcacaaaccaagaagattatgcaagttacattatgaacggtatcatcaaatggggtgacccagttactcgagttctagatgatggggagctgctggtgcagcagactaagaacagtgaccgcacaccattggtcagcgtgcttctggaaggccctcctcacagtgggaagactgctttagctgcaaaaattgcagaggaatccaacttcccgttcatcaagatctgttctcctgataaaatgattggcttttctgaaacagccaaatgtcaggccatgaagaagatctttgatgatgcgtacaaatcccagctcagttgtgtggttgtggatgacattgagagattgcttgattacgtccctattggccctcgattttcaaatcttgtattacaggctcttctcgttttactgaaaaaggcacctcctcagggccgcaagcttcttatcattgggaccactagccgcaaagatgtccttcaggagatggaaatgcttaacgctttcagcaccaccatccacgtgcccaacattgccacaggagagcagctgttggaagctttggagcttttgggcaacttcaaggataaggaacgcaccacaattgcacagcaagtcaaagggaagaaggtctggataggaatcaagaagttactaatgctgatcgagatgtccctacagatggatcctgaataccgtgtgagaaaattcttggccctcttaagagaagaaggagctagcccccttgattttgattgaaaatgaactatttgaaacacacagtgaccaagggaagtgaccaaggtgaagatggcctaggatcttcactgtcttactcaagatactggactaagtggaacgttctctaccttcaacatgtgctcgctctgcatgattagtgcaataaaactcccttccttatgcatactgagatagcttagtgtctcgtggaaggtgtcaatttggtttagaatgctgcgcttaccttcccatgcaggctaaagtgattccttcttgctcagtccctctgggtgggaaccatccagtacttgtggacactacacgtttcaacctctctactagcaccatcacccttgagcagactttctacatgcaaatctggcttagtaaatcgaggtgtgggccagagatcctctgacagctgtcctgagctaacactaaaagtcactgggtatttggttaaaggtctcccacaagactggtattctctttgcctgaagaaacaaggcattgaatctctaaaatgctgttctcaatcattgtcagagatgttttcaagttgcagtcagaagatctttcttaatagaaagtcagatgactaccgtgttggttgtgacttccccttaagtataactaatttgctctgtggtaagagatatgctcattattaccacttagaagatgttgttaaaaacatgtgaaagataggtatggaaaaagcatacacccccaaacagaaaggagttattaaagtaatttacaaacctctcagcactaattagtgtccaactccaagtgggtcaattccttagtataatattaaggcttactagtatcactgctttttccttagcttaatgacttacttagaatttatcctttattttaaatgatctgtactatctagtgtctaaaacactattctccagaaaaatcaatcattttctagccctctccctcagtcctttattgtccattccaatacattgaacacatttcctttaccctccacacacttcttccaaaaggaagcacccgttgagtccttttgagggtgatttgtcttacaactgactgacttagcaggaatttaattaggtcatatttggtgatgagacttatggagtgtgcctctctctcccaactgctgcttaaaatgcaaggacaagcaattagaagccatcctaaggtgcttacctcacacgccacccatgaggcttgtggccacagtggcacttgggtgtggctcctctgttatttgtcctcatgtgagaaagcagatcatctccaaatcttgccatttgtatacttttggtggagacttggatgtcatatcttctttgttttgggttttcttccctagcttattttgtggcttttaaagaagtggattgtattgtgagatcctgtgattcctggtggccagtatcctggattcctctaagatcttgcctctttcctcctcatgaaagcagcacacattgtgttaacttatgtctcttgttaaatgagcttaatgtctttgtgttttgtccaaaactgtattgaaaaaatattgtttaatgcaaatgaaggaatgcaataaagagtaaatatacttgaaaaaaaaaaaagaccagt

SEQ ID NO: 455789 - DNA, 3848 bp, Homo sapiens
  misc_feature (3848)..(3848): n is a, c, g, or t
gcgggggcgggctttgccgagcgcagagctgcagccgccgagccggacgtgtgcgcgaagatggcgggccggagcatgcaagcggcaagatgtcctacagatgaattatctttaaccaattgtgcagttgtgaatgaaaaggatttccagtctggccagcatgtgattgtgaggacctctcccaatcacaggtacacatttacactgaagacacatccatcggtggttccagggagcattgcattcagtttacctcagagaaaatgggctgggctttctattgggcaagaaatagaagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacagcttgtctttagcttcaatgaaaagctttttggcttactggtgaaggacattgaatccatggatcctagcatcctgaagggagagcctgcgacagggaaaaggcagaagattgaagtaggactggttgttggaaacagtcaagttgcatttgaaaaagcagaaaattcgtcacttaatcttattggcaaagctaaaaccaaggaaaatcgccaatcaattatcaatcctgactggaactttgaaaaaatgggaataggaggtctagacaaggaattttcagatattttccgacgagcatttgccttcccgagtatttcctccagagattgtggagcagatgggttgtatacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggaggcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggaatgaccaatagaccagatctgatagatgaggctcttcttagacctggaagactggaagttaaaatggagataggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggccagtactaaagtggaagtggacatggagaaagcagaaagcctgcaagtgacgagaggagacttccttgcttctttggagaatgatatcaaaccagcctttggcacaaaccaagaagattatgcaagttacattatgaacggtatcatcaaatggggtgacccagttactcgagttctagatgatggggagctgctggtgcagcagactaagaacagtgaccgcacaccattggtcagcgtgcttctggaaggccctcctcacagtgggaagactgctttagctgcaaaaattgcagaggaatccaacttcccgttcatcaagatctgttctcctgataaaatgattggcttttctgaaacagccaaatgtcaggccatgaagaagatctttgatgatgcgtacaaatcccagctcagttgtgtggttgtggatgacattgagagattgcttgattacgtccctattggccctcgattttcaaatcttgtattacaggctcttctcgttttactgaaaaaggcacctcctcagggccgcaagcttcttatcattgggaccactagccgcaaagatgtccttcaggagatggaaatgcttaacgctttcagcaccaccatccacgtgcccaacattgccacaggagagcagctgttggaagctttggagcttttgggcaacttcaaggataaggaacgcaccacaattgcacagcaagtcaaagggaagaaggtctggataggaatcaagaagttactaatgctgatcgagatgtccctacagatggatcctgaataccgtgtgagaaaattcttggccctcttaagagaagaaggagctagcccccttgattttgattgaaaatgaactatttgaaacacacagtgaccaagggaagtgaccaaggtgaagatggcctaggatcttcactgtcttactcaagatactggactaagtggaacgttctctaccttcaacatgtgctcgctctgcatgattagtgcaataaaactcccttccttatgcatactgagatagcttagtgtctcgtggaaggtgtcaatttggtttagaatgctgcgcttaccttcccatgcaggctaaagtgattccttcttgctcagtccctctgggtgggaaccatccagtacttgtggacactacacgtttcaacctctctactagcaccatcacccttgaaaactctcagtcagtgtcatgaatgttgcatgacaacagttggccgattagaaggcagactttctacatgcaaatctggcttagtaaatcgaggtgtgggccagagatcctctgacagctgtcctgagctaacactaaaagtcactgggtatttggttaaaggtctcccacaagactggtattctctttgcctgaagaaacaaggcattgaatctctaaaatgctgttctcaatcattgtcagagatgttttcaagttgcagtcagaagatctttcttaatagaaagtcagatgactaccgtgttggttgtgacttccccttaagtataactaatttgctctgtggtaagagatatgctcattattaccacttagaagatgttgttaaaaacatgtgaaagataggtatggaaaaagcatacacccccaaacagaaaggagttattaaagtaatttacaaacctctcagcactaattagtgtccaactccaagtgggtcaattccttagtataatattaaggcttactagtatcactgctttttccttagcttaatgacttacttagaatttatcctttattttaaatgatctgtactatctagtgtctaaaacactattctccagaaaaatcaatcattttctagccctctccctcagtcctttattgtccattccaatacattgaacacatttcctttaccctccacacacttcttccaaaaggaagcacccgttgagtccttttgagggtgatttgtcttacaactgactgacttagcaggaatttaattaggtcatatttggtgatgagacttatggagtgtgcctctctctcccaactgctgcttaaaatgcaaggacaagcaattagaagccatcctaaggtgcttacctcacacgccacccatgaggcttgtggccacagtggcacttgggtgtggctcctctgttatttgtcctcatgtgagaaagcagatcatctccaaatcttgccatttgtatactttgggggactggttgctatctcttgttgggttctgcctagctattgggtttagactggtgttgggaccggactgggggcggtcggatcctgattgccctcccctgagggcctgggtttgctggggcgcgttggtgcccgtgagatgtgtgcgggggctttgaaaaaagggggtacgggccgggggtggtccggcgcggccgtcgtn

SEQ ID NO: 455790 - DNA, 1980 bp, Homo sapiens
  misc_feature (9)..(9): n is a, c, g, or t
  misc_feature (44)..(44): n is a, c, g, or t
  misc_feature (47)..(47): n is a, c, g, or t
  misc_feature (1565)..(1565): n is a, c, g, or t
  misc_feature (1748)..(1748): n is a, c, g, or t
  misc_feature (1760)..(1760): n is a, c, g, or t
  misc_feature (1766)..(1768): n is a, c, g, or t
  misc_feature (1771)..(1771): n is a, c, g, or t
  misc_feature (1777)..(1777): n is a, c, g, or t
  misc_feature (1784)..(1785): n is a, c, g, or t
  misc_feature (1792)..(1792): n is a, c, g, or t
  misc_feature (1797)..(1797): n is a, c, g, or t
  misc_feature (1799)..(1799): n is a, c, g, or t
  misc_feature (1804)..(1804): n is a, c, g, or t
  misc_feature (1808)..(1808): n is a, c, g, or t
  misc_feature (1814)..(1814): n is a, c, g, or t
  misc_feature (1820)..(1820): n is a, c, g, or t
  misc_feature (1825)..(1826): n is a, c, g, or t
  misc_feature (1834)..(1834): n is a, c, g, or t
  misc_feature (1839)..(1839): n is a, c, g, or t
  misc_feature (1841)..(1843): n is a, c, g, or t
  misc_feature (1848)..(1848): n is a, c, g, or t
  misc_feature (1858)..(1858): n is a, c, g, or t
  misc_feature (1862)..(1862): n is a, c, g, or t
  misc_feature (1866)..(1866): n is a, c, g, or t
  misc_feature (1869)..(1869): n is a, c, g, or t
  misc_feature (1877)..(1877): n is a, c, g, or t
  misc_feature (1888)..(1889): n is a, c, g, or t
  misc_feature (1894)..(1894): n is a, c, g, or t
  misc_feature (1896)..(1897): n is a, c, g, or t
  misc_feature (1904)..(1904): n is a, c, g, or t
  misc_feature (1907)..(1908): n is a, c, g, or t
  misc_feature (1915)..(1915): n is a, c, g, or t
  misc_feature (1920)..(1920): n is a, c, g, or t
  misc_feature (1926)..(1926): n is a, c, g, or t
  misc_feature (1932)..(1933): n is a, c, g, or t
  misc_feature (1937)..(1937): n is a, c, g, or t
  misc_feature (1939)..(1939): n is a, c, g, or t
  misc_feature (1945)..(1945): n is a, c, g, or t
  misc_feature (1961)..(1962): n is a, c, g, or t
  misc_feature (1968)..(1968): n is a, c, g, or t
gagaaggtntctttctctgttgcccaggctggagtgcagcggcngangctcggatcactacaacctctgcctctcgggttcaagcagttctcctgcctcagcctcccaagtagctgagattacagcatgcaagcggcaagatgtcctacagatgaattatctttaaccaattgtgcagttgtgaatgaaaaggatttccagtctggccagcatgtgattgtgaggacctctcccaatcacaggtacacatttacactgaagacacatccatcggtggttccagggagcattgcattcagtttacctcagagaaaatgggctgggctttctattgggcaagaaatagaagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctngtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccactcatgcctgtaatcccancactttgggagnctgagnnnggnggatcntttgagnncaggagntcaanancagcntggncaacanagtganacccnntctctacnaaaantnnnaaaantagctgcgtntgtngtcncanctactcangaggctgaggnnggagnanngcttganccnnggaggtngaggntgcagngagccnngatngngccacngcactccagcctgggnnacagancgagattgtctc

SEQ ID NO: 455791 - DNA, 138 bp, Homo sapiens
gcacagtggctccctggggatggggcccatggccacagagctggagcccctgtgcactccggtggtcacctgtactcccagctgcactgcttacacgtcttccttcgtcttcgggtcgtttggagatcctctagagcg

SEQ ID NO: 455792 - DNA, 2093 bp, Homo sapiens
aaagcagtggctgcggcgcctcgtactcgaaccgcatctgcagcgagcaactgagaagccaagactgagccggcggccgcggcgcagcgaacgagcagtgaccgtgctcctacccagctctgcttcacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggtaaggctggcttcccgtcgccgcggggccgggggcttggggtcgcggaggaggagacaccgggcgggacgctccagtagatgagtagggggctcccttgtgcctggagggaggctgccgtggccggagcggtgccggctcgggggctcgggacttgctctgagcgcacgcacgcttgccatagtaagaattggttcccccttcgggaggcaggttcgttctgagcaacctctggtctgcactccaggacggatctctgacattagctggagcagacgtgtcccaagcacaaactcgctaactagagcctggcttctccggggaggtggcagaaagcggcaatcccccctcccccggcagcctggagcacggaggagggatgagggaggagggtgcagcgggcgggtgtgtaaggcagtttcattgataaaaagcgagttcattctggagactccggagcggcgcctgcgtcagcgcagacgtcagggatatttataacaaaccccctttcaagcaagtgatgctgaagggataacgggaacgcagcggcaggatggaagagacaggcactgcgctgcggaatgcctgggaggaaaagggggagacctttcatccaggatgagggacatttaagatgaaatgtccgtggcaggatcgtttctcttcactgctgcatgcggcactgggaactcgccccacctgtgtccggaacctgctcgctcacgtcggctttccccttctgttttgttctaggacttctgcacggacctggccgtctccagtgccaacttcattcccacggtcactgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaagcatccatgtgtggactcaagtccttacctcttccggagatgtagcaaaacgcatggagtgtgtattgttcccagtgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcga

SEQ ID NO: 455793 - DNA, 1340 bp, Homo sapiens
aaagcagtggctgcggcgcctcgtactcgaaccgcatctgcagcgagcaactgagaagccaagactgagccggcggccgcggcgcagcgaacgagcagtgaccgtgctcctacccagctctgcttcacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggacttctgcacggacctggccgtctccagtgccaacttcattcccacggtcactgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaagcatccatgtgtggactcaagtccttacctcttccggagatgtagcaaaacgcatggagtgtgtattgttcccagtgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcga

SEQ ID NO: 455794 - DNA, 1580 bp, Homo sapiens
aaagcagtggctgcggcgcctcgtactcgaaccgcatctgcagcgagcaactgagaagccaagactgagccggcggccgcggcgcagcgaacgagcagtgaccgtgctcctacccagctctgcttcacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggacttctgcacggacctggccgtctccagtgccaacttcattcccacggtcactgccatctcgaccagtccggacctgcagtggctggtgcagcccgccctcgtctcctctgtggccccatcgcagaccagagcccctcaccctttcggagtccccgccccctccgctggggcttactccagggctggcgttgtgaagaccatgacaggaggccgagcgcagagcattggcaggaggggcaaggtggaacagttatctccagaagaagaagagaaaaggagaatccgaagggaaaggaataagatggctgcagccaaatgccgcaaccggaggagggagctgactgatacactccaagcggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtgggcttcccttgatcttgactgggggcctgccagaggttgccaccccggagtctgaggaggccttcaccctgcctctcctcaatgaccctgaggcccaagccctcaggggaacctgtcaagagcatcaggagcatggagctgaagaccggagcccttgatgacttcctgttcccatgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcga

SEQ ID NO: 455795 - DNA, 818 bp, Homo sapiens
cttcctccttagccagaacgccactcccttcccacatccccttcttctctccgccttctccacatctcctaggagatgtggagaaacacatcttccctagagggttcctgtagacctagggaggaccttatctgtgcgtgaaacacaccaggctgtgggcctcaaggacttgaaagcatccatgtgtggactcaagtccttacctcttccggagatgtagcaaaacgcatggagtgtgtattgttcccagtgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcga

SEQ ID NO: 455796 - DNA, 2128 bp, Homo sapiens
aaagcagtggctgcggcgcctcgtactcgaaccgcatctgcagcgagcaactgagaagccaagactgagccggcggccgcggcgcagcgaacgagcagtgaccgtgctcctacccagctctgcttcacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggacttctgcacggacctggccgtctccagtgccaacttcattcccacggtcactgccatctcgaccagtccggacctgcagtggctggtgcagcccgccctcgtctcctctgtggccccatcgcagaccagagcccctcaccctttcggagtccccgccccctccgctggggcttactccagggctggcgttgtgaagaccatgacaggaggccgagcgcagagcattggcaggaggggcaaggtggaacaggtgaggaactctagcgtactcttcctgggaatgtgggggctgggtgggaagcagccccggagatgcaggagcccagtacagaggatgaagccactgatggggctggctgcacatccgtaactgggagccctggctccaagcccattccatcccaactcagactctgagtctcaccctaagaagtactctcatagtttcttccctaagtttcttaccgcatgctttcagactgggctcttctttgttctcttgctgaggatcttattttaaatgcaagtcacacctagtctgcaactgcaggtcagaaatggtttcacagtggggtgccaggaagcagggaagctgcaggagccagttctactggggtgggtgaatggaggtgatggcagacacttttactgaatgtcggtctttttttgtgattattctagttttatctccagaagaagaagagaaaaggagaatccgaagggaaaggaataagatggctgcagccaaatgccgcaaccggaggagggagctgactgatacactccaagcggtaggtactctgtgggttgctcctttttaaaacttaagggaaagttggagattgagcataagggcccttgagtaagactgtgtcttatgctttcctttatccctctgtatacagggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtgggcttcccttgatcttgactgggggcctgccagaggttgccaccccggagtctgaggaggccttcaccctgcctctcctcaatgaccctgaggcccaagccctcaggggaacctgtcaagagcatcaggagcatggagctgaagaccggagcccttgatgacttcctgttcccatgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcga

SEQ ID NO: 455797 - DNA, 865 bp, Homo sapiens
gcacagaggttgcagtgagccgagatcaagccactgcactccagcctggcgacaaagtgatactccgcctcaagaaaaaaaaaaagtatggtaaatacccaaagcaaatcaaaataaaacagtgaaaagacttggaactggctatctctagggagaaataaataagcaccccccttatctgtgcgtgaaacacaccaggctgtgggcctcaaggacttgaaagcatccatgtgtggactcaagtccttacctcttccggagatgtagcaaaacgcatggagtgtgtattgttcccagtgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcga

SEQ ID NO: 455798 - DNA, 725 bp, Homo sapiens
  misc_feature (7)..(7): n is a, c, g, or t
gggctgnctagaggatcccaaacgacccgaagccttatctgtgcgtgaaacacaccaggctgtgggcctcaaggacttgaaagcatccatgtgtggactcaagtccttacctcttccggagatgtagcaaaacgcatggagtgtgtattgttcccagtgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcga

SEQ ID NO: 455799 - DNA, 2013 bp, Homo sapiens
aaagcagtggctgcggcgcctcgtactcgaaccgcatctgcagcgagcaactgagaagccaagactgagccggcggccgcggcgcagcgaacgagcagtgaccgtgctcctacccagctctgcttcacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggacttctgcacggacctggccgtctccagtgccaacttcattcccacggtcactgccatctcgaccagtccggacctgcagtggctggtgcagcccgccctcgtctcctctgtggccccatcgcagaccagagcccctcaccctttcggagtccccgccccctccgctggggcttactccagggctggcgttgtgaagaccatgacaggaggccgagcgcagagcattggcaggaggggcaaggtggaacaggtgaggaactctagcgtactcttcctgggaatgtgggggctgggtgggaagcagccccggagatgcaggagcccagtacagaggatgaagccactgatggggctggctgcacatccgtaactgggagccctggctccaagcccattccatcccaactcagactctgagtctcaccctaagaagtactctcatagtttcttccctaagtttcttaccgcatgctttcagactgggctcttctttgttctcttgctgaggatcttattttaaatgcaagtcacacctagtctgcaactgcaggtcagaaatggtttcacagtggggtgccaggaagcagggaagctgcaggagccagttctactggggtgggtgaatggaggtgatggcagacacttttactgaatgtcggtctttttttgtgattattctagttttatctccagaagaagaagagaaaaggagaatccgaagggaaaggaataagatggctgcagccaaatgccgcaaccggaggagggagctgactgatacactccaagcggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtgggcttcccttgatcttgactgggggcctgccagaggttgccaccccggagtctgaggaggccttcaccctgcctctcctcaatgaccctgaggcccaagccctcaggggaacctgtcaagagcatcaggagcatggagctgaagaccggagcccttgatgacttcctgttcccatgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcga

SEQ ID NO: 455800 - DNA, 1959 bp, Homo sapiens
aaagcagtggctgcggcgcctcgtactcgaaccgcatctgcagcgagcaactgagaagccaagactgagccggcggccgcggcgcagcgaacgagcagtgaccgtgctcctacccagctctgcttcacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggacttctgcacggacctggccgtctccagtgccaacttcattcccacggtcactgccatctcgaccagtccggacctgcagtggctggtgcagcccgccctcgtctcctctgtggccccatcgcagaccagagcccctcaccctttcggagtccccgccccctccgctggggcttactccagggctggcgttgtgaagaccatgacaggaggccgagcgcagagcattggcaggaggggcaaggtggaacaggtgaggaactctagcgtactcttcctgggaatgtgggggctgggtgggaagcagccccggagatgcaggagcccagtacagaggatgaagccactgatggggctggctgcacatccgtaactgggagccctggctccaagcccattccatcccaactcagactctgagtctcaccctaagaagtactctcatagtttcttccctaagtttcttaccgcatgctttcagactgggctcttctttgttctcttgctgaggatcttattttaaatgcaagtcacacctagtctgcaactgcaggtcagaaatggtttcacagtggggtgccaggaagcagggaagctgcaggagccagttctactggggtgggtgaatggaggtgatggcagacacttttactgaatgtcggtctttttttgtgattattctagttttatctccagaagaagaagagaaaaggagaatccgaagggaaaggaataagatggctgcagccaaatgccgcaaccggaggagggagctgactgatacactccaagcggagacagaccaactagaagatgagaagtctgctttgcagaccgagattgccaacctgctgaaggagaaggacctgggcttcccagaagagatgtctgtgggcttcccttgatcttgactgggggcctgccagaggttgccaccccggagtctgaggaggccttcaccctgcctctcctcaatgaccctgaggcccaagccctcaggggaacctgtcaagagcatcaggagcatggagctgaagaccggagcccttgatgacttcctgttcccatgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcga

SEQ ID NO: 455801 - DNA, 1093 bp, Homo sapiens
gcacagtggctccctggggatggggcccatggccacagagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaagcatccatgtgtggactcaagtccttacctcttccggagatgtagcaaaacgcatggagtgtgtattgttcccagtgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcgaaaaaaatttctctttttcttctgctccccctcccccctccccctccccccctccctcctct

SEQ ID NO: 455802 - DNA, 1906 bp, Homo sapiens
aaagcagtggctgcggcgcctcgtactcgaaccgcatctgcagcgagcaactgagaagccaagactgagccggcggccgcggcgcagcgaacgagcagtgaccgtgctcctacccagctctgcttcacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggacttctgcacggacctggccgtctccagtgccaacttcattcccacggtcactgccatctcgaccagtccggacctgcagtggctggtgcagcccgccctcgtctcctctgtggccccatcgcagaccagagcccctcaccctttcggagtccccgccccctccgctggggcttactccagggctggcgttgtgaagaccatgacaggaggccgagcgcagagcattggcaggaggggcaaggtggaacagttatctccagaagaagaagagaaaaggagaatccgaagggaaaggaataagatggctgcagccaaatgccgcaaccggaggagggagctgactgatacactccaagcggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtgggcttcccttgatcttgactgggggcctgccagaggttgccaccccggagtctgaggaggccttcaccctgcctctcctcaatgaccctgaggcccaagccctcaggggaacctgtcaagagcatcaggagcatggagctgaagaccggagcccttgatgacttcctgttcccatgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcgaaaaaaaaaaaaaaaaaaaaaaaaaaaaaaaaaaaaaaaaaaaaaaaaaaaaaaaaaaaaaaaaaaaaaaaataaaaaaaaaaaaatccaaaaaaaaaaaaaaaaaatataaaatacaccttaaaaaaaaaaaaaaataaaaaaaaaaaattttgggccccttttctcccaaatttttttaaaactcggaaatttttttttccggccccaatattagggcctcttttggccatttcccctttaaggggtgcttttaaaatttaggggcccggttcttaacaacacctggtctgtgacctctgggtcccacaaatatccttcttgctc

SEQ ID NO: 455803 - DNA, 966 bp, Homo sapiens
gcacagtggctccctggggatggggcccatggccacagagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggatcaagtccttacctcttccggagatgtagcaaaacgcatggagtgtgtattgttcccagtgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcga

SEQ ID NO: 455804 - DNA, 1499 bp, Homo sapiens
ggtctcctggttgcccaggtcttcaggcttgctcaggtctcctggcttgctcaggtctcctggcttgctcaggtctcctggcttgctcaggtctccatcccaactcagactctgagtctcaccctaagaagtactctcatagtttcttccctaagtttcttaccgcatgctttcagactgggctcttctttgttctcttgctgaggatcttattttaaatgcaagtcacacctagtctgcaactgcaggtcagaaatggtttcacagtggggtgccaggaagcagggaagctgcaggagccagttctactggggtgggtgaatggaggtgatggcagacacttttactgaatgtcggtctttttttgtgattattctagttttatctccagaagaagaagagaaaaggagaatccgaagggaaaggaataagatggctgcagccaaatgccgcaaccggaggagggagctgactgatacactccaagcggtaggtactctgtgggttgctcctttttaaaacttaagggaaagttggagattgagcataagggcccttgagtaagactgtgtcttatgctttcctttatccctctgtatacagggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtgggcttcccttgatcttgactgggggcctgccagaggttgccaccccggagtctgaggaggccttcaccctgcctctcctcaatgaccctgaggcccaagccctcaggggaacctgtcaagagcatcaggagcatggagctgaagaccggagcccttgatgacttcctgttcccatgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcga

SEQ ID NO: 455805 - DNA, 2225 bp, Homo sapiens
aaagcagtggctgcggcgcctcgtactcgaaccgcatctgcagcgagcaactgagaagccaagactgagccggcggccgcggcgcagcgaacgagcagtgaccgtgctcctacccagctctgcttcacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggtaaggctggcttcccgtcgccgcggggccgggggcttggggtcgcggaggaggagacaccgggcgggacgctccagtagatgagtagggggctcccttgtgcctggagggaggctgccgtggccggagcggtgccggctcgggggctcgggacttgctctgagcgcacgcacgcttgccatagtaagaattggttcccccttcgggaggcaggttcgttctgagcaacctctggtctgcactccaggacggatctctgacattagctggagcagacgtgtcccaagcacaaactcgctaactagagcctggcttctccggggaggtggcagaaagcggcaatcccccctcccccggcagcctggagcacggaggagggatgagggaggagggtgcagcgggcgggtgtgtaaggcagtttcattgataaaaagcgagttcattctggagactccggagcggcgcctgcgtcagcgcagacgtcagggatatttataacaaaccccctttcaagcaagtgatgctgaagggataacgggaacgcagcggcaggatggaagagacaggcactgcgctgcggaatgcctgggaggaaaagggggagacctttcatccaggatgagggacatttaagatgaaatgtccgtggcaggatcgtttctcttcactgctgcatgcggcactgggaactcgccccacctgtgtccggaacctgctcgctcacgtcggctttccccttctgttttgttctaggacttctgcacggacctggccgtctccagtgccaacttcattcccacggtcactgccatctcgaccagtccggacctgcagtggctggtgcagcccgccctcgtctcctctgtggccccatcgcagaccagagcccctcaccctttcggagtccccgccccctccgctggggcttactccagggctggcgttgtgaagaccatgacaggaggccgagcgcagagcattggcaggaggggcaaggtggaacaggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtgggcttcccttgatcttgactgggggcctgccagaggttgccaccccggagtctgaggaggccttcaccctgcctctcctcaatgaccctgaggcccaagccctcaggggaacctgtcaagagcatcaggagcatggagctgaagaccggagcccttgatgacttcctgttcccatgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcga

SEQ ID NO: 455806 - DNA, 1144 bp, Homo sapiens
aaagcagtggctgcggcgcctcgtactcgaaccgcatctgcagcgagcaactgagaagccaagactgagccggcggccgcggcgcagcgaacgagcagtgaccgtgctcctacccagctctgcttcacagcgcccacctgtttatctccagaagaagaagagaaaaggagaatccgaagggaaaggaataagatggctgcagccaaatgccgcaaccggaggagggagctgactgatacactccaagcggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtgggcttcccttgatcttgactgggggcctgccagaggttgccaccccggagtctgaggaggccttcaccctgcctctcctcaatgaccctgaggcccaagccctcaggggaacctgtcaagagcatcaggagcatggagctgaagaccggagcccttgatgacttcctgttcccatgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcga

SEQ ID NO: 455807 - DNA, 783 bp, Homo sapiens
ccccgagacagaagatcacctcatggaaatgaatctaagagtgctccaagctcccgaagccgaagtctcactttgctcccacatggaacacccaattctgcgtctccctgtagccagagacacctcagtgtgggggcccccggtgctgtcacaatcacgcatcacaagtcgcatgcagccgcccgaagagccaagagtcagtattccggccagcttgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcga

SEQ ID NO: 455808 - DNA, 1707 bp, Homo sapiens
aaagcagtggctgcggcgcctcgtactcgaaccgcatctgcagcgagcaactgagaagccaagactgagccggcggccgcggcgcagcgaacgagcagtgaccgtgctcctacccagctctgcttcacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggacttctgcacggacctggccgtctccagtgccaacttcattcccacggtcactgccatctcgaccagtccggacctgcagtggctggtgcagcccgccctcgtctcctctgtggccccatcgcagaccagagcccctcaccctttcggagtccccgccccctccgctggggcttactccagggctggcgttgtgaagaccatgacaggaggccgagcgcagagcattggcaggaggggcaaggtggaacagttatctccagaagaagaagagaaaaggagaatccgaagggaaaggaataagatggctgcagccaaatgccgcaaccggaggagggagctgactgatacactccaagcggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtgggcttcccttgatcttgactgggggcctgccagaggttgccaccccggagtctgaggaggccttcaccctgcctctcctcaatgaccctgaggcccaagccctcaggggaacctgtcaagagcatcaggagcatggagctgaagaccggagcccttgatgacttcctgttcccatgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgattgcatttagactcactacttcttaaccgaccccacccaagaaaagaaaaatcgcgatacccgatattaacccttctaagtctaaattccatccttattgcctttagaccccaggtgtcttccagtgtccatcattaatttaaaaacactgaactattttcttgtgttgaattcctttttgaattaatcaccaaaaaaacgctctgaaattaccctggttctggttatttacggactattaatgttccattgcttcctcttcctggcttgtttttggaatttattgtccctttctccatggcattctatgcctttttcacggacttttttttttt

SEQ ID NO: 455809 - DNA, 1471 bp, Homo sapiens
aaagcagtggctgcggcgcctcgtactcgaaccgcatctgcagcgagcaactgagaagccaagactgagccggcggccgcggcgcagcgaacgagcagtgaccgtgctcctacccagctctgcttcacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggacttctgcacggacctggccgtctccagtgccaacttcattcccacggtcactgccatctcgaccagtccggacctgcagtggctggtgcagcccgccctcgtctcctctgtggccccatcgcagaccagagcccctcaccctttcggagtccccgccccctccgctggggcttactccagggctggcgttgtgaagaccatgacaggaggccgagcgcagagcattggcaggaggggcaaggtggaacagttatctccagaagaagaagagaaaaggagaatccgaagggaaaggaataagatggctgcagccaaatgccgcaaccggaggagggagctgactgatacactccaagcggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtgggcttcccttgatcttgactgggggcctgccagaggttgccaccccggagtctgaggaggccttcaccctgcctctcctcaatgaccctgaggcccaagccctcaggggaacctgtcaagagcatcaggagcatggagctgaagaccggagcccttgatgacttcctgttcccatgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgcaatatctgttgtttttttctttttctctaacttacctaggggtgtataatcacaatcacttaggaagttagagaaaaagaaaaatacaacaatgcctgg

SEQ ID NO: 455810 - DNA, 978 bp, Homo sapiens
gcacagtggctccctggggatggggcccatggccacagagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaagcatccatgtgtggactcaagtccttacctcttccggagatgtagcaaaacgcatggagtgtgtattgttcccagtgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagatgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcga

SEQ ID NO: 455811 - DNA, 622 bp, Homo sapiens
tgatacacctccaagttggcactataccaccaacacaaatgggctaagacacagggtcatagggatagcaggcacctgagccaagccagaacttagatctcaactgttaatgcaggatgatttgtattgaaccatgaattttacactgcctctcaatggtggtatcagctataccacccctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcga

SEQ ID NO: 455812 - DNA, 1258 bp, Homo sapiens
  misc_feature (1150)..(1151): n is a, c, g, or t
  misc_feature (1216)..(1216): n is a, c, g, or t
aaagcagtggctgcggcgcctcgtactcgaaccgcatctgcagcgagcaactgagaagccaagactgagccggcggccgcggcgcagcgaacgagcagtgaccgtgctcctacccagctctgcttcacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggacttctgcacggacctggccgtctccagtgccaacttcattcccacggtcactgccatctcgaccagtccggacctgcagtggctggtgcagcccgccctcgtctcctctgtggccccatcgcagaccagagcccctcaccctttcggagtccccgccccctccgctggggcttactccagggctggcgttgtgaagaccatgacaggaggccgagcgcagagcattggcaggaggggcaaggtggaacaggtgaggaactctagcgtactcttcctgggaatgtgggggctgggtgggaagcagccccggagatgcaggagcccagtacagaggatgaagccactgatggggctggctgcacatccgtaactgggagccctggctccaagcccattccatcccaactcagactctgagtctcaccctaagaagtactctcatagtttcttccctaagtttcttaccgcatgctttcagactgggctcttctttgttctcttgctgaggatcttattttaaatgcaagtcacacctagtctgcaactgcaggtcagaaatggtttcacagtggggtgccaggaagcagggaagctgcaggagccagttctactggggtgggtgaatggaggtgatggcagacacttttactgaatgtcggtctttttttgtgattattctagttttatctccagaagaagaagagaaaaggagaatccgaagggaaaggaataagatggctgcagccaaatgccgcaaccggaggagggagctgactgatacactccaagcggtaggtactctgtgggttgctcctttttgttnncttatcctctgatacaggacagccacttgagatggaagctgtttgcgaccggatgcaactgctanggaggaaactgagtatctggagtaccactgctgagatctgaa

SEQ ID NO: 455813 - DNA, 445 bp, Homo sapiens
  misc_feature (46)..(46): n is a, c, g, or t
  misc_feature (48)..(48): n is a, c, g, or t
tgcaggtgcgaactctagaggagtcgccctgagttgcatttagacnancaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcga

SEQ ID NO: 455814 - DNA, 410 bp, Homo sapiens
ctcgtgcgtagttccattaaacgatttttaaaatgtacacttgaaaaaaaaaaaaaaaaaaaaaaaaaacgcgagacaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcga

SEQ ID NO: 455815 - DNA, 826 bp, Homo sapiens
aaagcagtggctgcggcgcctcgtactcgaaccgcatctgcagcgagcaactgagaagccaagactgagccggcggccgcggcgcagcgaacgagcagtgaccgtgctcctacccagctctgcttcacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggtaaggctggcttcccgtcgccgcggggccgggggcttggggtcgcggaggaggagacaccgggcgggacgctccagtagatgagtagggggctcccttgtgcctggagggaggctgccgtggccggagcggtgccggctcgggggctcgggacttgctctgagcgcacgcacgcttgccatagtaagaattggttcccccttcgggaggcaggttcgttctgagcaacctctggtctgcactccaggacggatctctgacattagctggagcagacgtgtcccaagcacaaactcgctaactagagcctggcttctccggggaggtggcagaaagcggcaatcccccctcccccggcagcctggagcacggaggagggatgagggaggagggtgcagcgggcgggtgtgtaaggcagtttcattgataaatatccctgacgtctgcgctgacgcaggcgccgctccggagtctccagaatgaactcgctttttatcaatg

SEQ ID NO: 455816 - DNA, 1032 bp, Homo sapiens
gcacagtggctccctggggatggggcccatggccacagagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaagcatccatgtgtggactcaagtccttacctcttccggagatgtagcaaaacgcatggagtgtgtattgttcccagtgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcga

SEQ ID NO: 455817 - DNA, 1008 bp, Homo sapiens
aaagcagtggctgcggcgcctcgtactcgaaccgcatctgcagcgagcaactgagaagccaagactgagccggcggccgcggcgcagcgaacgagcagtgaccgtgtccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaagcatccatgtgtggactcaagtccttacctcttccggagatgtagcaaaacgcatggagtgtgtattgttcccagtgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcga

SEQ ID NO: 455818 - DNA, 1526 bp, Homo sapiens
aaagcagtggctgcggcgcctcgtactcgaaccgcatctgcagcgagcaactgagaagccaagactgagccggcggccgcggcgcagcgaacgagcagtgaccgtgctcctacccagctctgcttcacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggacttctgcacggacctggccgtctccagtgccaacttcattcccacggtcactgccatctcgaccagtccggacctgcagtggctggtgcagcccgccctcgtctcctctgtggccccatcgcagaccagagcccctcaccctttcggagtccccgccccctccgctggggcttactccagggctggcgttgtgaagaccatgacaggaggccgagcgcagagcattggcaggaggggcaaggtggaacagttatctccagaagaagaagagaaaaggagaatccgaagggaaaggaataagatggctgcagccaaatgccgcaaccggaggagggagctgactgatacactccaagcggagacagaccaactagaagatgagaagtctgctttgcagaccgagattgccaacctgctgaaggagaaggacctgggcttcccagaagagatgtctgtgggcttcccttgatcttgactgggggcctgccagaggttgccaccccggagtctgaggaggccttcaccctgcctctcctcaatgaccctgaggcccaagccctcaggggaacctgtcaagagcatcaggagcatggagctgaagaccggagcccttgatgacttcctgttcccatgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcga

SEQ ID NO: 455819 - DNA, 2881 bp, Homo sapiens
aaagcagtggctgcggcgcctcgtactcgaaccgcatctgcagcgagcaactgagaagccaagactgagccggcggccgcggcgcagcgaacgagcagtgaccgtgctcctacccagctctgcttcacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggtaaggctggcttcccgtcgccgcggggccgggggcttggggtcgcggaggaggagacaccgggcgggacgctccagtagatgagtagggggctcccttgtgcctggagggaggctgccgtggccggagcggtgccggctcgggggctcgggacttgctctgagcgcacgcacgcttgccatagtaagaattggttcccccttcgggaggcaggttcgttctgagcaacctctggtctgcactccaggacggatctctgacattagctggagcagacgtgtcccaagcacaaactcgctaactagagcctggcttctccggggaggtggcagaaagcggcaatcccccctcccccggcagcctggagcacggaggagggatgagggaggagggtgcagcgggcgggtgtgtaaggcagtttcattgataaaaagcgagttcattctggagactccggagcggcgcctgcgtcagcgcagacgtcagggatatttataacaaaccccctttcaagcaagtgatgctgaagggataacgggaacgcagcggcaggatggaagagacaggcactgcgctgcggaatgcctgggaggaaaagggggagacctttcatccaggatgagggacatttaagatgaaatgtccgtggcaggatcgtttctcttcactgctgcatgcggcactgggaactcgccccacctgtgtccggaacctgctcgctcacgtcggctttccccttctgttttgttctaggacttctgcacggacctggccgtctccagtgccaacttcattcccacggtcactgccatctcgaccagtccggacctgcagtggctggtgcagcccgccctcgtctcctctgtggccccatcgcagaccagagcccctcaccctttcggagtccccgccccctccgctggggcttactccagggctggcgttgtgaagaccatgacaggaggccgagcgcagagcattggcaggaggggcaaggtggaacaggtgaggaactctagcgtactcttcctgggaatgtgggggctgggtgggaagcagccccggagatgcaggagcccagtacagaggatgaagccactgatggggctggctgcacatccgtaactgggagccctggctccaagcccattccatcccaactcagactctgagtctcaccctaagaagtactctcatagtttcttccctaagtttcttaccgcatgctttcagactgggctcttctttgttctcttgctgaggatcttattttaaatgcaagtcacacctagtctgcaactgcaggtcagaaatggtttcacagtggggtgccaggaagcagggaagctgcaggagccagttctactggggtgggtgaatggaggtgatggcagacacttttactgaatgtcggtctttttttgtgattattctagttttatctccagaagaagaagagaaaaggagaatccgaagggaaaggaataagatggctgcagccaaatgccgcaaccggaggagggagctgactgatacactccaagcggtaggtactctgtgggttgctcctttttaaaacttaagggaaagttggagattgagcataagggcccttgagtaagactgtgtcttatgctttcctttatccctctgtatacagggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtgggcttcccttgatcttgactgggggcctgccagaggttgccaccccggagtctgaggaggccttcaccctgcctctcctcaatgaccctgaggcccaagccctcaggggaacctgtcaagagcatcaggagcatggagctgaagaccggagcccttgatgacttcctgttcccatgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcga

SEQ ID NO: 455820 - DNA, 1358 bp, Homo sapiens
gcacagtggctccctggggatggggcccatggccacagagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaagcatccatgtgtggactcaagtccttacctcttccggagatgtagcaaaacgcatggagtgtgtattgttcccagtgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcgaaaaaaaaaaaaaaaaaaaaaaaaaaaaaaaaaaaaaaaaaaaaaaaaaaaaaaaaaaaaaaaaaaaaaaaataaaaaaaaaaaaatccaaaaaaaaaaaaaaaaaatataaaatacaccttaaaaaaaaaaaaaaataaaaaaaaaaaattttgggccccttttctcccaaatttttttaaaactcggaaatttttttttccggccccaatattagggcctcttttggccatttcccctttaaggggtgcttttaaaatttaggggcccggttcttaacaacacctggtctgtgacctctgggtcccacaaatatccttcttgctc

SEQ ID NO: 455821 - DNA, 2053 bp, Homo sapiens
aaagcagtggctgcggcgcctcgtactcgaaccgcatctgcagcgagcaactgagaagccaagactgagccggcggccgcggcgcagcgaacgagcagtgaccgtgctcctacccagctctgcttcacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggacttctgcacggacctggccgtctccagtgccaacttcattcccacggtcactgccatctcgaccagtccggacctgcagtggctggtgcagcccgccctcgtctcctctgtggccccatcgcagaccagagcccctcaccctttcggagtccccgccccctccgctggggcttactccagggctggcgttgtgaagaccatgacaggaggccgagcgcagagcattggcaggaggggcaaggtggaacaggtgaggaactctagcgtactcttcctgggaatgtgggggctgggtgggaagcagccccggagatgcaggagcccagtacagaggatgaagccactgatggggctggctgcacatccgtaactgggagccctggctccaagcccattccatcccaactcagactctgagtctcaccctaagaagtactctcatagtttcttccctaagtttcttaccgcatgctttcagactgggctcttctttgttctcttgctgaggatcttattttaaatgcaagtcacacctagtctgcaactgcaggtcagaaatggtttcacagtggggtgccaggaagcagggaagctgcaggagccagttctactggggtgggtgaatggaggtgatggcagacacttttactgaatgtcggtctttttttgtgattattctagttcggaggagggagctgactgatacactccaagcggtaggtactctgtgggttgctcctttttaaaacttaagggaaagttggagattgagcataagggcccttgagtaagactgtgtcttatgctttcctttatccctctgtatacagggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtgggcttcccttgatcttgactgggggcctgccagaggttgccaccccggagtctgaggaggccttcaccctgcctctcctcaatgaccctgaggcccaagccctcaggggaacctgtcaagagcatcaggagcatggagctgaagaccggagcccttgatgacttcctgttcccatgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcga

SEQ ID NO: 455822 - DNA, 1110 bp, Homo sapiens
  misc_feature (1038)..(1038): n is a, c, g, or t
  misc_feature (1098)..(1098): n is a, c, g, or t
gcacagtggctccctggggatggggcccatggccacagagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaagcatccatgtgtggactcaagtccttacctcttccggagatgtagcaaaacgcatggagtgtgtattgttcccagtgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcgaaaaaanaaaagactatttaaaatctgcggccgatattcgagctcactgggccattcccgctatagngaggcgtttacc

SEQ ID NO: 455823 - DNA, 1076 bp, Homo sapiens
  misc_feature (7)..(7): n is a, c, g, or t
gggctgnctagaggatcccaaacgacccgaagactacttctccagcattggcaggaggggcaaggtggaacagttatctccagaagaagaagagaaaaggagaatccgaagggaaaggaataagatggctgcagccaaatgccgcaaccggaggagggagctgactgatacactccaagcggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtgggcttcccttgatcttgactgggggcctgccagaggttgccaccccggagtctgaggaggccttcaccctgcctctcctcaatgaccctgaggcccaagccctcaggggaacctgtcaagagcatcaggagcatggagctgaagaccggagcccttgatgacttcctgttcccatgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcga

SEQ ID NO: 455824 - DNA, 1054 bp, Homo sapiens
tctagaggatcccggctgagcaagttggcaggaggggcagggttggaacagttatctccagaagaagaagagaaaaggagaatccgaagggaaaggaataagatggctgcagccaaatgccgcaaccggaggagggagctgactgatacactccaagcggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtgggcttcccttgatcttgactgggggcctgccagaggttgccaccccggagtctgaggaggccttcaccctgcctctcctcaatgaccctgaggcccaagccctcaggggaacctgtcaagagcatcaggagcatggagctgaagaccggagcccttgatgacttcctgttcccatgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcga

SEQ ID NO: 455825 - DNA, 2039 bp, Homo sapiens
aaagcagtggctgcggcgcctcgtactcgaaccgcatctgcagcgagcaactgagaagccaagactgagccggcggccgcggcgcagcgaacgagcagtgaccgtgctcctacccagctctgcttcacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggtaaggctggcttcccgtcgccgcggggccgggggcttggggtcgcggaggaggagacaccgggcgggacgctccagtagatgagtagggggctcccttgtgcctggagggaggctgccgtggccggagcggtgccggctcgggggctcgggacttgctctgagcgcacgcacgcttgccatagtaagaattggttcccccttcgggaggcaggttcgttctgagcaacctctggtctgcactccaggacggatctctgacattagctggagcagacgtgtcccaagcacaaactcgctaactagagcctggcttctccggggaggtggcagaaagcggcaatcccccctcccccggcagcctggagcacggaggagggatgagggaggagggtgcagcgggcgggtgtgtaaggcagtttcattgataaaaagcgagttcattctggagactccggagcggcgcctgcgtcagcgcagacgtcagggatatttataacaaaccccctttcaagcaagtgatgctgaagggataacgggaacgcagcggcaggatggaagagacaggcactgcgctgcggaatgcctgggaggaaaagggggagacctttcatccaggatgagggacatttaagatgaaatgtccgtggcaggatcgtttctcttcactgctgcatgcggcactgggaactcgccccacctgtgtccggaacctgctcgctcacgtcggctttccccttctgttttgttctaggacttctgcacggacctggccgtctccagtgccaacttcattcccacggtcactgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaagcatccatgtgtggactcaagtccttacctcttccggagatgtagcatagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcga

SEQ ID NO: 455826 - DNA, 988 bp, Homo sapiens
gcacagtggctccctggggatggggcccatggccacagagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaagcatccatgtgtggactcaagtccttacctcttccggagatgtagcaaaacgcatggagtgtgtattgttcccagtgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgtcagatatttatatttttattttatttttttctaccttgaggtcttttgacatgtggaaagtgaatttgaatgaaaaatttaagcattgtttgcttattgttccaagacattgtcaataaaagcatttaagttgaatgcga

SEQ ID NO: 455827 - DNA, 750 bp, Homo sapiens
aaagcagtggctgcggcgcctcgtactcgaaccgcatctgcagcgagcaactgagaagccaagactgagccggcggccgcggcgcagcgaacgagcagtgaccgtgctcctacccagctctgcttcacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggacttctgcacggacctggccgtctccagtgccaacttcattcccacggtcactgccatctcgaccagtccggacctgcagtggctggtgcagcccgccctcgtctcctctgtggccccatcgcagaccagagcccctcaccctttcggagtccccgccccctccgctggggcttactccagggctggcgttgtgaagaccatgacaggaggccgagcgcagagcattggcaggaggggcaaggtggaacagttatctccagaagaagaagagaaaaggagaatccgaagggaaaggaataagatggctgcagccaaatgccgcaaccggaggagggagctgactgatacactccaagcgagaaaggcatggaacagatgctccttccagcctccagaaggagccaacgctgcgccctcgggtcc

SEQ ID NO: 455828 - DNA, 894 bp, Homo sapiens
aaagcagtggctgcggcgcctcgtactcgaaccgcatctgcagcgagcaactgagaagccaagactgagccggcggccgcggcgcagcgaacgagcagtgaccgtgctcctacccagctctgcttcacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggacttctgcacggacctggccgtctccagtgccaacttcattcccacggtcactgccatctcgaccagtccggacctgcagtggctggtgcagcccgccctcgtctcctctgtggccccatcgcagaccagagcccctcaccctttcggagtccccgccccctccgctggggcttactccagggctggcgttgtgaagaccatgacaggaggccgagcgcagagcattggcaggaggggcaaggtggaacaggtgaggaactctagcgtactcttcctgggaatgtgggggctgggtgggaagcagccccggagatgcaggagcccagtacagaggatgaagccactgatggggctggctgcacatccgtaactgggagccctggctccaagcccattccatcccaactcagactctgagtctcaccctaagaagtactctcatagtttcttccctaagtttcttaccgcatgctttcagactgggctcttctttgttctcttgctgaggatcttatatcaacgcatgacacaccacgcggtaccggctcgattctatctgtctgcttt

SEQ ID NO: 455829 - DNA, 2792 bp, Homo sapiens
ggatccgtcgacggccattaccaatcgcgaaaccgctcgcgcgcgtgcatcccgcaccatcccccggccccgggccctggccggcgtcagaccgagctgccgccgccaccaccgcagcagcagcagtcggggagccaggcccagccagggccgcgggaggcgggggcgcccgggccctggatgtcccgcagcgcggcggccagcggcggaccccggaggcctgagcggcacctgcccccagccccctgtggggccccggggcccccagaaacctgcaggacggagccagacggggcgggcaccatgaacaagttacggcagagcctgcggcggaggaagccagcctacgtgcccgaggcgtcgcgcccgcaccagtggcaggcagacgaggacgcggtgcggaagggcacgtgcagcttcccggtcaggtacctgggtcacgtggaggtagaggagtcccggggaatgcacgtgtgtgaagatgcggtgaagaagctgaaggcgatgggccgaaagtccgtgaagtctgtcctgtgggtgtcagccgatgggctccgagtggtggacgacaaaaccaaggatcttctggtcgaccagaccatcgaaaaggtctccttttgtgctcctgaccgcaacctggacaaggctttctcctatatctgtcgtgacgggactacccgccgctggatctgccactgttttctggcactgaaggactccggcgagaggctgagccacgctgtgggctgtgcttttgccgcctgcctggagcgaaaacagcgacgggagaaggaatgtggggtcacggccgccttcgatgccagccgcaccagcttcgcccgcgagggctccttccgcctgtctgggggtgggcggcctgctgagcgagaggccccggacaagaagaaagcagaggcagcagctgcccccactgtggctcctggccctgcccagcctgggcacgtgtccccgacaccagccaccacatcccctggtgagaagggtgaggcaggcacccctgtggctgcaggcaccactgcggccgccatcccccggcgccatgcacccctggagcagctggttcgccagggctccttccgtgggttcccagcactcagccagaagaactcgcctttcaaacggcagctgagcctacggctgaatgagctgccatccacgctgcagcgccgcactgacttccaggtgaagggcacagtgcctgagatggagcctcctggtgccggcgacagtgacagcatcaacgctctgtgcacacagatcagttcatcttttgccagtgctggagcgccagcaccagggccaccacctgccacaacagggacttctgcctggggtgagccctccgtgccccctgcagctgccttccagcctgggcacaagcggacaccttcagaggctgagcgatggctggaggaggtgtcacaggtggccaaggcccagcagcagcagcagcagcaacagcaacagcagcagcagcagcagcagcaacagcagcaagcagcctcagtggccccagtgcccaccatgcctcctgccctgcagcctttccccgcccccgtggggccctttgacgctgcacctgcccaagtggccgtgttcctgccacccccacacatgcagcccccttttgtgcccgcctacccgggcttgggctacccaccgatgccccgggtgcccgtggtgggcatcacaccctcacagatggtggcaaacgccttctgctcagccgcccagctccagcctcagcctgccactctgcttgggaaagctggggccttcccgccccctgccatacccagtgcccctgggagccaggcccgccctcgccccaatggggccccctggccccctgagccagcgcctgccccagctccagagttggacccctttgaggcccagtgggcggcattagaaggcaaagccactgtagagaaaccctccaaccccttttctggcgacctgcaaaagacattcgagattgaactgtagcccgagccgccccacccactccatcatctccaggtgccccacgcctgggggtggaggcacaacctctcccctaaccctgctccctggggctgcgcccctcaacaccctctcaacacccccctccctcaaccaccccgacaaccactacagaaccaacattgtgacgcccaggttgcaacaggatggaattcagggacggacccagcctggctaagggaaccatttcactgccggacttaggctggcaatgcccccttccccaaccccagacacaggggttggccacaatcccactgaatgcccttggttcacactccatttcccagtttctgttgacccccaccttccagtgttggacaggatggaggggggacacttgcttaggggctctcctgggccccacaccagtgcccaccccaaatctggtcgtctcctccccccatgcacagcacaagctaagggctgccctctgcccacacgctgcgttcactgccaatgctgtactcacctccatcaccctccaactttggggcccatgtcttccttgggccaaggtctcatgggggctagggccaagttgggggcccaggaggcggggagggaggaggaggagaagatgcgcagttacctcatgtcggtgcccgctggggaggggtccgggaagaaggggaaggggtgcctggcgggtacttttctatcttttatttccagattttttttgtatctaaacttgaagatttgtattatacaaggacagccaataaaggaagaatataatggtg

SEQ ID NO: 455830 - DNA, 407 bp, Homo sapiens
tccccccaatttccaccgcggccaattcatggacaggaactaccccagcgccggcttcggggacccgctcggcgccggggcgggatggagttacgagaggtcagcgaaagctagcttggtttatggcagctccaggacctcgcaccccgagacggacatcttacaccgccaggcctatgcggccccccacccactgcaaagctatgccaccaaccaccacccggcaggcctctctggactcttcgacactggcctccaccacgcgggctcagcagggcccgacgcctccgtcatgaaccttatctcggccctggaatcccggggcccccagcctggcccctccgcctcctctctcctctcccagttccgcagtccttcctggcaaacaggcatgcacacgccaggcc

SEQ ID NO: 455831 - DNA, 2923 bp, Homo sapiens
  misc_feature (2795)..(2795): n is a, c, g, or t
aacggaatcctcccgggagccgaggaggctcgcgcgcgtgcatcccgcaccatcccccggccccgggccctggccggcgtcagaccgagctgccgccgccaccaccgcagcagcagcagtcggggagccaggcccagccagggccgcgggaggcgggggcgcccgggccctggatgtcccgcagcgcggcggccagcggcggaccccggaggcctgagcggcacctgcccccagccccctgtggggccccggggcccccagaaacctgcaggacggagccagacggggcgggcaccatgaacaagttacggcagagcctgcggcggaggaagccagcctacgtgcccgaggcgtcgcgcccgcaccagtggcaggcagacgaggacgcggtgcggaagggcacgtgcagcttcccggtcaggtacctgggtcacgtggaggtagaggagtcccggggaatgcacgtgtgtgaagatgcggtgaagaagctgaaggcgatgggccgaaagtccgtgaagtctgtcctgtgggtgtcagccgatgggctccgagtggtggacgacaaaaccaaggatcttctggtcgaccagaccatcgaaaaggtctccttttgtgctcctgaccgcaacctggacaaggctttctcctatatctgtcgtgacgggactacccgccgctggatctgccactgttttctggcactgaaggactccggcgagaggctgagccacgctgtgggctgtgcttttgccgcctgcctggagcgaaaacagcgacgggagaaggaatgtggggtcacggccgccttcgatgccagccgcaccagcttcgcccgcgagggctccttccgcctgtctgggggtgggcggcctgctgagcgagaggccccggacaagaagaaagcagaggcagcagctgcccccactgtggctcctggccctgcccagcctgggcacgtgtccccgacaccagccaccacatcccctggtgagaagggtgaggcaggcacccctgtggctgcaggcaccactgcggccgccatcccccggcgccatgcacccctggagcagctggttcgccagggctccttccgtgggttcccagcactcagccagaagaactcgcctttcaaacggcagctgagcctacggctgaatgagctgccatccacgctgcagcgccgcactgacttccaggtgaagggcacagtgcctgagatggagcctcctggtgccggcgacagtgacagcatcaacgctctgtgcacacagatcagttcatcttttgccagtgctggagcgccagcaccagggccaccacctgccacaacagggacttctgcctggggtgagccctccgtgccccctgcagctgccttccagcctgggcacaagcggacaccttcagaggctgagcgatggctggaggaggtgtcacaggtggccaaggcccagcagcagcagcagcagcaacagcaacagcagcagcagcagcagcagcaacagcagcaagcagcctcagtggccccagtgcccaccatgcctcctgccctgcagcctttccccgcccccgtggggccctttgacgctgcacctgcccaagtggccgtgttcctgccacccccacacatgcagcccccttttgtgcccgcctacccgggcttgggctacccaccgatgccccgggtgcccgtggtgggcatcacaccctcacagatggtggcaaacgccttctgctcagccgcccagctccagcctcagcctgccactctgcttgggaaagctggggccttcccgccccctgccatacccagtgcccctgggagccaggcccgccctcgccccaatggggccccctggccccctgagccagcgcctgccccagctccagagttggacccctttgaggcccagtgggcggcattagaaggcaaagccactgtagagaaaccctccaaccccttttctggcgacctgcaaaagacattcgagattgaactgtagcccgagccgccccacccactccatcatctccaggtgccccacgcctgggggtggaggcacaacctctcccctaaccctgctccctggggctgcgcccctcaacaccctctcaacacccccctccctcaaccaccccgacaaccactacagaaccaacattgtgacgcccaggttgcaacaggatggaattcagggacggacccagcctggctaagggaaccatttcactgccggacttaggctggcaatgcccccttccccaaccccagacacaggggttggccacaatcccactgaatgcccttggttcacactccatttcccagtttctgttgacccccaccttccagtgttggacaggatggaggggggacacttgcttaggggctctcctgggccccacaccagtgcccaccccaaatctggtcgtctcctccccccatgcacagcacaagctaagggctgccctctgcccacacgctgcgttcactgccaatgctgtactcacctccatcaccctccaactttggggcccatgtcttccttgggccaaggtctcatgggggctagggccaagttgggggcccaggaggcggggagggaggaggaggagaagatgcgcagttacctcatgtcggtgcccgctggggaggggtccgggaagaaggggaaggggtgcctggcgggtacttttctatcttttatttccagattttttttgtatctaaacttgaagatttgtattatacaaggacagccaataaaggaagaatataatggtgaaacaaacanaaaaggacaaaaaaaagaaacccgggggtttttgcgggggggaaaaaaggttaaaagggcacggtgcatgcttttccgcacccttttttaaaaggggaatgcggtcccaaagggggtaaatgaacgga

SEQ ID NO: 455832 - DNA, 3568 bp, Homo sapiens
aacggaatcctcccgggagccgaggaggctcgcgcgcgtgcatcccgcaccatcccccggccccgggccctggccggcgtcagaccgagctgccgccgccaccaccgcagcagcagcagtcggggagccaggcccagccagggccgcgggaggcgggggcgcccgggccctggatgtcccgcagcgcggcggccagcggcggaccccggaggcctgagcggcacctgcccccagccccctgtggggccccggggcccccagaaacctgcaggacggagccagacggggcgggcaccatgaacaagttacggcagagcctgcggcggaggaagccagcctacgtgcccgaggcgtcgcgcccgcaccagtggcaggcagacgaggacgcggtgcggaagggcacgtgcagcttcccggtcaggtacctgggtcacgtggaggtagaggagtcccggggaatgcacgtgtgtgaagatgcggtgaagaagctgaaggcgatgggccgaaagtccgtgaagtctgtcctgtgggtgtcagccgatgggctccgagtggtggacgacaaaaccaaggatcttctggtcgaccagaccatcgaaaaggtctccttttgtgctcctgaccgcaacctggacaaggctttctcctatatctgtcgtgacgggactacccgccgctggatctgccactgttttctggcactgaaggactccggcgagaggctgagccacgctgtgggctgtgcttttgccgcctgcctggagcgaaaacagcgacgggagaaggaatgtggggtcacggccgccttcgatgccagccgcaccagcttcgcccgcgagggctccttccgcctgtctgggggtgggcggcctgctgagcgagaggccccggacaagaagaaagcagaggcagcagctgcccccactgtggctcctggccctgcccagcctgggcacgtgtccccgacaccagccaccacatcccctggtgagaagggtgaggcaggcacccctgtggctgcaggcaccactgcggccgccatcccccggcgccatgcacccctggagcagctggttcgccagggctccttccgtgggttcccagcactcagccagaagaactcgcctttcaaacggcagctgagcctacggctgaatgagctgccatccacgctgcagcgccgcactgacttccaggtgaagggcacagtgcctgagatggagcctcctggtgccggcgacagtgacagcatcaacgctctgtgcacacagatcagttcatcttttgccagtgctggagcgccagcaccagggccaccacctgccacaacagggacttctgcctggggtgagccctccgtgccccctgcagctgccttccagcctgggcacaagcggacaccttcagaggctgagcgatggctggaggaggtgtcacaggtggccaaggcccagcagcagcagcagcagcaacagcaacagcagcagcagcagcagcagcaacagcagcaagcagcctcagtggccccagtgcccaccatgcctcctgccctgcagcctttccccgcccccgtggggccctttgacgctgcacctgcccaagtggccgtgttcctgccacccccacacatgcagcccccttttgtgcccgcctacccgggcttgggctacccaccgatgccccgggtgcccgtggtgggcatcacaccctcacagatggtggcaaacgccttctgctcagccgcccagctccagcctcagcctgccactctgcttgggaaagctggggccttcccgccccctgccatacccagtgcccctgggagccaggcccgccctcgccccaatggggccccctggccccctgagccagcgcctgccccagctccagagttggacccctttgaggcccagtgggcggcattagaaggcaaagccactgtagagaaaccctccaaccccttttctggcgacctgcaaaagacattcgagattgaactgtagcccgagccgccccacccactccatcatctccaggtgccccacgcctgggggtggaggcacaacctctcccctaaccctgctccctggggctgcgcccctcaacaccctctcaacacccccctccctcaaccaccccgacaaccactacagaaccaacattgtgacgcccaggttgcaacaggatggaattcagggacggacccagcctggctaagggaaccatttcactgccggacttaggctggcaatgcccccttccccaaccccagacacaggggttggccacaatcccactgaatgcccttggttcacactccatttcccagtttctgttgacccccaccttccagtgttggacaggatggaggggggacacttgcttaggggctctcctgggccccacaccagtgcccaccccaaatctggtcgtctcctccccccatgcacagcacaagctaagggctgccctctgcccacacgctgcgttcactgccaatgctgtactcacctccatcaccctccaactttggggcccatgtcttccttgggccaaggtctcatgggggctagggccaagttgggggcccaggaggcggggagggaggaggaggagaagatgcgcagttacctcatgtcggtgcccgctggggaggggtccgggaagaaggggaaggggtgcctggcgggtacttttctatcttttatttccagattttttttgtatctaaacttgaagatttgtattatacaaggacagccaataaaggaagaatataatggtgcccctcgggaaacgagggtgtgtgtagggcgctggtgaggccctagaacctttcctcctgagtcatggactgaaacagagtcagaaggatgtccctgagtgataacctctgagtcatagcgtggtaacaggtaccactgactcagcacctgccaggcgggtattaaaggagccaaaattaatcaccccatttctattccttacagagttagaatcaaggaataaaaaacaaatattatgaactgctggctgggcacagtggctcacgcctgtaatcccagcactttgggaggtcgaggcaggcagatcacttaaggtcaggagttcgagaccagcctggccgccatggagaaacccagtctctaccaaaaattcaaaaattagccgggcgtggtggcaggcgcctgtaattccaggaggctgaggcacaagaatcgcttgaacccgggcagcagaggttgcagtgacctgaggtcacaccattgcactcctgcctgggcaacagaatgagactctgtctcaaaaaaaaaaaaacaaaaaaaaaaaaactacttctaattagctcaatattaatattttaacaagttgggttggtaacagtatatctttgcccatgctggcaaattcttgttttgtcagcattttccataactctggccaaagtgtcacctgatgtggcaacgttttacagtcttgctattgtttcttgagtcctttaatctataagatgtatttttaaaaatatataacatataaattttgtttcgttatagctctttaaaat

SEQ ID NO: 455833 - DNA, 2579 bp, Homo sapiens
aacggaatcctcccgggagccgaggaggctcgcgcgcgtgcatcccgcaccatcccccggccccgggccctggccggcgtcagaccgagctgccgccgccaccaccgcagcagcagcagtcggggagccaggcccagccagggccgcgggaggcgggggcgcccgggccctggatgtcccgcagcgcggcggccagcggcggaccccggaggcctgagcggcacctgcccccagccccctgtggggccccggggcccccagaaacctgcaggacggagccagacggggcgggcaccatgaacaagttacggcagagcctgcggcggaggaagccagcctacgtgcccgaggcgtcgcgcccgcaccagtggcaggcagacgaggacgcggtgcggaagggcacgtgcagcttcccggtcaggtacctgggtcacgtggaggtagaggagtcccggggaatgcacgtgtgtgaagatgcggtgaagaagctgaaggcgatgggccgaaagtccgtgaagtctgtcctgtgggtgtcagccgatgggctccgagtggtggacgacaaaaccaaggatcttctggtcgaccagaccatcgaaaaggtctccttttgtgctcctgaccgcaacctggacaaggctttctcctatatctgtcgtgacgggactacccgccgctggatctgccactgttttctggcactgaaggactccggcgagaggctgagccacgctgtgggctgtgcttttgccgcctgcctggagcgaaaacagcgacgggagaaggaatgtggggtcacggccgccttcgatgccagccgcaccagcttcgcccgcgagggctccttccgcctgtctgggggtgggcggcctgctgagcgagaggccccggacaagaagaaagcagaggcagcagctgcccccactgtggctcctggccctgcccagcctgggcacgtgtccccgacaccagccaccacatcccctggtgagaagggtgaggcaggcacccctgtggctgcaggcaccactgcggccgccatcccccggcgccatgcacccctggagcagctggttcgccagggctccttccgtgggttcccagcactcagccagaagaactcgcctttcaaacggcagctgagcctacggctgaatgagctgccatccacgctgcagcgccgcactgacttccaggtgaagggcacagtgcctgagatggagcctcctggtgccggcgacagtgacagcatcaacgctctgtgcacacagatcagttcatcttttgccagtgctggagcgccagcaccagggccaccacctgccacaacagggacttctgcctggggtgagccctccgtgccccctgcagctgccttccagcctgggcacaagcggacaccttcagaggctgagcgatggctggaggaggtgtcacaggtggccaaggcccagcagcagcagcagcagcaacagcaacagcagcagcagcagcagcagcaacagcagcaagcagcctcagtggccccagtgcccaccatgcctcctgccctgcagcctttccccgcccccgtggggccctttgacgctgcacctgcccaagtggccgtgttcctgccacccccacacatgcagcccccttttgtgcccgcctacccgggcttgggctacccaccgatgccccgggtgcccgtggtgggcatcacaccctcacagatggtggcaaacgccttctgctcagccgcccagctccagcctcagcctgccactctgcttgggaaagctggggccttcccgccccctgccatacccagtgcccctgggagccaggcccgccctcgccccaatggggccccctggccccctgagccagcgcctgccccagctccagagttggacccctttgaggcccagtgggcggcattagaaggcaaagccactgtagagaaaccctccaaccccttttctggcgacctgcaaaagacattcgagattgaactgtagcccgagccgccccacccactccatcatctccaggtgccccacgcctgggggtggaggcacaacctctcccctaaccctgctccctggggctgcgcccctcaacaccctctcaacacccccctccctcaaccaccccgacaaccactacagaaccaacattgtgacgcccaggttgcaacaggatggaattcagggacggacccagcctggctaagggaaccatttcactgccggacttaggctggcaatgcccccttccccaaccccagacacaggggttggccacaatcccactgaatgcccttggttcacactccatttcccagtttctgttgacccccaccttccagtgttggacaggatggaggggggacacttgcttaggggcggggagggaggaggaggagaagatgcgcagttacctcatgtcggtgcccgctggggaggggtccgggaagaaggggaaggggtgcctggcgggtacttttctatcttttatttccagattttttttgtatctaaacttgaagatttgtattatacaaggacagccaataaaggaagaatataatggtg

SEQ ID NO: 455834 - DNA, 2009 bp, Homo sapiens
  misc_feature (2002)..(2003): n is a, c, g, or t
  misc_feature (2006)..(2006): n is a, c, g, or t
aacggaatcctcccgggagccgaggaggctcgcgcgcgtgcatcccgcaccatcccccggccccgggccctggccggcgtcagaccgagctgccgccgccaccaccgcagcagcagcagtcggggagccaggcccagccagggccgcgggaggcgggggcgcccgggccctggatgtcccgcagcgcggcggccagcggcggaccccggaggcctgagcggcacctgcccccagccccctgtggggccccggggcccccagaaacctgcaggacggagccagacggggcgggcaccatgaacaagttacggcagagcctgcggcggaggaagccagcctacgtgcccgaggcgtcgcgcccgcaccagtggcaggcagacgaggacgcggtgcggaagggcacgtgcagcttcccggtcaggtacctgggtcacgtggaggtagaggagtcccggggaatgcacgtgtgtgaagatgcggtgaagaagctgaaggcgatgggccgaaagtccgtgaagtctgtcctgtgggtgtcagccgatgggctccgagtggtggacgacaaaaccaaggatcttctggtcgaccagaccatcgaaaaggtctccttttgtgctcctgaccgcaacctggacaaggctttctcctatatctgtcgtgacgggactacccgccgctggatctgccactgttttctggcactgaaggactccggcgagaggctgagccacgctgtgggctgtgcttttgccgcctgcctggagcgaaaacagcgacgggagaaggaatgtggggtcacggccgccttcgatgccagccgcaccagcttcgcccgcgagggctccttccgcctgtctgggggtgggcggcctgctgagcgagaggccccggacaagaagaaagcagaggcagcagctgcccccactgtggctcctggccctgcccagcctgggcacgtgtccccgacaccagccaccacatcccctggtgagaagggtgaggcaggcacccctgtggctgcaggcaccactgcggccgccatcccccggcgccatgcacccctggagcagctggttcgccagggctccttccgtgggttcccagcactcagccagaagaactcgcctttcaaacggcagctgagcctacggctgaatgagctgccatccacgctgcagcgccgcactgacttccaggtgaagggcacagtgcctgagatggagcctcctggtgccggcgacagtgacagcatcaacgctctgtgcacacagatcagttcatcttttgccagtgctggagcgccagcaccagggccaccacctgccacaacagggacttctgcctggggtgagccctccgtgccccctgcagctgccttccagcctgggcacaagcggacaccttcagaggctgagcgatggctggaggaggtgtcacaggtggccaaggcccagcagcagcagcagcagcaacagcaacagcagcagcagcagcagcagcaacagcagcaagcagcctcagtggccccagtgcccaccatgcctcctgccctgcagcctttccccgcccccgtggggccctttgacgctgcacctgcccaagtggccgtgttcctgccacccccacacatgcagcccccttttgtgcccgcctacccgggcttgggctacccaccgatgccccgggtgcccgtggtgggcatcacaccctcacagatggtggcaaacgccttctgctcagccgcccagctccagcctcagcctgccactctgcttgggaaagctggggccttcccgccccctgccatacccagtgcccctgggagccaggcccgccctcgccccaatggggccccctggccccctgagccagcgcctgccccagctccagagttggacccctttgaggcccagtgggcggcattagaaggcaaagccactgtagagaaagccgctttccccctttccctccccttcaagcaccgcttgagatttggactttnntantag

SEQ ID NO: 455835 - DNA, 2702 bp, Homo sapiens
tccccccaatttccaccgcggccaattcatggacaggaactaccccagcgccggcttcggggacccgctcggcgccggggcgggatggagttacgagaggtcagcgaaagctagggcggaccccggaggcctgagcggcacctgcccccagccccctgtggggccccggggcccccagaaacctgcaggacggagccagacggggcgggcaccatgaacaagttacggcagagcctgcggcggaggaagccagcctacgtgcccgaggcgtcgcgcccgcaccagtggcaggcagacgaggacgcggtgcggaagggcacgtgcagcttcccggtcaggtacctgggtcacgtggaggtagaggagtcccggggaatgcacgtgtgtgaagatgcggtgaagaagctgaaggcgatgggccgaaagtccgtgaagtctgtcctgtgggtgtcagccgatgggctccgagtggtggacgacaaaaccaaggatcttctggtcgaccagaccatcgaaaaggtctccttttgtgctcctgaccgcaacctggacaaggctttctcctatatctgtcgtgacgggactacccgccgctggatctgccactgttttctggcactgaaggactccggcgagaggctgagccacgctgtgggctgtgcttttgccgcctgcctggagcgaaaacagcgacgggagaaggaatgtggggtcacggccgccttcgatgccagccgcaccagcttcgcccgcgagggctccttccgcctgtctgggggtgggcggcctgctgagcgagaggccccggacaagaagaaagcagaggcagcagctgcccccactgtggctcctggccctgcccagcctgggcacgtgtccccgacaccagccaccacatcccctggtgagaagggtgaggcaggcacccctgtggctgcaggcaccactgcggccgccatcccccggcgccatgcacccctggagcagctggttcgccagggctccttccgtgggttcccagcactcagccagaagaactcgcctttcaaacggcagctgagcctacggctgaatgagctgccatccacgctgcagcgccgcactgacttccaggtgaagggcacagtgcctgagatggagcctcctggtgccggcgacagtgacagcatcaacgctctgtgcacacagatcagttcatcttttgccagtgctggagcgccagcaccagggccaccacctgccacaacagggacttctgcctggggtgagccctccgtgccccctgcagctgccttccagcctgggcacaagcggacaccttcagaggctgagcgatggctggaggaggtgtcacaggtggccaaggcccagcagcagcagcagcagcaacagcaacagcagcagcagcagcagcagcaacagcagcaagcagcctcagtggccccagtgcccaccatgcctcctgccctgcagcctttccccgcccccgtggggccctttgacgctgcacctgcccaagtggccgtgttcctgccacccccacacatgcagcccccttttgtgcccgcctacccgggcttgggctacccaccgatgccccgggtgcccgtggtgggcatcacaccctcacagatggtggcaaacgccttctgctcagccgcccagctccagcctcagcctgccactctgcttgggaaagctggggccttcccgccccctgccatacccagtgcccctgggagccaggcccgccctcgccccaatggggccccctggccccctgagccagcgcctgccccagctccagagttggacccctttgaggcccagtgggcggcattagaaggcaaagccactgtagagaaaccctccaaccccttttctggcgacctgcaaaagacattcgagattgaactgtagcccgagccgccccacccactccatcatctccaggtgccccacgcctgggggtggaggcacaacctctcccctaaccctgctccctggggctgcgcccctcaacaccctctcaacacccccctccctcaaccaccccgacaaccactacagaaccaacattgtgacgcccaggttgcaacaggatggaattcagggacggacccagcctggctaagggaaccatttcactgccggacttaggctggcaatgcccccttccccaaccccagacacaggggttggccacaatcccactgaatgcccttggttcacactccatttcccagtttctgttgacccccaccttccagtgttggacaggatggaggggggacacttgcttaggggctctcctgggccccacaccagtgcccaccccaaatctggtcgtctcctccccccatgcacagcacaagctaagggctgccctctgcccacacgctgcgttcactgccaatgctgtactcacctccatcaccctccaactttggggcccatgtcttccttgggccaaggtctcatgggggctagggccaagttgggggcccaggaggcggggagggaggaggaggagaagatgcgcagttacctcatgtcggtgcccgctggggaggggtccgggaagaaggggaaggggtgcctggcgggtacttttctatcttttatttccagattttttttgtatctaaacttgaagatttgtattatacaaggacagccaataaaggaagaatataatggtg

SEQ ID NO: 455836 - DNA, 2785 bp, Homo sapiens
aacggaatcctcccgggagccgaggaggctcgcgcgcgtgcatcccgcaccatcccccggccccgggccctggccggcgtcagaccgagctgccgccgccaccaccgcagcagcagcagtcggggagccaggcccagccagggccgcgggaggcgggggcgcccgggccctggatgtcccgcagcgcggcggccagcggcggaccccggaggcctgagcggcacctgcccccagccccctgtggggccccggggcccccagaaacctgcaggacggagccagacggggcgggcaccatgaacaagttacggcagagcctgcggcggaggaagccagcctacgtgcccgaggcgtcgcgcccgcaccagtggcaggcagacgaggacgcggtgcggaagggcacgtgcagcttcccggtcaggtacctgggtcacgtggaggtagaggagtcccggggaatgcacgtgtgtgaagatgcggtgaagaagctgaaggcgatgggccgaaagtccgtgaagtctgtcctgtgggtgtcagccgatgggctccgagtggtggacgacaaaaccaaggatcttctggtcgaccagaccatcgaaaaggtctccttttgtgctcctgaccgcaacctggacaaggctttctcctatatctgtcgtgacgggactacccgccgctggatctgccactgttttctggcactgaaggactccggcgagaggctgagccacgctgtgggctgtgcttttgccgcctgcctggagcgaaaacagcgacgggagaaggaatgtggggtcacggccgccttcgatgccagccgcaccagcttcgcccgcgagggctccttccgcctgtctgggggtgggcggcctgctgagcgagaggccccggacaagaagaaagcagaggcagcagctgcccccactgtggctcctggccctgcccagcctgggcacgtgtccccgacaccagccaccacatcccctggtgagaagggtgaggcaggcacccctgtggctgcaggcaccactgcggccgccatcccccggcgccatgcacccctggagcagctggttcgccagggctccttccgtgggttcccagcactcagccagaagaactcgcctttcaaacggcagctgagcctacggctgaatgagctgccatccacgctgcagcgccgcactgacttccaggtgaagggcacagtgcctgagatggagcctcctggtgccggcgacagtgacagcatcaacgctctgtgcacacagatcagttcatcttttgccagtgctggagcgccagcaccagggccaccacctgccacaacagggacttctgcctggggtgagccctccgtgccccctgcagctgccttccagcctgggcacaagcggacaccttcagaggctgagcgatggctggaggaggtgtcacaggtggccaaggcccagcagcagcagcagcagcaacagcaacagcagcagcagcagcagcagcaacagcagcaagcagcctcagtggccccagtgcccaccatgcctcctgccctgcagcctttccccgcccccgtggggccctttgacgctgcacctgcccaagtggccgtgttcctgccacccccacacatgcagcccccttttgtgcccgcctacccgggcttgggctacccaccgatgccccgggtgcccgtggtgggcatcacaccctcacagatggtggcaaacgccttctgctcagccgcccagctccagcctcagcctgccactctgcttgggaaagctggggccttcccgccccctgccatacccagtgcccctgggagccaggcccgccctcgccccaatggggccccctggccccctgagccagcgcctgccccagctccagagttggacccctttgaggcccagtgggcggcattagaaggcaaagccactgtagagaaaccctccaaccccttttctggcgacctgcaaaagacattcgagattgaactgtagcccgagccgccccacccactccatcatctccaggtgccccacgcctgggggtggaggcacaacctctcccctaaccctgctccctggggctgcgcccctcaacaccctctcaacacccccctccctcaaccaccccgacaaccactacagaaccaacattgtgacgcccaggttgcaacaggatggaattcagggacggacccagcctggctaagggaaccatttcactgccggacttaggctggcaatgcccccttccccaaccccagacacaggggttggccacaatcccactgaatgcccttggttcacactccatttcccagtttctgttgacccccaccttccagtgttggacaggatggaggggggacacttgcttaggggctctcctgggccccacaccagtgcccaccccaaatctggtcgtctcctccccccatgcacagcacaagctaagggctgccctctgcccacacgctgcgttcactgccaatgctgtactcacctccatcaccctccaactttggggcccatgtcttccttgggccaaggtctcatgggggctagggccaagttgggggcccaggaggcggggagggaggaggaggagaagatgcgcagttacctcatgtcggtgcccgctggggaggggtccgggaagaaggggaaggggtgcctggcgggtacttttctatcttttatttccagattttttttgtatctaaacttgaagatttgtattatacaaggacagccaataaaggaagaatataatggtg

SEQ ID NO: 455837 - DNA, 3549 bp, Homo sapiens
aacggaatcctcccgggagccgaggaggctcgcgcgcgtgcatcccgcaccatcccccggccccgggccctggccggcgtcagaccgagctgccgccgccaccaccgcagcagcagcagtcggggagccaggcccagccagggccgcgggaggcgggggcgcccgggccctggatgtcccgcagcgcggcggccagcggcggaccccggaggcctgagcggcacctgcccccagccccctgtggggccccggggcccccagaaacctgcaggacggagccagacggggcgggcaccatgaacaagttacggcagagcctgcggcggaggaagccagcctacgtgcccgaggcgtcgcgcccgcaccagtggcaggcagacgaggacgcggtgcggaagggcacgtgcagcttcccggtcaggtacctgggtcacgtggaggtagaggagtcccggggaatgcacgtgtgtgaagatgcggtgaagaagctgaaggcgatgggccgaaagtccgtgaagtctgtcctgtgggtgtcagccgatgggctccgagtggtggacgacaaaaccaaggatcttctggtcgaccagaccatcgaaaaggtctccttttgtgctcctgaccgcaacctggacaaggctttctcctatatctgtcgtgacgggactacccgccgctggatctgccactgttttctggcactgaaggactccggcgagaggctgagccacgctgtgggctgtgcttttgccgcctgcctggagcgaaaacagcgacgggagaaggaatgtggggtcacggccgccttcgatgccagccgcaccagcttcgcccgcgagggctccttccgcctgtctgggggtgggcggcctgctgagcgagaggccccggacaagaagaaagcagaggcagcagctgcccccactgtggctcctggccctgcccagcctgggcacgtgtccccgacaccagccaccacatcccctggtgagaagggtgaggcaggcacccctgtggctgcaggcaccactgcggccgccatcccccggcgccatgcacccctggagcagctggttcgccagggctccttccgtgggttcccagcactcagccagaagaactcgcctttcaaacggcagctgagcctacggctgaatgagctgccatccacgctgcagcgccgcactgacttccaggtgaagggcacagtgcctgagatggagcctcctggtgccggcgacagtgacagcatcaacgctctgtgcacacagatcagttcatcttttgccagtgctggagcgccagcaccagggccaccacctgccacaacagggacttctgcctggggtgagccctccgtgccccctgcagctgccttccagcctgggcacaagcggacaccttcagaggctgagcgatggctggaggaggtgtcacaggtggccaaggcccagcagcagcagcagcagcaacagcaacagcagcagcagcagcagcagcaacagcagcaagcagcctcagtggccccagtgcccaccatgcctcctgccctgcagcctttccccgcccccgtggggccctttgacgctgcacctgcccaagtggccgtgttcctgccacccccacacatgcagcccccttttgtgcccgcctacccgggcttgggctacccaccgatgccccgggtgcccgtggtgggcatcacaccctcacagatggtggcaaacgccttctgctcagccgcccagctccagcctcagcctgccactctgcttgggaaagctggggccttcccgccccctgccatacccagtgcccctgggagccaggcccgccctcgccccaatggggccccctggccccctgagccagcgcctgccccagctccagagttggacccctttgaggcccagtgggcggcattagaaggcaaagccactgtagagaaaccctccaaccccttttctggcgacctgcaaaagacattcgagattgaactgtagcccgagccgccccacccactccatcatctccaggtgccccacgcctgggggtggaggcacaacctctcccctaaccctgctccctggggctgcgcccctcaacaccctctcaacacccccctccctcaaccaccccgacaaccactacagaaccaacattgtgacgcccaggttgcaacaggatggaattcagggacggacccagcctggctaagggaaccatttcactgccggacttaggctggcaatgcccccttccccaaccccagacacaggggttggccacaatcccactgaatgcccttggttcacactccatttcccagtttctgttgacccccaccttccagtgttggacaggatggaggggggacacttgcttaggggctctcctgggccccacaccagtgcccaccccaaatctggtcgtctcctccccccatgcacagcacaagctaagggctgccctctgcccacacgctgcgttcactgccaatgctgtactcacctccatcaccctccaactttggggcccatgtcttccttgggccaaggtctcatgggggctagggccaagttgggggcccaggaggcggggagggaggaggaggagaagatgcgcagttacctcatgtcggtgcccgctggggaggggtccgggaagaaggggaaggggtgcctggcgggtacttttctatcttttatttccagattttttttgtatctaaacttgaagatttgtattatacaaggacagccaataaaggaagaatataatggtgcccctcgggaaacgagggtgtgtgtagggcgctggtgaggccctagaacctttcctcctgagtcatggactgaaacagagtcagaaggatgtccctgagtgataacctctgagtcatagcgtggtaacaggtaccactgactcagcacctgccaggcgggtattaaaggagccaaaattaatcaccccatttctattccttacagagttagaatcaaggaataaaaaacaaatattatgaactgctggctgggcacagtggctcacgcctgtaatcccagcactttgggaggtcgaggcaggcagatcacttaaggtcaggagttcgagaccagcctggccgccatggagaaacccagtctctaccaaaaattcaaaaattagccgggcgtggtggcaggcgcctgtaattccaggaggctgaggcacaagaatcgcttgaacccgggcagcagaggttgcagtgacctgaggtcacaccattgcactcctgcctgggcaacagaatgagactctgtctcaaaaaaaaatacttctaattagctcaatattaatattttaacaagttgggttggtaacagtatatctttgcccatgctggcaaattcttgttttgtcagcattttccataactctggccaaagtgtcacctgatgtggcaacgttttacagtcttgctattgtttcttgagtcctttaatctataagatgtatttttaaaaatatataacatataaattttgtttcgttatagctctttaaaat

SEQ ID NO: 455838 - DNA, 2623 bp, Homo sapiens
agcgggcggtgacggtgacggcggctttgtgtgtgggcggaccccggaggcctgagcggcacctgcccccagccccctgtggggccccggggcccccagaaacctgcaggacggagccagacggggcgggcaccatgaacaagttacggcagagcctgcggcggaggaagccagcctacgtgcccgaggcgtcgcgcccgcaccagtggcaggcagacgaggacgcggtgcggaagggcacgtgcagcttcccggtcaggtacctgggtcacgtggaggtagaggagtcccggggaatgcacgtgtgtgaagatgcggtgaagaagctgaaggcgatgggccgaaagtccgtgaagtctgtcctgtgggtgtcagccgatgggctccgagtggtggacgacaaaaccaaggatcttctggtcgaccagaccatcgaaaaggtctccttttgtgctcctgaccgcaacctggacaaggctttctcctatatctgtcgtgacgggactacccgccgctggatctgccactgttttctggcactgaaggactccggcgagaggctgagccacgctgtgggctgtgcttttgccgcctgcctggagcgaaaacagcgacgggagaaggaatgtggggtcacggccgccttcgatgccagccgcaccagcttcgcccgcgagggctccttccgcctgtctgggggtgggcggcctgctgagcgagaggccccggacaagaagaaagcagaggcagcagctgcccccactgtggctcctggccctgcccagcctgggcacgtgtccccgacaccagccaccacatcccctggtgagaagggtgaggcaggcacccctgtggctgcaggcaccactgcggccgccatcccccggcgccatgcacccctggagcagctggttcgccagggctccttccgtgggttcccagcactcagccagaagaactcgcctttcaaacggcagctgagcctacggctgaatgagctgccatccacgctgcagcgccgcactgacttccaggtgaagggcacagtgcctgagatggagcctcctggtgccggcgacagtgacagcatcaacgctctgtgcacacagatcagttcatcttttgccagtgctggagcgccagcaccagggccaccacctgccacaacagggacttctgcctggggtgagccctccgtgccccctgcagctgccttccagcctgggcacaagcggacaccttcagaggctgagcgatggctggaggaggtgtcacaggtggccaaggcccagcagcagcagcagcagcaacagcaacagcagcagcagcagcagcagcaacagcagcaagcagcctcagtggccccagtgcccaccatgcctcctgccctgcagcctttccccgcccccgtggggccctttgacgctgcacctgcccaagtggccgtgttcctgccacccccacacatgcagcccccttttgtgcccgcctacccgggcttgggctacccaccgatgccccgggtgcccgtggtgggcatcacaccctcacagatggtggcaaacgccttctgctcagccgcccagctccagcctcagcctgccactctgcttgggaaagctggggccttcccgccccctgccatacccagtgcccctgggagccaggcccgccctcgccccaatggggccccctggccccctgagccagcgcctgccccagctccagagttggacccctttgaggcccagtgggcggcattagaaggcaaagccactgtagagaaaccctccaaccccttttctggcgacctgcaaaagacattcgagattgaactgtagcccgagccgccccacccactccatcatctccaggtgccccacgcctgggggtggaggcacaacctctcccctaaccctgctccctggggctgcgcccctcaacaccctctcaacacccccctccctcaaccaccccgacaaccactacagaaccaacattgtgacgcccaggttgcaacaggatggaattcagggacggacccagcctggctaagggaaccatttcactgccggacttaggctggcaatgcccccttccccaaccccagacacaggggttggccacaatcccactgaatgcccttggttcacactccatttcccagtttctgttgacccccaccttccagtgttggacaggatggaggggggacacttgcttaggggctctcctgggccccacaccagtgcccaccccaaatctggtcgtctcctccccccatgcacagcacaagctaagggctgccctctgcccacacgctgcgttcactgccaatgctgtactcacctccatcaccctccaactttggggcccatgtcttccttgggccaaggtctcatgggggctagggccaagttgggggcccaggaggcggggagggaggaggaggagaagatgcgcagttacctcatgtcggtgcccgctggggaggggtccgggaagaaggggaaggggtgcctggcgggtacttttctatcttttatttccagattttttttgtatctaaacttgaagatttgtattatacaaggacagccaataaaggaagaatataatggtg

SEQ ID NO: 455839 - DNA, 519 bp, Homo sapiens
tatctaaccatccatctcccccatgtctccagcagaggcagcagctgcccccactgtggctcctggccctgcccagcctgggcacgtgtccccgacaccagccaccacatcccctggtgagaagggtgaggcaggcacccctgtggctgcaggcaccactgcggccgccatcccccggcgccatgcacccctggagcagctggttcgccagggctccttccgtgggttcccagcactcagccagaagaactcgcctttcaaacggcagctgagcctacggctgaatgagctgccatccacgctgcagcgccgcactgacttccaggtgaagggcacaggtgagccctgggcccagtgggaaacggcgttggaatcaattggcactatctgatgtgggcaagggatggaggcgagatggttcacactgtgattgatttgcactgtctgccatgggcaaaggagagagagtgggaacatgtcatgatcgattagcagtgggcaagggagaggaaagagata

SEQ ID NO: 455840 - DNA, 3153 bp, Homo sapiens
acgcatgcacgcacgcacgcacgcggcggccggcggggccgcaggctcgcgcccgggctcgccccgcgccgctccagaggctcgcgcactcagcaggttgggctgcggcggcggcggcagctgtggaagctcaggcgctgcgcgtgagaggtcccagatacgtctgcggttccggctccgccaccctcagcttctcttccccaggtctgggagccgagtgcggaaggagggaacggccctagctttgggaagccagaggacacccctggctcctgccgacaccgccctccttcccttcccagccgcgggcctcgctcggtgctaggctactctgccgggaggcggcggcggctgccagtctgtggagagtcctgctgccctccagccgggctcctccaccgggccttgcaggggccgagagagctcggtgcccgcccttccgctcgcctttttcgtcagctggctggagcagcatcggtccgggaggtctctaggctgaggcggcggccgctcctctagttccacaatgtccacgggcggagacttcgggaatccgctgaggaaattcaagctggtgttcctgggggagcaaagcgttggaaagacatctttgatcaccagattcatgtatgacagttttgacaacacctatcaggcaacaattggcattgactttttatcaaaaactatgtacttggaggatcgaacagtacgattgcaattatgggacacagcaggtcaagagcggttcaggagcttgattcctagctacattcgtgactccactgtggcagttgttgtttatgatatcacaaatgttaactcattccagcaaactacaaagtggattgatgatgtcagaacagaaagaggaagtgatgttatcatcatgctagtaggaaataaaacagatcttgctgacaagaggcaagtgtcaattgaggagggagagaggaaagccaaagagctgaatgttatgtttattgaaactagtgcaaaagctggatacaatgtaaagcagctctttcgacgtgtagcagcagctttgccgggaatggaaagcacacaggacagaagcagagaagatatgattgacataaaactggaaaagcctcaggagcaaccagtcagtgaaggaggctgttcctgctaatctcccatgtcatcttcaaccttcttcagaagctcactgctttggcccccttactctttcattgactgcagtgtgaatattggcttgaaccttttcccttcagtaataacgtattgcaattcatcattgctgcctgtctcgtggagatgatctattagcttcacaagcacaacaaaagtcagtgtcttcattatttatattttacaaaaagccaaaatatttcagcatattccagtgataactttaaaaattagatacattttcttaacatttttttcttttttaatgttatgataatgtacttcaaaatgatggaaatctcaacagtatgagtatggcttggttaacgagcggtatgttcacagcctactttatctctccttgcttttctcacctctcacttacccccattccctattaccctattcttacctagcctcccccgacttcctcaaaacaaacaagagatggcaaagcagcagttctaccaagcccattggaattatcctttaattttacagataccacttgctgtaggctacggaccaagatgtccaaaattattcttgagcactgataaaaattacggtcttctttgaggtcaaaattcagccatcatggtaggcagtgcttgaatgagaaaaggctcctggtgcatcttcaaaatgagtcctaaagaacatactgagtacttagaagtagaagaacataagatgtatttctgactaaaacaaatggctctttcacatgtgctttattagactctgggagagaaaattaaccaagtgcttcagaacaggtttttagtatttaattcttcacggtaagaaaatgaagttctaatgaactgtttctcccaaggttttaaaattgtcaagagttattctgtttgtttaaaaaataagaaacctctttaagcaatagatttgcttgggttttcttttttaaaaacataatactgtgcaggcaaggcactgtaaaagttttaattccttccagaagaaccagtggaagaatttaaatttggcgctacgatcaaaactactgaattagtagaaataatgatgtctaaagcttaccaacaaaagaaccctcagcagaataacaaaaactttgctcaggacatttgaggtcaaattgaagacggaaaccggaaaccgttttcttgtaagcccctagaggcagatcaggtaaagcatacatagtagagggaaaggagagaatggaaataaaactcaatattatgcagatttatgccttattttttagcattttttaaggttgggtctttcaggctggttttggtttgtattagatctgtatagtttaattaactggtgatttagttttatatttaagctacaattaatcttttttctttggtgatatttatttctttgccttttttttttttaacaactttcaatcttcagatgtttcgttgaatctatttagagcttcaccatggcaatatgtatttcccttaaaacactgcaaacaaatatactaggagtgtgcccttttaatctttactagttattgtgagattgctgtgtaagctaataaacacatttgtaaatacattgtttgcaggacgaaaacttctgagttacagctcaggaaaagcctgctgaatttatgttgtaagcattacttaacacagtataaagatgaaaagacaacaaaaatatcttcatacttcctcatcccctcattggaacaaaaccttaaactgggagaaccttagtcccctctctttcctcttcctcctccacttcccacttattgtcaccttgtaatattcagagagcacttggattatggatctgaatagagaaatgcttacagataatcattagcccacataccagtaactatacttaaagatgggatggagttgtaaagtgcttttataatacaatataattgttaaaggcaagggttgactctttgttttattttgacatggcatgtcctgaaataaatattgattcaatatg

SEQ ID NO: 455841 - DNA, 613 bp, Homo sapiens
ctggagtgcagtgatgtggtggcctaataatggcctgctgcagcctcaacattcctgggctcgagcatcctcaagctattaagtttgtaaaagtaaaaaaattacaggatgagcccagtcaagtgaaagcaaatcagtaacaaaaaaaagtctttaaaaaaatgttaagtatacacacacagaaacacacaaatttcaagagtgtggcagattaatgaatttttaaactaatgtgacctgtataaccagtccttatatcaaggaaagttattttcagagctttctttataatctttataatactgcctcatgtctcaaaagtaagaagtttgtttgtttctttacaggcaagtgtcaattgaggagggagagaggaaagccaaagagctgaatgttatgtttattgaaactagtgcaaaagctggatacaatgtaaagcaggtaagttgagttgaggttaccaaattgaaaaaatatgaaataattgtgtgagtattctattctctggtgtataggtttccttccacctggcaagagcaggccttacaaactagcagtatattttcaaacagtgaaaaatataaatgtggcatagtttttggaaaaagagaaa

SEQ ID NO: 455842 - DNA, 3387 bp, Homo sapiens
acgcatgcacgcacgcacgcacgcggcggccggcggggccgcaggctcgcgcccgggctcgccccgcgccgctccagaggctcgcgcactcagcaggttgggctgcggcggcggcggcagctgtggaagctcaggcgctgcgcgtgagaggtcccagatacgtctgcggttccggctccgccaccctcagcttctcttccccaggtctgggagccgagtgcggaaggagggaacggccctagctttgggaagccagaggacacccctggctcctgccgacaccgccctccttcccttcccagccgcgggcctcgctcggtgctaggctactctgccgggaggcggcggcggctgccagtctgtggagagtcctgctgccctccagccgggctcctccaccgggccttgcaggggccgagagagctcggtgcccgcccttccgctcgcctttttcgtcagctggctggagcagcatcggtccgggaggtctctaggctgaggcggcggccgctcctctagttccacaatgtccacgggcggagacttcgggaatccgctgaggaaattcaagctggtgttcctgggggagcaaagcgttggaaagacatctttgatcaccagattcatgtatgacagttttgacaacacctatcaggcaacaattggcattgactttttatcaaaaactatgtacttggaggatcgaacagtacgattgcaattatgggacacagcaggtcaagagcggttcaggagcttgattcctagctacattcgtgactccactgtggcagttgttgtttatgatatcacaaatgttaactcattccagcaaactacaaagtggattgatgatgtcagaacagaaagaggaagtgatgttatcatcatgctagtaggaaataaaacagatcttgctgacaagaggcaagtgtcaattgaggagggagagaggaaagccaaagagctgaatgttatgtttattgaaactagtgcaaaagctggatacaatgtaaagcagctctttcgacgtgtagcagcagctttgccgggaatggaaagcacacaggacagaagcagagaagatatgattgacataaaactggaaaagcctcaggagcaaccagtcagtgaaggaggctgttcctgctaatctcccatgtcatcttcaaccttcttcagaagctcactgctttggcccccttactctttcattgactgcagtgtgaatattggcttgaaccttttcccttcagtaataacgtattgcaattcatcattgctgcctgtctcgtggagatgatctattagcttcacaagcacaacaaaagtcagtgtcttcattatttatattttacaaaaagccaaaatatttcagcatattccagtgataactttaaaaattagatacattttcttaacatttttttcttttttaatgttatgataatgtacttcaaaatgatggaaatctcaacagtatgagtatggcttggttaacgagcggtatgttcacagcctactttatctctccttgcttttctcacctctcacttacccccattccctattaccctattcttacctagcctcccccgacttcctcaaaacaaacaagagatggcaaagcagcagttctaccaagcccattggaattatcctttaattttacagataccacttgctgtaggctacggaccaagatgtccaaaattattcttgagcactgataaaaattacggtcttctttgaggtcaaaattcagccatcatggtaggcagtgcttgaatgagaaaaggctcctggtgcatcttcaaaatgagtcctaaagaacatactgagtacttagaagtagaagaacataagatgtatttctgactaaaacaaatggctctttcacatgtgctttattagactctgggagagaaaattaaccaagtgcttcagaacaggtttttagtatttaattcttcacggtaagaaaatgaagttctaatgaactgtttctcccaaggttttaaaattgtcaagagttattctgtttgtttaaaaaataagaaacctctttaagcaatagatttgcttgggttttcttttttaaaaacataatactgtgcaggcaaggcactgtaaaagttttaattccttccagaagaaccagtggaagaatttaaatttggcgctacgatcaaaactactgaattagtagaaataatgatgtctaaagcttaccaacaaaagaaccctcagcagaataacaaaaactttgctcaggacatttgaggtcaaattgaagacggaaaccggaaaccgttttcttgtaagcccctagaggcagatcaggtaaagcatacatagtagagggaaaggagagaatggaaataaaactcaatattatgcagatttatgccttattttttagcattttttaaggttgggtctttcaggctggttttggtttgtattagatctgtatagtttaattaactggtgatttagttttatatttaagctacaattaatcttttttctttggtgatatttatttctttgccttttttttttttaacaactttcaatcttcagatgtttcgttgaatctatttagagcttcaccatggcaatatgtatttcccttaaaacactgcaaacaaatatactaggagtgtgcccttttaatctttactagttattgtgagattgctgtgtaagctaataaacacatttgtaaatacattgtttgcaggacgaaaacttctgagttacagctcaggaaaagcctgctgaatttatgttgtaagcattacttaacacagtataaagatgaaaagacaacaaaaatatcttcatacttcctcatcccctcattggaacaaaaccttaaactgggagaaccttagtcccctctctttcctcttcctcctccacttcccacttattgtcaccttgtaatattcagagagcacttggattatggatctgaatagagaaatgcttacagataatcattagcccacataccagtaactatacttaaagatgggatggagttgtaaagtgcttttataatacaatataattgttaaaggcaagggttgactctttgttttattttgacatggcatgtcctgaaataaatattgattcaatatgaaaaacaaaaccaacaccaacaacaacactttttgcggcgccgggccccgaaaaatttttcaaaccccttttggcgcgcggccccataggttacgcaaaacgcgcacacaggtgtccaaagaaaacaccggccaaacaagcgcgtggttctccccaaaaaaagacgcggggacccaacttttaaaacaccacagaggtccggggacaggggactcaacggaggccagagaccga

SEQ ID NO: 455843 - DNA, 3772 bp, Homo sapiens
acgcatgcacgcacgcacgcacgcggcggccggcggggccgcaggctcgcgcccgggctcgccccgcgccgctccagaggctcgcgcactcagcaggttgggctgcggcggcggcggcagctgtggaagctcaggcgctgcgcgtgagaggtcccagatacgtctgcggttccggctccgccaccctcagcttctcttccccaggtctgggagccgagtgcggaaggagggaacggccctagctttgggaagccagaggacacccctggctcctgccgacaccgccctccttcccttcccagccgcgggcctcgctcggtgctaggctactctgccgggaggcggcggcggctgccagtctgtggagagtcctgctgccctccagccgggctcctccaccgggccttgcaggggccgagagagctcggtgcccgcccttccgctcgcctttttcgtcagctggctggagcagcatcggtccgggaggtctctaggctgaggcggcggccgctcctctagttccacaatgtccacgggcggagacttcgggaatccgctgaggaaattcaagctggtgttcctgggggagcaaagcgttggaaagacatctttgatcaccagattcatgtatgacagttttgacaacacctatcaggcaacaattggcattgactttttatcaaaaactatgtacttggaggatcgaacagtacgattgcaattatgggacacagcaggtcaagagcggttcaggagcttgattcctagctacattcgtgactccactgtggcagttgttgtttatgatatcacaaatgttaactcattccagcaaactacaaagtggattgatgatgtcagaacagaaagaggaagtgatgttatcatcatgctagtaggaaataaaacagatcttgctgacaagaggcaagtgtcaattgaggagggagagaggaaagccaaagagctgaatgttatgtttattgaaactagtgcaaaagctggatacaatgtaaagcagctctttcgacgtgtagcagcagctttgccgggaatggaaagcacacaggacagaagcagagaagatatgattgacataaaactggaaaagcctcaggagcaaccagtcagtgaaggaggctgttcctgctaatctcccatgtcatcttcaaccttcttcagaagctcactgctttggcccccttactctttcattgactgcagtgtgaatattggcttgaaccttttcccttcagtaataacgtattgcaattcatcattgctgcctgtctcgtggagatgatctattagcttcacaagcacaacaaaagtcagtgtcttcattatttatattttacaaaaagccaaaatatttcagcatattccagtgataactttaaaaattagatacattttcttaacatttttttcttttttaatgttatgataatgtacttcaaaatgatggaaatctcaacagtatgagtatggcttggttaacgagcggtatgttcacagcctactttatctctccttgcttttctcacctctcacttacccccattccctattaccctattcttacctagcctcccccgacttcctcaaaacaaacaagagatggcaaagcagcagttctaccaagcccattggaattatcctttaattttacagataccacttgctgtaggctacggaccaagatgtccaaaattattcttgagcactgataaaaattacggtcttctttgaggtcaaaattcagccatcatggtaggcagtgcttgaatgagaaaaggctcctggtgcatcttcaaaatgagtcctaaagaacatactgagtacttagaagtagaagaacataagatgtatttctgactaaaacaaatggctctttcacatgtgctttattagactctgggagagaaaattaaccaagtgcttcagaacaggtttttagtatttaattcttcacggtaagaaaatgaagttctaatgaactgtttctcccaaggttttaaaattgtcaagagttattctgtttgtttaaaaaataagaaacctctttaagcaatagatttgcttgggttttcttttttaaaaacataatactgtgcaggcaaggcactgtaaaagttttaattccttccagaagaaccagtggaagaatttaaatttggcgctacgatcaaaactactgaattagtagaaataatgatgtctaaagcttaccaacaaaagaaccctcagcagaataacaaaaactttgctcaggacatttgaggtcaaattgaagacggaaaccggaaaccgttttcttgtaagcccctagaggcagatcaggtaaagcatacatagtagagggaaaggagagaatggaaataaaactcaatattatgcagatttatgccttattttttagcattttttaaggttgggtctttcaggctggttttggtttgtattagatctgtatagtttaattaactggtgatttagttttatatttaagctacaattaatcttttttctttggtgatatttatttctttgccttttttttttttaacaactttcaatcttcagatgtttcgttgaatctatttagagcttcaccatggcaatatgtatttcccttaaaacactgcaaacaaatatactaggagtgtgcccttttaatctttactagttattgtgagattgctgtgtaagctaataaacacatttgtaaatacattgtttgcaggacgaaaacttctgagttacagctcaggaaaagcctgctgaatttatgttgtaagcattacttaacacagtataaagatgaaaagacaacaaaaatatcttcatacttcctcatcccctcattggaacaaaaccttaaactgggagaaccttagtcccctctctttcctcttcctcctccacttcccacttattgtcaccttgtaatattcagagagcacttggattatggatctgaatagagaaatgcttacagataatcattagcccacataccagtaactatacttaaagatgggatggagttgtaaagtgcttttataatacaatataattgttaaaggcaagggttgactctttgttttattttgacatggcatgtcctgaaataaatattgattcaatatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacttttgggcccctttggcccaagggattttaaacttgggcaagttttttctttgggcccaaatttgggcttatttggccaattcccccttaaggggggggttttaaaattaaatggcccgggttttaaaaaggtggaactggaaaaaccctggggttacccaatttaaaccccttggaaaaaaacccctttttgccaagtggggtaaaaacaaaaaggccccaaccgatgggcttttccaaaaattggccaaccttaatgggcaatggaaattgtaagccgtaaatttttggtaaaattccgggtaaatttttggtaaaccacttattttttaaccaattggcccaaatccggaaaatccctttaaaataaaaggattcccccgaaaaaggttagagggtttcacatttggaaccaaggagccctttttaagaaacggggcctcaaaggtggggcaacggtatataaggcaatggcccctttacgtgacccattcccttaacggtttttggctccaggggccg

SEQ ID NO: 455844 - DNA, 3268 bp, Homo sapiens
  misc_feature (1436)..(1436): n is a, c, g, or t
  misc_feature (1483)..(1483): n is a, c, g, or t
acgcatgcacgcacgcacgcacgcggcggccggcggggccgcaggctcgcgcccgggctcgccccgcgccgctccagaggctcgcgcactcagcaggttgggctgcggcggcggcggcagctgtggaagctcaggcgctgcgcgtgagaggtcccagatacgtctgcggttccggctccgccaccctcagcttctcttccccaggtctgggagccgagtgcggaaggagggaacggccctagctttgggaagccagaggacacccctggctcctgccgacaccgccctccttcccttcccagccgcgggcctcgctcggtgctaggctactctgccgggaggcggcggcggctgccagtctgtggagagtcctgctgccctccagccgggctcctccaccgggccttgcaggggccgagagagctcggtgcccgcccttccgctcgcctttttcgtcagctggctggagcagcatcggtccgggaggtctctaggctgaggcggcggccgctcctctagttccacaatgtccacgggcggagacttcgggaatccgctgaggaaattcaagctggtgttcctgggggagcaaagcgttggaaagacatctttgatcaccagattcatgtatgacagttttgacaacacctatcaggcaacaattggcattgactttttatcaaaaactatgtacttggaggatcgaacagtacgattgcaattatgggacacagcaggtcaagagcggttcaggagcttgattcctagctacattcgtgactccactgtggcagttgttgtttatgatatcacaaatgttaactcattccagcaaactacaaagtggattgatgatgtcagaacagaaagaggaagtgatgttatcatcatgctagtaggaaataaaacagatcttgctgacaagaggcaagtgtcaattgaggagggagagaggaaagccaaagagctgaatgttatgtttattgaaactagtgcaaaagctggatacaatgtaaagcagctctttcgacgtgtagcagcagctttgccgggaatggaaagcacacaggacagaagcagagaagatatgattgacataaaactggaaaagcctcaggagcaaccagtcagtgaaggaggctgttcctgctaatctcccatgtcatcttcaaccttcttcagaagctcactgctttggcccccttactctttcattgactgcagtgtgaatattggcttgaaccttttcccttcagtaataacgtattgcaattcatcattgctgcctgtctcgtggagatgatctattagcttcacaagcacaacaaaagtcagtgtcttcattatttatattttacaaaaagccaaaatatttcagcatattccagtgataactttaaaaattagatacacttcttcctttacacccaactttnctatctcgtgttctcccgttctcctgcttctgtcaacaacgctggcnttactcaccttcgcaacctttaacaaccgttctggcttttacccccttttttcccaaaaaatcaaccaaactttgcaaatttggggggcaacaaaaaacttccctccaacagtatgagtatggcttggttaacgagcggtatgttcacagcctactttatctctccttgcttttctcacctctcacttacccccattccctattaccctattcttacctagcctcccccgacttcctcaaaacaaacaagagatggcaaagcagcagttctaccaagcccattggaattatcctttaattttacagataccacttgctgtaggctacggaccaagatgtccaaaattattcttgagcactgataaaaattacggtcttctttgaggtcaaaattcagccatcatggtaggcagtgcttgaatgagaaaaggctcctggtgcatcttcaaaatgagtcctaaagaacatactgagtacttagaagtagaagaacataagatgtatttctgactaaaacaaatggctctttcacatgtgctttattagactctgggagagaaaattaaccaagtgcttcagaacaggtttttagtatttaattcttcacggtaagaaaatgaagttctaatgaactgtttctcccaaggttttaaaattgtcaagagttattctgtttgtttaaaaaataagaaacctctttaagcaatagatttgcttgggttttcttttttaaaaacataatactgtgcaggcaaggcactgtaaaagttttaattccttccagaagaaccagtggaagaatttaaatttggcgctacgatcaaaactactgaattagtagaaataatgatgtctaaagcttaccaacaaaagaaccctcagcagaataacaaaaactttgctcaggacatttgaggtcaaattgaagacggaaaccggaaaccgttttcttgtaagcccctagaggcagatcaggtaaagcatacatagtagagggaaaggagagaatggaaataaaactcaatattatgcagatttatgccttattttttagcattttttaaggttgggtctttcaggctggttttggtttgtattagatctgtatagtttaattaactggtgatttagttttatatttaagctacaattaatcttttttctttggtgatatttatttctttgccttttttttttttaacaactttcaatcttcagatgtttcgttgaatctatttagagcttcaccatggcaatatgtatttcccttaaaacactgcaaacaaatatactaggagtgtgcccttttaatctttactagttattgtgagattgctgtgtaagctaataaacacatttgtaaatacattgtttgcaggacgaaaacttctgagttacagctcaggaaaagcctgctgaatttatgttgtaagcattacttaacacagtataaagatgaaaagacaacaaaaatatcttcatacttcctcatcccctcattggaacaaaaccttaaactgggagaaccttagtcccctctctttcctcttcctcctccacttcccacttattgtcaccttgtaatattcagagagcacttggattatggatctgaatagagaaatgcttacagataatcattagcccacataccagtaactatacttaaagatgggatggagttgtaaagtgcttttataatacaatataattgttaaaggcaagggttgactctttgttttattttgacatggcatgtcctgaaataaatattgattcaatatg

SEQ ID NO: 455845 - DNA, 2847 bp, Homo sapiens
acgcatgcacgcacgcacgcacgcggcggccggcggggccgcaggctcgcgcccgggctcgccccgcgccgctccagaggctcgcgcactcagcaggttgggctgcggcggcggcggcagctgtggaagctcaggcgctgcgcgtgagaggtcccagatacgtctgcggttccggctccgccaccctcagcttctcttccccaggtctgggagccgagtgcggaaggagggaacggccctagctttgggaagccagaggacacccctggctcctgccgacaccgccctccttcccttcccagccgcgggcctcgctcggtgctaggctactctgccgggaggcggcggcggctgccagtctgtggagagtcctgctgccctccagccgggctcctccaccgggccttgcaggggccgagagagctcggtgcccgcccttccgctcgcctttttcgtcagctggctggagcagcatcggtccgggaggtctctaggctgaggcggcggccgctcctctagttccacaatgtccacgggcggagacttcgggaatccgctgaggaaattcaagctggtgttcctgggggagcaaagcgttggaaagacatctttgatcaccagattcatgtatgacagttttgacaacacctatcaggcaacaattggcattgactttttatcaaaaactatgtacttggaggatcgaacagtacgattgcaattatgggacacagcaggtcaagagcggttcaggagcttgattcctagctacattcgtgactccactgtggcagttgttgtttatgatatcacaaatgttaactcattccagcaaactacaaagtggattgatgatgtcagaacagaaagaggaagtgatgttatcatcatgctagtaggaaataaaacagatcttgctgacaagaggcaagtgtcaattgaggagggagagaggaaagccaaagagctgaatgttatgtttattgaaactagtgcaaaagctggatacaatgtaaagcagctctttcgacgtgtagcagcagctttgccgggaatggaaagcacacaggacagaagcagagaagatatgattgacataaaactggaaaagcctcaggagcaaccagtcagtgaaggaggctgttcctgctaatctcccatgtcatcttcaaccttcttcagaagctcactgctttggcccccttactctttcattgactgcagtgtgaatattggcttgaaccttttcccttcagtaataacgtattgcaattcatcattgctgcctgtctcgtggagatgatctattagcttcacaagcacaacaaaagtcagtgtcttcattatttatattttacaaaaagccaaaatatttcagcatattccagtgataactttaaaaattagatacattttcttaacatttttttcttttttaatgttatgataatgtacttcaaaatgatggaaatctcaacagtatgagtatggcttggttaacgagcggtatgttcacagcctactttatctctccttgcttttctcacctctcacttacccccattccctattaccctattcttacctagcctcccccgacttcctcaaaacaaacaagagatggcaaagcagcagttctaccaagcccattggaattatcctttaattttacagataccacttgctgtaggctacggaccaagatgtccaaaattattcttgagcactgataaaaattacggtcttctttgaggtcaaaattcagccatcatggtaggcagtgcttgaatgagaaaaggctcctggtgcatcttcaaaatgagtcctaaagaacatactgagtacttagaagtagaagaacataagatgtatttctgactaaaacaaatggctctttcacatgtgctttattagactctgggagagaaaattaaccaagtgcttcagaacaggtttttagtatttaattcttcacggtaagaaaatgaagttctaatgaactgtttctcccaaggttttaaaattgtcaagagttattctgtttgtttaaaaaataagaaacctctttaagcaatagatttgcttgggttttcttttttaaaaacataatactgtgcaggcaaggcactgtaaaagttttaattccttccagaagaaccagtggaagaatttaaatttggcgctacgatcaaaactactgaattagtagaaataatgatgtctaaagcttaccaacaaaagaaccctcagcagaataacaaaaactttgctcaggacatttgaggtcaaattgaagacggaaaccggaaaccgttttcttgtaagcccctagaggcagatcaggtaaagcatacatagtagagggaaaggagagaatggaaataaaactcaatattatgcagatttatgccttattttttagcattttttaaggttgggtctttcaggctggttttggtttgtattagatctgtatagtttaattaactggtgatttagttttatatttaagctacaattaatcttttttctttggtgatatttatttctttgccttttttttttttaacaactttcaatcttcagatgtttcgttgaatctatttagagcttcaccatggcaatatgtatttcccttaaaacactgcaaacaaatatactaggagtgtgcccttttaatctttactagttattgtgagattgctgtgtaagctaataaacacatttgtaaatacattgtttgcaggacgaaaacttctgagttacagctcaggaaaagcctgctgaatttatgttgtcttttcatctttatactgtgttaagtaatgcttacaacataagtcgacg

SEQ ID NO: 455846 - DNA, 3047 bp, Homo sapiens
acgcatgcacgcacgcacgcacgcggcggccggcggggccgcaggctcgcgcccgggctcgccccgcgccgctccagaggctcgcgcactcagcaggttgggctgcggcggcggcggcagctgtggaagctcaggcgctgcgcgtgagaggtcccagatacgtctgcggttccggctccgccaccctcagcttctcttccccaggtctgggagccgagtgcggaaggagggaacggccctagctttgggaagccagaggacacccctggctcctgccgacaccgccctccttcccttcccagccgcgggcctcgctcggtgctaggctactctgccgggaggcggcggcggctgccagtctgtggagagtcctgctgccctccagccgggctcctccaccgggccttgcaggggccgagagagctcggtgcccgcccttccgctcgcctttttcgtcagctggctggagcagcatcggtccgggaggtctctaggctgaggcggcggccgctcctctagttccacaatgtccacgggcggagacttcgggaatccgctgaggaaattcaagctggtgttcctgggggagcaaagcgttggaaagacatctttgatcaccagattcatgtatgacagttttgacaacacctatcaggcaacaattggcattgactttttatcaaaaactatgtacttggaggatcgaacaatgttaactcattccagcaaactacaaagtggattgatgatgtcagaacagaaagaggaagtgatgttatcatcatgctagtaggaaataaaacagatcttgctgacaagaggcaagtgtcaattgaggagggagagaggaaagccaaagagctgaatgttatgtttattgaaactagtgcaaaagctggatacaatgtaaagcagctctttcgacgtgtagcagcagctttgccgggaatggaaagcacacaggacagaagcagagaagatatgattgacataaaactggaaaagcctcaggagcaaccagtcagtgaaggaggctgttcctgctaatctcccatgtcatcttcaaccttcttcagaagctcactgctttggcccccttactctttcattgactgcagtgtgaatattggcttgaaccttttcccttcagtaataacgtattgcaattcatcattgctgcctgtctcgtggagatgatctattagcttcacaagcacaacaaaagtcagtgtcttcattatttatattttacaaaaagccaaaatatttcagcatattccagtgataactttaaaaattagatacattttcttaacatttttttcttttttaatgttatgataatgtacttcaaaatgatggaaatctcaacagtatgagtatggcttggttaacgagcggtatgttcacagcctactttatctctccttgcttttctcacctctcacttacccccattccctattaccctattcttacctagcctcccccgacttcctcaaaacaaacaagagatggcaaagcagcagttctaccaagcccattggaattatcctttaattttacagataccacttgctgtaggctacggaccaagatgtccaaaattattcttgagcactgataaaaattacggtcttctttgaggtcaaaattcagccatcatggtaggcagtgcttgaatgagaaaaggctcctggtgcatcttcaaaatgagtcctaaagaacatactgagtacttagaagtagaagaacataagatgtatttctgactaaaacaaatggctctttcacatgtgctttattagactctgggagagaaaattaaccaagtgcttcagaacaggtttttagtatttaattcttcacggtaagaaaatgaagttctaatgaactgtttctcccaaggttttaaaattgtcaagagttattctgtttgtttaaaaaataagaaacctctttaagcaatagatttgcttgggttttcttttttaaaaacataatactgtgcaggcaaggcactgtaaaagttttaattccttccagaagaaccagtggaagaatttaaatttggcgctacgatcaaaactactgaattagtagaaataatgatgtctaaagcttaccaacaaaagaaccctcagcagaataacaaaaactttgctcaggacatttgaggtcaaattgaagacggaaaccggaaaccgttttcttgtaagcccctagaggcagatcaggtaaagcatacatagtagagggaaaggagagaatggaaataaaactcaatattatgcagatttatgccttattttttagcattttttaaggttgggtctttcaggctggttttggtttgtattagatctgtatagtttaattaactggtgatttagttttatatttaagctacaattaatcttttttctttggtgatatttatttctttgccttttttttttttaacaactttcaatcttcagatgtttcgttgaatctatttagagcttcaccatggcaatatgtatttcccttaaaacactgcaaacaaatatactaggagtgtgcccttttaatctttactagttattgtgagattgctgtgtaagctaataaacacatttgtaaatacattgtttgcaggacgaaaacttctgagttacagctcaggaaaagcctgctgaatttatgttgtaagcattacttaacacagtataaagatgaaaagacaacaaaaatatcttcatacttcctcatcccctcattggaacaaaaccttaaactgggagaaccttagtcccctctctttcctcttcctcctccacttcccacttattgtcaccttgtaatattcagagagcacttggattatggatctgaatagagaaatgcttacagataatcattagcccacataccagtaactatacttaaagatgggatggagttgtaaagtgcttttataatacaatataattgttaaaggcaagggttgactctttgttttattttgacatggcatgtcctgaaataaatattgattcaatatg

SEQ ID NO: 455847 - DNA, 3055 bp, Homo sapiens
acgcatgcacgcacgcacgcacgcggcggccggcggggccgcaggctcgcgcccgggctcgccccgcgccgctccagaggctcgcgcactcagcaggttgggctgcggcggcggcggcagctgtggaagctcaggcgctgcgcgtgagaggtcccagatacgtctgcggttccggctccgccaccctcagcttctcttccccagccgcgggcctcgctcggtgctaggctactctgccgggaggcggcggcggctgccagtctgtggagagtcctgctgccctccagccgggctcctccaccgggccttgcaggggccgagagagctcggtgcccgcccttccgctcgcctttttcgtcagctggctggagcagcatcggtccgggaggtctctaggctgaggcggcggccgctcctctagttccacaatgtccacgggcggagacttcgggaatccgctgaggaaattcaagctggtgttcctgggggagcaaagcgttggaaagacatctttgatcaccagattcatgtatgacagttttgacaacacctatcaggcaacaattggcattgactttttatcaaaaactatgtacttggaggatcgaacaatcaggcttcagctgtgggatactgcgggtcaggaacgtttccgtagcctcattcccagttacatccgtgattctgctgcagctgtagtagtttacgatatcacaaatgttaactcattccagcaaactacaaagtggattgatgatgtcagaacagaaagaggaagtgatgttatcatcatgctagtaggaaataaaacagatcttgctgacaagaggcaagtgtcaattgaggagggagagaggaaagccaaagagctgaatgttatgtttattgaaactagtgcaaaagctggatacaatgtaaagcagctctttcgacgtgtagcagcagctttgccgggaatggaaagcacacaggacagaagcagagaagatatgattgacataaaactggaaaagcctcaggagcaaccagtcagtgaaggaggctgttcctgctaatctcccatgtcatcttcaaccttcttcagaagctcactgctttggcccccttactctttcattgactgcagtgtgaatattggcttgaaccttttcccttcagtaataacgtattgcaattcatcattgctgcctgtctcgtggagatgatctattagcttcacaagcacaacaaaagtcagtgtcttcattatttatattttacaaaaagccaaaatatttcagcatattccagtgataactttaaaaattagatacattttcttaacatttttttcttttttaatgttatgataatgtacttcaaaatgatggaaatctcaacagtatgagtatggcttggttaacgagcggtatgttcacagcctactttatctctccttgcttttctcacctctcacttacccccattccctattaccctattcttacctagcctcccccgacttcctcaaaacaaacaagagatggcaaagcagcagttctaccaagcccattggaattatcctttaattttacagataccacttgctgtaggctacggaccaagatgtccaaaattattcttgagcactgataaaaattacggtcttctttgaggtcaaaattcagccatcatggtaggcagtgcttgaatgagaaaaggctcctggtgcatcttcaaaatgagtcctaaagaacatactgagtacttagaagtagaagaacataagatgtatttctgactaaaacaaatggctctttcacatgtgctttattagactctgggagagaaaattaaccaagtgcttcagaacaggtttttagtatttaattcttcacggtaagaaaatgaagttctaatgaactgtttctcccaaggttttaaaattgtcaagagttattctgtttgtttaaaaaataagaaacctctttaagcaatagatttgcttgggttttcttttttaaaaacataatactgtgcaggcaaggcactgtaaaagttttaattccttccagaagaaccagtggaagaatttaaatttggcgctacgatcaaaactactgaattagtagaaataatgatgtctaaagcttaccaacaaaagaaccctcagcagaataacaaaaactttgctcaggacatttgaggtcaaattgaagacggaaaccggaaaccgttttcttgtaagcccctagaggcagatcaggtaaagcatacatagtagagggaaaggagagaatggaaataaaactcaatattatgcagatttatgccttattttttagcattttttaaggttgggtctttcaggctggttttggtttgtattagatctgtatagtttaattaactggtgatttagttttatatttaagctacaattaatcttttttctttggtgatatttatttctttgccttttttttttttaacaactttcaatcttcagatgtttcgttgaatctatttagagcttcaccatggcaatatgtatttcccttaaaacactgcaaacaaatatactaggagtgtgcccttttaatctttactagttattgtgagattgctgtgtaagctaataaacacatttgtaaatacattgtttgcaggacgaaaacttctgagttacagctcaggaaaagcctgctgaatttatgttgtaagcattacttaacacagtataaagatgaaaagacaacaaaaatatcttcatacttcctcatcccctcattggaacaaaaccttaaactgggagaaccttagtcccctctctttcctcttcctcctccacttcccacttattgtcaccttgtaatattcagagagcacttggattatggatctgaatagagaaatgcttacagataatcattagcccacataccagtaactatacttaaagatgggatggagttgtaaagtgcttttataatacaatataattgttaaaggcaagggttgactctttgttttattttgacatggcatgtcctgaaataaatattgattcaatatg

SEQ ID NO: 455848 - DNA, 2787 bp, Homo sapiens
acgcatgcacgcacgcacgcacgcggcggccggcggggccgcaggctcgcgcccgggctcgccccgcgccgctccagaggctcgcgcactcagcaggttgggctgcggcggcggcggcagctgtggaagctcaggcgctgcgcgtgagaggtcccagatacgtctgcggttccggctccgccaccctcagcttctcttccccaggtctgggagccgagtgcggaaggagggaacggccctagctttgggaagccagaggacacccctggctcctgccgacaccgccctccttcccttcccagccgcgggcctcgctcggtgctaggctactctgccgggaggcggcggcggctgccagtctgtggagagtcctgctgccctccagccgggctcctccaccgggccttgcaggggccgagagagctcggtgcccgcccttccgctcgcctttttcgtcagctggctggagcagcatcggtccgggaggtctctaggctgaggcggcggccgctcctctagttccacaatgtccacgggcggagacttcgggaatccgctgaggaaattcaagctggtgttcctgggggagcaaagcgttggaaagacatctttgatcaccagattcatgtatgacagttttgacaacacctatcagctctttcgacgtgtagcagcagctttgccgggaatggaaagcacacaggacagaagcagagaagatatgattgacataaaactggaaaagcctcaggagcaaccagtcagtgaaggaggctgttcctgctaatctcccatgtcatcttcaaccttcttcagaagctcactgctttggcccccttactctttcattgactgcagtgtgaatattggcttgaaccttttcccttcagtaataacgtattgcaattcatcattgctgcctgtctcgtggagatgatctattagcttcacaagcacaacaaaagtcagtgtcttcattatttatattttacaaaaagccaaaatatttcagcatattccagtgataactttaaaaattagatacattttcttaacatttttttcttttttaatgttatgataatgtacttcaaaatgatggaaatctcaacagtatgagtatggcttggttaacgagcggtatgttcacagcctactttatctctccttgcttttctcacctctcacttacccccattccctattaccctattcttacctagcctcccccgacttcctcaaaacaaacaagagatggcaaagcagcagttctaccaagcccattggaattatcctttaattttacagataccacttgctgtaggctacggaccaagatgtccaaaattattcttgagcactgataaaaattacggtcttctttgaggtcaaaattcagccatcatggtaggcagtgcttgaatgagaaaaggctcctggtgcatcttcaaaatgagtcctaaagaacatactgagtacttagaagtagaagaacataagatgtatttctgactaaaacaaatggctctttcacatgtgctttattagactctgggagagaaaattaaccaagtgcttcagaacaggtttttagtatttaattcttcacggtaagaaaatgaagttctaatgaactgtttctcccaaggttttaaaattgtcaagagttattctgtttgtttaaaaaataagaaacctctttaagcaatagatttgcttgggttttcttttttaaaaacataatactgtgcaggcaaggcactgtaaaagttttaattccttccagaagaaccagtggaagaatttaaatttggcgctacgatcaaaactactgaattagtagaaataatgatgtctaaagcttaccaacaaaagaaccctcagcagaataacaaaaactttgctcaggacatttgaggtcaaattgaagacggaaaccggaaaccgttttcttgtaagcccctagaggcagatcaggtaaagcatacatagtagagggaaaggagagaatggaaataaaactcaatattatgcagatttatgccttattttttagcattttttaaggttgggtctttcaggctggttttggtttgtattagatctgtatagtttaattaactggtgatttagttttatatttaagctacaattaatcttttttctttggtgatatttatttctttgccttttttttttttaacaactttcaatcttcagatgtttcgttgaatctatttagagcttcaccatggcaatatgtatttcccttaaaacactgcaaacaaatatactaggagtgtgcccttttaatctttactagttattgtgagattgctgtgtaagctaataaacacatttgtaaatacattgtttgcaggacgaaaacttctgagttacagctcaggaaaagcctgctgaatttatgttgtaagcattacttaacacagtataaagatgaaaagacaacaaaaatatcttcatacttcctcatcccctcattggaacaaaaccttaaactgggagaaccttagtcccctctctttcctcttcctcctccacttcccacttattgtcaccttgtaatattcagagagcacttggattatggatctgaatagagaaatgcttacagataatcattagcccacataccagtaactatacttaaagatgggatggagttgtaaagtgcttttataatacaatataattgttaaaggcaagggttgactctttgttttattttgacatggcatgtcctgaaataaatattgattcaatatg

SEQ ID NO: 455849 - DNA, 2573 bp, Homo sapiens
ctggagtgcagtgatgtggtggcctaataatggcctgctgcagcctcaacattcctgggctcgagcatcctcaagctattaagtttgtaaaagtaaaaaaattacaggatgagcccagtcaagtgaaagcaaatcagtaacaaaaaaaagtctttaaaaaaatgttaagtatacacacacagaaacacacaaatttcaagagtgtggcagattaatgaatttttaaactaatgtgacctgtataaccagtccttatatcaaggaaagttattttcagagctttctttataatctttataatactgcctcatgtctcaaaagtaagaagtttgtttgtttctttacaggcaagtgtcaattgaggagggagagaggaaagccaaagagctgaatgttatgtttattgaaactagtgcaaaagctggatacaatgtaaagcagctctttcgacgtgtagcagcagctttgccgggaatggaaagcacacaggacagaagcagagaagatatgattgacataaaactggaaaagcctcaggagcaaccagtcagtgaaggaggctgttcctgctaatctcccatgtcatcttcaaccttcttcagaagctcactgctttggcccccttactctttcattgactgcagtgtgaatattggcttgaaccttttcccttcagtaataacgtattgcaattcatcattgctgcctgtctcgtggagatgatctattagcttcacaagcacaacaaaagtcagtgtcttcattatttatattttacaaaaagccaaaatatttcagcatattccagtgataactttaaaaattagatacattttcttaacatttttttcttttttaatgttatgataatgtacttcaaaatgatggaaatctcaacagtatgagtatggcttggttaacgagcggtatgttcacagcctactttatctctccttgcttttctcacctctcacttacccccattccctattaccctattcttacctagcctcccccgacttcctcaaaacaaacaagagatggcaaagcagcagttctaccaagcccattggaattatcctttaattttacagataccacttgctgtaggctacggaccaagatgtccaaaattattcttgagcactgataaaaattacggtcttctttgaggtcaaaattcagccatcatggtaggcagtgcttgaatgagaaaaggctcctggtgcatcttcaaaatgagtcctaaagaacatactgagtacttagaagtagaagaacataagatgtatttctgactaaaacaaatggctctttcacatgtgctttattagactctgggagagaaaattaaccaagtgcttcagaacaggtttttagtatttaattcttcacggtaagaaaatgaagttctaatgaactgtttctcccaaggttttaaaattgtcaagagttattctgtttgtttaaaaaataagaaacctctttaagcaatagatttgcttgggttttcttttttaaaaacataatactgtgcaggcaaggcactgtaaaagttttaattccttccagaagaaccagtggaagaatttaaatttggcgctacgatcaaaactactgaattagtagaaataatgatgtctaaagcttaccaacaaaagaaccctcagcagaataacaaaaactttgctcaggacatttgaggtcaaattgaagacggaaaccggaaaccgttttcttgtaagcccctagaggcagatcaggtaaagcatacatagtagagggaaaggagagaatggaaataaaactcaatattatgcagatttatgccttattttttagcattttttaaggttgggtctttcaggctggttttggtttgtattagatctgtatagtttaattaactggtgatttagttttatatttaagctacaattaatcttttttctttggtgatatttatttctttgccttttttttttttaacaactttcaatcttcagatgtttcgttgaatctatttagagcttcaccatggcaatatgtatttcccttaaaacactgcaaacaaatatactaggagtgtgcccttttaatctttactagttattgtgagattgctgtgtaagctaataaacacatttgtaaatacattgtttgcaggacgaaaacttctgagttacagctcaggaaaagcctgctgaatttatgttgtaagcattacttaacacagtataaagatgaaaagacaacaaaaatatcttcatacttcctcatcccctcattggaacaaaaccttaaactgggagaaccttagtcccctctctttcctcttcctcctccacttcccacttattgtcaccttgtaatattcagagagcacttggattatggatctgaatagagaaatgcttacagataatcattagcccacataccagtaactatacttaaagatgggatggagttgtaaagtgcttttataatacaatataattgttaaaggcaagggttgactctttgttttattttgacatggcatgtcctgaaataaatattgattcaatatg

SEQ ID NO: 455850 - DNA, 2267 bp, Homo sapiens
  misc_feature (43)..(43): n is a, c, g, or t
  misc_feature (65)..(65): n is a, c, g, or t
aatggactgaggaccttccgcagtctctcccagagtccgtgcngcttgtgccctgtgtgaatttntgtattctagctctaagagtttccctgaggctcttcgttgtctcagcaactttcccatctcgtctcttctctagtaacaagagaagagacgagatgactaaacatggaaagctcacaggacagaagcagagaagatatgattgacataaaactggaaaagcctcaggagcaaccagtcagtgaaggaggctgttcctgctaatctcccatgtcatcttcaaccttcttcagaagctcactgctttggcccccttactctttcattgactgcagtgtgaatattggcttgaaccttttcccttcagtaataacgtattgcaattcatcattgctgcctgtctcgtggagatgatctattagcttcacaagcacaacaaaagtcagtgtcttcattatttatattttacaaaaagccaaaatatttcagcatattccagtgataactttaaaaattagatacattttcttaacatttttttcttttttaatgttatgataatgtacttcaaaatgatggaaatctcaacagtatgagtatggcttggttaacgagcggtatgttcacagcctactttatctctccttgcttttctcacctctcacttacccccattccctattaccctattcttacctagcctcccccgacttcctcaaaacaaacaagagatggcaaagcagcagttctaccaagcccattggaattatcctttaattttacagataccacttgctgtaggctacggaccaagatgtccaaaattattcttgagcactgataaaaattacggtcttctttgaggtcaaaattcagccatcatggtaggcagtgcttgaatgagaaaaggctcctggtgcatcttcaaaatgagtcctaaagaacatactgagtacttagaagtagaagaacataagatgtatttctgactaaaacaaatggctctttcacatgtgctttattagactctgggagagaaaattaaccaagtgcttcagaacaggtttttagtatttaattcttcacggtaagaaaatgaagttctaatgaactgtttctcccaaggttttaaaattgtcaagagttattctgtttgtttaaaaaataagaaacctctttaagcaatagatttgcttgggttttcttttttaaaaacataatactgtgcaggcaaggcactgtaaaagttttaattccttccagaagaaccagtggaagaatttaaatttggcgctacgatcaaaactactgaattagtagaaataatgatgtctaaagcttaccaacaaaagaaccctcagcagaataacaaaaactttgctcaggacatttgaggtcaaattgaagacggaaaccggaaaccgttttcttgtaagcccctagaggcagatcaggtaaagcatacatagtagagggaaaggagagaatggaaataaaactcaatattatgcagatttatgccttattttttagcattttttaaggttgggtctttcaggctggttttggtttgtattagatctgtatagtttaattaactggtgatttagttttatatttaagctacaattaatcttttttctttggtgatatttatttctttgccttttttttttttaacaactttcaatcttcagatgtttcgttgaatctatttagagcttcaccatggcaatatgtatttcccttaaaacactgcaaacaaatatactaggagtgtgcccttttaatctttactagttattgtgagattgctgtgtaagctaataaacacatttgtaaatacattgtttgcaggacgaaaacttctgagttacagctcaggaaaagcctgctgaatttatgttgtaagcattacttaacacagtataaagatgaaaagacaacaaaaatatcttcatacttcctcatcccctcattggaacaaaaccttaaactgggagaaccttagtcccctctctttcctcttcctcctccacttcccacttattgtcaccttgtaatattcagagagcacttggattatggatctgaatagagaaatgcttacagataatcattagcccacataccagtaactatacttaaagatgggatggagttgtaaagtgcttttataatacaatataattgttaaaggcaagggttgactctttgttttattttgacatggcatgtcctgaaataaatattgattcaatatg

SEQ ID NO: 455851 - DNA, 2551 bp, Homo sapiens
  misc_feature (2441)..(2441): n is a, c, g, or t
  misc_feature (2443)..(2443): n is a, c, g, or t
  misc_feature (2448)..(2449): n is a, c, g, or t
  misc_feature (2453)..(2453): n is a, c, g, or t
acgcatgcacgcacgcacgcacgcggcggccggcggggccgcaggctcgcgcccgggctcgccccgcgccgctccagaggctcgcgcactcagcaggttgggctgcggcggcggcggcagctgtggaagctcaggcgctgcgcgtgagaggtcccagatacgtctgcggttccggctccgccaccctcagcttctcttccccaggtctgggagccgagtgcggaaggagggaacggccctagctttgggaagccagaggacacccctggctcctgccgacaccgccctccttcccttcccagccgcgggcctcgctcggtgctaggctactctgccgggaggcggcggcggctgccagtctgtggagagtcctgctgccctccagccgggctcctccaccgggccttgcaggggccgagagagctcggtgcccgcccttccgctcgcctttttcgtcagctggctggagcagcatcggtccgggaggtctctaggctgaggcggcggccgctcctctagttccacaatgtccacgggcggagacttcgggaatccgctgaggaaattcaagctggtgttcctgggggagcaaagcgttggaaagacatctttgatcaccagattcatgtatgacagttttgacaacacctatcaggcaacaattggcattgactttttatcaaaaactatgtacttggaggatcgaacagtacgattgcaattatgggacacagcaggtcaagagcggttcaggagcttgattcctagctacattcgtgactccactgtggcagttgttgtttatgatatcacaaatgttaactcattccagcaaactacaaagtggattgatgatgtcagaacagaaagaggaagtgatgttatcatcatgctagtaggaaataaaacagatcttgctgacaagaggcaagtgtcaattgaggagggagagaggaaagccaaagagctgaatgttatgtttattgaaactagtgcaaaagctggatacaatgtaaagcagctctttcgacgtgtagcagcagctttgccgggaatggaaagcacacaggacagaagcagagaagatatgattgacataaaactggaaaagcctcaggagcaaccagtcagtgaaggaggctgttcctgctaatctcccatgtcatcttcaaccttcttcagaagctcactgctttggcccccttactctttcattgactgcagtgtgaatattggcttgaaccttttcccttcagtaataacgtattgcaattcatcattgctgcctgtctcgtggagatgatctattagcttcacaagcacaacaaaagtcagtgtcttcattatttatattttacaaaaagccaaaatatttcagcatattccagtgataactttaaaaattagatacattttcttaacatttttttcttttttaatgttatgataatgtacttcaaaatgatggaaatctcaacagtatgagtatggcttggttaacgagcggtatgttcacagcctactttatctctccttgcttttctcacctctcacttacccccattccctattaccctattcttacctagcctcccccgacttcctcaaaacaaacaagagatggcaaagcagcagttctaccaagcccattggaattatcctttaattttacagataccacttgctgtaggctacggaccaagatgtccaaaattattcttgagcactgataaaaattacggtcttctttgaggtcaaaattcagccatcatggtaggcagtgcttgaatgagaaaaggctcctggtgcatcttcaaaatgagtcctaaagaacatactgagtacttagaagtagaagaacataagatgtatttctgactaaaacaaatggctctttcacatgtgctttattagactctgggagagaaaattaaccaagtgcttcagaacaggtttttagtatttaattcttcacggtaagaaaatgaagttctaatgaactgtttctcccaaggttttaaaattgtcaagagttattctgtttgtttaaaaaataagaaacctctttaagcaatagatttgcttgggttttcttttttaaaaacataatactgtgcaggcaaggcactgtaaaagttttaattccttccagaagaaccagtggaagaatttaaatttggcgctacgatcaaaactactgaattagtagaaataatgatgtctaaagcttaccaacaaaagaaccctcagcagaataacaaaaactttgctcaggacatttgaggtcaaattgaagacggaaaccggaaaccgttttcttgtaagcccctagaggcagatcaggtaaagcatacatagtagagggaaaggagagaatggaaataaaactcaatattatgcagatttatgccttattttttagcattttttaaggttggctncngctgnntggntgatcaattgttgttattactgtttgtttttttgctcatactttcttgggttttctgctttttttaccttcttggttttcttatactgggcaatcgtt

SEQ ID NO: 455852 - DNA, 1578 bp, Homo sapiens
acgcatgcacgcacgcacgcacgcggcggccggcggggccgcaggctcgcgcccgggctcgccccgcgccgctccagaggctcgcgcactcagcaggttgggctgcggcggcggcggcagctgtggaagctcaggcgctgcgcgtgagaggtcccagatacgtctgcggttccggctccgccaccctcagcttctcttccccaggtctgggagccgagtgcggaaggagggaacggccctagctttgggaagccagaggacacccctggctcctgccgacaccgccctccttcccttcccagccgcgggcctcgctcggtgctaggctactctgccgggaggcggcggcggctgccagtctgtggagagtcctgctgccctccagccgggctcctccaccgggccttgcaggggccgagagagctcggtgcccgcccttccgctcgcctttttcgtcagctggctggagcagcatcggtccgggaggtctctaggctgaggcggcggccgctcctctagttccacaatgtccacgggcggagacttcgggaatccgctgaggaaattcaagctggtgttcctgggggagcaaagcgttggaaagacatctttgatcaccagattcatgtatgacagttttgacaacacctatcaggcaacaattggcattgactttttatcaaaaactatgtacttggaggatcgaacagtacgattgcaattatgggacacagcaggtcaagagcggttcaggagcttgattcctagctacattcgtgactccactgtggcagttgttgtttatgatatcacaaatgttaactcattccagcaaactacaaagtggattgatgatgtcagaacagaaagaggaagtgatgttatcatcatgctagtaggaaataaaacagatcttgctgacaagaggcaagtgtcaattgaggagggagagaggaaagccaaagagctgaatgttatgtttattgaaactagtgcaaaagctggatacaatgtaaagcagctctttcgacgtgtagcagcagctttgccgggaatggaaagcacacaggacagaagcagagaagatatgattgacataaaactggaaaagcctcaggagcaaccagtcagtgaaggaggctgttcctgctaatctcccatgtcatcttcaaccttcttcagaagctcactgctttggcccccttactctttcattgactgcagtgtgaatattggcttgaaccttttcccttcagtaataacgtattgcaattcatcattgctgcctgtctcgtggagatgatctattagcttcacaagcacaacaaaagtcagtgtcttcattatttatattttacaaaaagccaaaatatttcagcatattccagtgataactttaaaaattagatacattttcttaacatttttttcttttttaatgttatgataatgtacttcaaaatgatggaaatctcaacagtatgagtatggcttggttaaagaactgctgctttgccatctcttgtttgttttgaggaagtcgggggaggctaggtaagagtagggtaatagggaatg

SEQ ID NO: 455853 - DNA, 1199 bp, Homo sapiens
acgcatgcacgcacgcacgcacgcggcggccggcggggccgcaggctcgcgcccgggctcgccccgcgccgctccagaggctcgcgcactcagcaggttgggctgcggcggcggcggcagctgtggaagctcaggcgctgcgcgtgagaggtcccagatacgtctgcggttccggctccgccaccctcagcttctcttccccaggtctgggagccgagtgcggaaggagggaacggccctagctttgggaagccagaggacacccctggctcctgccgacaccgccctccttcccttcccagccgcgggcctcgctcggtgctaggctactctgccgggaggcggcggcggctgccagtctgtggagagtcctgctgccctccagccgggctcctccaccgggccttgcaggggccgagagagctcggtgcccgcccttccgctcgcctttttcgtcagctggctggagcagcatcggtccgggaggtctctaggctgaggcggcggccgctcctctagttccacaatgtccacgggcggagacttcgggaatccgctgaggaaattcaagctggtgttcctgggggagcaaagcgttggaaagacatctttgatcaccagattcatgtatgacagttttgacaacacctatcaggcaacaattggcattgactttttatcaaaaactatgtacttggaggatcgaacagtacgattgcaattatgggacacagcaggtcaagagcggttcaggagcttgattcctagctacattcgtgactccactgtggcagttgttgtttatgatatcacaaatgttaactcattccagcaaactacaaagtggattgatgatgtcagaacagaaagaggaagtgatgttatcatcatgctagtaggaaataaaacagatcttgctgacaagaggcaagtgtcaattgaggagggagagaggaaagccaaagagctgaatgttatgtttattgaaactagtgcaaaagctggatacaatgtaaagcagctctttcgacgtgtagcagcagctttgccgggaatggaaagcacacaggacagaagcagagaagatatgattgacataaaactggaaaagcctcaggagcaaccagtcagtgaaggaggctgttcctgctaatctcccgtcagtgaaggaggctgatcctgctaatgtccctagtcaa

SEQ ID NO: 455854 - DNA, 1100 bp, Homo sapiens
ctggtagtccgacgacgagactcgagcatcagattacgtccccgcccaggacataatactgtgcaggcaaggcactgtaaaagttttaattccttccagaagaaccagtggaagaatttaaatttggcgctacgatcaaaactactgaattagtagaaataatgatgtctaaagcttaccaacaaaagaaccctcagcagaataacaaaaactttgctcaggacatttgaggtcaaattgaagacggaaaccggaaaccgttttcttgtaagcccctagaggcagatcaggtaaagcatacatagtagagggaaaggagagaatggaaataaaactcaatattatgcagatttatgccttattttttagcattttttaaggttgggtctttcaggctggttttggtttgtattagatctgtatagtttaattaactggtgatttagttttatatttaagctacaattaatcttttttctttggtgatatttatttctttgccttttttttttttaacaactttcaatcttcagatgtttcgttgaatctatttagagcttcaccatggcaatatgtatttcccttaaaacactgcaaacaaatatactaggagtgtgcccttttaatctttactagttattgtgagattgctgtgtaagctaataaacacatttgtaaatacattgtttgcaggacgaaaacttctgagttacagctcaggaaaagcctgctgaatttatgttgtaagcattacttaacacagtataaagatgaaaagacaacaaaaatatcttcatacttcctcatcccctcattggaacaaaaccttaaactgggagaaccttagtcccctctctttcctcttcctcctccacttcccacttattgtcaccttgtaatattcagagagcacttggattatggatctgaatagagaaatgcttacagataatcattagcccacataccagtaactatacttaaagatgggatggagttgtaaagtgcttttataatacaatataattgttaaaggcaagggttgactctttgttttattttgacatggcatgtcctgaaataaatattgattcaatatg

SEQ ID NO: 455855 - DNA, 1030 bp, Homo sapiens
acgcatgcacgcacgcacgcacgcggcggccggcggggccgcaggctcgcgcccgggctcgccccgcgccgctccagaggctcgcgcactcagcaggttgggctgcggcggcggcggcagctgtggaagctcaggcgctgcgcgtgagaggtcccagatacgtctgcggttccggctccgccaccctcagcttctcttccccaggtctgggagccgagtgcggaaggagggaacggccctagctttgggaagccagaggacacccctggctcctgccgacaccgccctccttcccttcccagccgcgggcctcgctcggtgctaggctactctgccgggaggcggcggcggctgccagtctgtggagagtcctgctgccctccagccgggctcctccaccgggccttgcaggggccgagagagctcggtgcccgcccttccgctcgcctttttcgtcagctggctggagcagcatcggtccgggaggtctctaggctgaggcggcggccgctcctctagttccacaatgtccacgggcggagacttcgggaatccgctgaggaaattcaagctggtgttcctgggggagcaaagcgttggaaagacatctttgatcaccagattcatgtatgacagttttgacaacacctatcaggcaacaattggcattgactttttatcaaaaactatgtacttggaggatcgaacagtacgattgcaattatgggacacagcaggtcaagagcggttcaggagcttgattcctagctacattcgtgactccactgtggcagttgttgtttatgatatcacaaatgttaactcattccagcaaactacaaagtggattgatgatgtcagaacagaaagaggaagtgatgttatcatcatgctagtaggaaataaaacagatcttgctgacaagaggcaagtgtcaattgaggagggatttcggcctgagagcgggccgaggagattggcgacggtgtcgcccgtgttttcgttggcgggtgcctgggctggtgggaac

SEQ ID NO: 455856 - DNA, 1097 bp, Homo sapiens
acgcatgcacgcacgcacgcacgcggcggccggcggggccgcaggctcgcgcccgggctcgccccgcgccgctccagaggctcgcgcactcagcaggttgggctgcggcggcggcggcagctgtggaagctcaggcgctgcgcgtgagaggtcccagatacgtctgcggttccggctccgccaccctcagcttctcttccccaggtctgggagccgagtgcggaaggagggaacggccctagctttgggaagccagaggacacccctggctcctgccgacaccgccctccttcccttcccagccgcgggcctcgctcggtgctaggctactctgccgggaggcggcggcggctgccagtctgtggagagtcctgctgccctccagccgggctcctccaccgggccttgcaggggccgagagagctcggtgcccgcccttccgctcgcctttttcgtcagctggctggagcagcatcggtccgggaggtctctaggctgaggcggcggccgctcctctagttccacaatgtccacgggcggagacttcgggaatccgctgaggaaattcaagctggtgttcctgggggagcaaagcgttggaaagacatctttgatcaccagattcatgtatgacagttttgacaacacctatcaggtattttgtttttgccaatttatttgttgtctattttgtgttacaagtaatattcaagatatttttaaaaaattatttacttgcagttgtggatgtaaaagtactttctataatctgtaaaatgctgtataaatacaatgtgtaaatgattttgtccagtcctaggataaacttttatcatttgatttcttttgtctcttccaaagtctgttgaaatatatctccaatatcatctaggatggcattagaagtaatggtggatattctctatagattttgtccaagcctaggattctgtgacattttttatctacatttgaaattaagaataaatgaataatgaaattagaaatcattaacagaaggatatttggcacattcacaaatatgtgaaaattaaataatacactcctaaataattaatgtcaaagatgaaatcaca

SEQ ID NO: 455857 - DNA, 3515 bp, Homo sapiens
acgcatgcacgcacgcacgcacgcggcggccggcggggccgcaggctcgcgcccgggctcgccccgcgccgctccagaggctcgcgcactcagcaggttgggctgcggcggcggcggcagctgtggaagctcaggcgctgcgcgtgagaggtcccagatacgtctgcggttccggctccgccaccctcagcttctcttccccaggtctgggagccgagtgcggaaggagggaacggccctagctttgggaagccagaggacacccctggctcctgccgacaccgccctccttcccttcccagccgcgggcctcgctcggtgctaggctactctgccgggaggcggcggcggctgccagtctgtggagagtcctgctgccctccagccgggctcctccaccgggccttgcaggggccgagagagctcggtgcccgcccttccgctcgcctttttcgtcagctggctggagcagcatcggtccgggaggtctctaggctgaggcggcggccgctcctctagttccacaatgtccacgggcggagacttcgggaatccgctgaggaaattcaagctggtgttcctgggggagcaaagcgttggaaagacatctttgatcaccagattcatgtatgacagttttgacaacacctatcaggcaacaattggcattgactttttatcaaaaactatgtacttggaggatcgaacagtacgattgcaattatgggacacagcaggtcaagagcggttcaggagcttgattcctagctacattcgtgactccactgtggcagttgttgtttatgatatcacaaatgttaactcattccagcaaactacaaagtggattgatgatgtcagaacagaaagaggaagtgatgttatcatcatgctagtaggaaataaaacagatcttgctgacaagaggcaagtgtcaattgaggagggagagaggaaagccaaagagctgaatgttatgtttattgaaactagtgcaaaagctggatacaatgtaaagcagctctttcgacgtgtagcagcagctttgccgggaatggaaagcacacaggacagaagcagagaagatatgattgacataaaactggaaaagcctcaggagcaaccagtcagtgaaggaggctgttcctgctaatctcccatgtcatcttcaaccttcttcagaagctcactgctttggcccccttactctttcattgactgcagtgtgaatattggcttgaaccttttcccttcagtaataacgtattgcaattcatcattgctgcctgtctcgtggagatgatctattagcttcacaagcacaacaaaagtcagtgtcttcattatttatattttacaaaaagccaaaatatttcagcatattccagtgataactttaaaaattagatacattttcttaacatttttttcttttttaatgttatgataatgtacttcaaaatgatggaaatctcaacagtatgagtatggcttggttaacgagcggtatgttcacagcctactttatctctccttgcttttctcacctctcacttacccccattccctattaccctattcttacctagcctcccccgacttcctcaaaacaaacaagagatggcaaagcagcagttctaccaagcccattggaattatcctttaattttacagataccacttgctgtaggctacggaccaagatgtccaaaattattcttgagcactgataaaaattacggtcttctttgaggtcaaaattcagccatcatggtaggcagtgcttgaatgagaaaaggctcctggtgcatcttcaaaatgagtcctaaagaacatactgagtacttagaagtagaagaacataagatgtatttctgactaaaacaaatggctctttcacatgtgctttattagactctgggagagaaaattaaccaagtgcttcagaacaggtttttagtatttaattcttcacggtaagaaaatgaagttctaatgaactgtttctcccaaggttttaaaattgtcaagagttattctgtttgtttaaaaaataagaaacctctttaagcaatagatttgcttgggttttcttttttaaaaacataatactgtgcaggcaaggcactgtaaaagttttaattccttccagaagaaccagtggaagaatttaaatttggcgctacgatcaaaactactgaattagtagaaataatgatgtctaaagcttaccaacaaaagaaccctcagcagaataacaaaaactttgctcaggacatttgaggtcaaattgaagacggaaaccggaaaccgttttcttgtaagcccctagaggcagatcaggtaaagcatacatagtagagggaaaggagagaatggaaataaaactcaatattatgcagatttatgccttattttttagcattttttaaggttgggtctttcaggctggttttggtttgtattagatctgtatagtttaattaactggtgatttagttttatatttaagctacaattaatcttttttctttggtgatatttatttctttgccttttttttttttaacaactttcaatcttcagatgtttcgttgaatctatttagagcttcaccatggcaatatgtatttcccttaaaacactgcaaacaaatatactaggagtgtgcccttttaatctttactagttattgtgagattgctgtgtaagctaataaacacatttgtaaatacattgtttgcaggacgaaaacttctgagttacagctcaggaaaagcctgctgaatttatgttgtaagcattacttaacacagtataaagatgaaaagacaacaaaaatatcttcatacttcctcatcccctcattggaacaaaaccttaaactgggagaaccttagtcccctctctttcctcttcctcctccacttcccacttattgtcaccttgtaatattcagagagcacttggattatggatctgaatagagaaatgcttacagataatcattagcccacataccagtaactatacttaaagatgggatggagttgtaaagtgcttttataatacaatataattgttaaaggcaagggttgactctttgttttattttgacatggcatgtcctgaaataaatattgattcaatatgaaaaaaaaaaaaaaaaaaaaaaaaaaaaaaaaaaaaaaaaaaaaaaaaaaaaggggggggagcgcgcaaaaaaaaatacacccaagagggggccacaaatagtaaacacaaccaaggcgtttgtagaaaaaaggggggcccacaaaggagaggcagcagataaaaacaagagacgaagaggaaacacaatataacaagagcgcgagaagaggggaaaaaaggcgaaaaacgggaaacaacagagaagggagccacataacgcgggcgggagagcacaaagcgggcaaacaccacacgcgaggagcattacacgcgcccaggggggaaaactagcaacaccacagcgggacaacgggagaaac

SEQ ID NO: 455858 - DNA, 3414 bp, Homo sapiens
acgcatgcacgcacgcacgcacgcggcggccggcggggccgcaggctcgcgcccgggctcgccccgcgccgctccagaggctcgcgcactcagcaggttgggctgcggcggcggcggcagctgtggaagctcaggcgctgcgcgtgagaggtcccagatacgtctgcggttccggctccgccaccctcagcttctcttccccaggtctgggagccgagtgcggaaggagggaacggccctagctttgggaagccagaggacacccctggctcctgccgacaccgccctccttcccttcccagccgcgggcctcgctcggtgctaggctactctgccgggaggcggcggcggctgccagtctgtggagagtcctgctgccctccagccgggctcctccaccgggccttgcaggggccgagagagctcggtgcccgcccttccgctcgcctttttcgtcagctggctggagcagcatcggtccgggaggtctctaggctgaggcggcggccgctcctctagttccacaatgtccacgggcggagacttcgggaatccgctgaggaaattcaagctggtgttcctgggggagcaaagcgttggaaagacatctttgatcaccagattcatgtatgacagttttgacaacacctatcaggcaacaattggcattgactttttatcaaaaactatgtacttggaggatcgaacagtacgattgcaattatgggacacagcaggtcaagagcggttcaggagcttgattcctagctacattcgtgactccactgtggcagttgttgtttatgatatcacaaatgttaactcattccagcaaactacaaagtggattgatgatgtcagaacagaaagaggaagtgatgttatcatcatgctagtaggaaataaaacagatcttgctgacaagaggcaagtgtcaattgaggagggagagaggaaagccaaagagctgaatgttatgtttattgaaactagtgcaaaagctggatacaatgtaaagcagctctttcgacgtgtagcagcagctttgccgggaatggaaagcacacaggacagaagcagagaagatatgattgacataaaactggaaaagcctcaggagcaaccagtcagtgaaggaggctgttcctgctaatctcccatgtcatcttcaaccttcttcagaagctcactgctttggcccccttactctttcattgactgcagtgtgaatattggcttgaaccttttcccttcagtaataacgtattgcaattcatcattgctgcctgtctcgtggagatgatctattagcttcacaagcacaacaaaagtcagtgtcttcattatttatattttacaaaaagccaaaatatttcagcatattccagtgataactttaaaaattagatacattttcttaacatttttttcttttttaatgttatgataatgtacttcaaaatgatggaaatctcaacagtatgagtatggcttggttaacgagcggtatgttcacagcctactttatctctccttgcttttctcacctctcacttacccccattccctattaccctattcttacctagcctcccccgacttcctcaaaacaaacaagagatggcaaagcagcagttctaccaagcccattggaattatcctttaattttacagataccacttgctgtaggctacggaccaagatgtccaaaattattcttgagcactgataaaaattacggtcttctttgaggtcaaaattcagccatcatggtaggcagtgcttgaatgagaaaaggctcctggtgcatcttcaaaatgagtcctaaagaacatactgagtacttagaagtagaagaacataagatgtatttctgactaaaacaaatggctctttcacatgtgctttattagactctgggagagaaaattaaccaagtgcttcagaacaggtttttagtatttaattcttcacggtaagaaaatgaagttctaatgaactgtttctcccaaggttttaaaattgtcaagagttattctgtttgtttaaaaaataagaaacctctttaagcaatagatttgcttgggttttcttttttaaaaacataatactgtgcaggcaaggcactgtaaaagttttaattccttccagaagaaccagtggaagaatttaaatttggcgctacgatcaaaactactgaattagtagaaataatgatgtctaaagcttaccaacaaaagaaccctcagcagaataacaaaaactttgctcaggacatttgaggtcaaattgaagacggaaaccggaaaccgttttcttgtaagcccctagaggcagatcaggtaaagcatacatagtagagggaaaggagagaatggaaataaaactcaatattatgcagatttatgccttattttttagcattttttaaggttgggtctttcaggctggttttggtttgtattagatctgtatagtttaattaactggtgatttagttttatatttaagctacaattaatcttttttctttggtgatatttatttctttgccttttttttttttaacaactttcaatcttcagatgtttcgttgaatctatttagagcttcaccatggcaatatgtatttcccttaaaacactgcaaacaaatatactaggagtgtgcccttttaatctttactagttattgtgagattgctgtgtaagctaataaacacatttgtaaatacattgtttgcaggacgaaaacttctgagttacagctcaggaaaagcctgctgaatttatgttgtaagcattacttaacacagtataaagatgaaaagacaacaaaaatatcttcatacttcctcatcccctcattggaacaaaaccttaaactgggagaaccttagtcccctctctttcctcttcctcctccacttcccacttattgtcaccttgtaatattcagagagcacttggattatggatctgaatagagaaatgcttacagataatcattagcccacataccagtaactatacttaaagatgggatggagttgtaaagtgcttttataatacaatataattgttaaaggcaagggttgactctttgttttattttgacatggcatgtcctgaaataaatattgattcaatatggcagatgggtcatattctttatttggaagaagttgtgacttctgacatgggtgtgattgtcttcctacactgttgcatttgattctttttatgtatttttaagaaagtaaccagttatactgcttttaatattgattggtctttttatttggcttggagttcttcaaagcattgaagtgtgttcatagtccaggttttttttttaataaacacaattttgctgccaaaaatatataaataaaacacgaaagaaaacaatta

SEQ ID NO: 455859 - DNA, 3153 bp, Homo sapiens
acgcatgcacgcacgcacgcacgcggcggccggcggggccgcaggctcgcgcccgggctcgccccgcgccgctccagaggctcgcgcactcagcaggttgggctgcggcggcggcggcagctgtggaagctcaggcgctgcgcgtgagaggtcccagatacgtctgcggttccggctccgccaccctcagcttctcttccccaggtctgggagccgagtgcggaaggagggaacggccctagctttgggaagccagaggacacccctggctcctgccgacaccgccctccttcccttcccagccgcgggcctcgctcggtgctaggctactctgccgggaggcggcggcggctgccagtctgtggagagtcctgctgccctccagccgggctcctccaccgggccttgcaggggccgagagagctcggtgcccgcccttccgctcgcctttttcgtcagctggctggagcagcatcggtccgggaggtctctaggctgaggcggcggccgctcctctagttccacaatgtccacgggcggagacttcgggaatccgctgaggaaattcaagctggtgttcctgggggagcaaagcgttggaaagacatctttgatcaccagattcatgtatgacagttttgacaacacctatcaggcaacaattggcattgactttttatcaaaaactatgtacttggaggatcgaacaatcaggcttcagctgtgggatactgcgggtcaggaacgtttccgtagcctcattcccagttacatccgtgattctgctgcagctgtagtagtttacgatatcacaaatgttaactcattccagcaaactacaaagtggattgatgatgtcagaacagaaagaggaagtgatgttatcatcatgctagtaggaaataaaacagatcttgctgacaagaggcaagtgtcaattgaggagggagagaggaaagccaaagagctgaatgttatgtttattgaaactagtgcaaaagctggatacaatgtaaagcagctctttcgacgtgtagcagcagctttgccgggaatggaaagcacacaggacagaagcagagaagatatgattgacataaaactggaaaagcctcaggagcaaccagtcagtgaaggaggctgttcctgctaatctcccatgtcatcttcaaccttcttcagaagctcactgctttggcccccttactctttcattgactgcagtgtgaatattggcttgaaccttttcccttcagtaataacgtattgcaattcatcattgctgcctgtctcgtggagatgatctattagcttcacaagcacaacaaaagtcagtgtcttcattatttatattttacaaaaagccaaaatatttcagcatattccagtgataactttaaaaattagatacattttcttaacatttttttcttttttaatgttatgataatgtacttcaaaatgatggaaatctcaacagtatgagtatggcttggttaacgagcggtatgttcacagcctactttatctctccttgcttttctcacctctcacttacccccattccctattaccctattcttacctagcctcccccgacttcctcaaaacaaacaagagatggcaaagcagcagttctaccaagcccattggaattatcctttaattttacagataccacttgctgtaggctacggaccaagatgtccaaaattattcttgagcactgataaaaattacggtcttctttgaggtcaaaattcagccatcatggtaggcagtgcttgaatgagaaaaggctcctggtgcatcttcaaaatgagtcctaaagaacatactgagtacttagaagtagaagaacataagatgtatttctgactaaaacaaatggctctttcacatgtgctttattagactctgggagagaaaattaaccaagtgcttcagaacaggtttttagtatttaattcttcacggtaagaaaatgaagttctaatgaactgtttctcccaaggttttaaaattgtcaagagttattctgtttgtttaaaaaataagaaacctctttaagcaatagatttgcttgggttttcttttttaaaaacataatactgtgcaggcaaggcactgtaaaagttttaattccttccagaagaaccagtggaagaatttaaatttggcgctacgatcaaaactactgaattagtagaaataatgatgtctaaagcttaccaacaaaagaaccctcagcagaataacaaaaactttgctcaggacatttgaggtcaaattgaagacggaaaccggaaaccgttttcttgtaagcccctagaggcagatcaggtaaagcatacatagtagagggaaaggagagaatggaaataaaactcaatattatgcagatttatgccttattttttagcattttttaaggttgggtctttcaggctggttttggtttgtattagatctgtatagtttaattaactggtgatttagttttatatttaagctacaattaatcttttttctttggtgatatttatttctttgccttttttttttttaacaactttcaatcttcagatgtttcgttgaatctatttagagcttcaccatggcaatatgtatttcccttaaaacactgcaaacaaatatactaggagtgtgcccttttaatctttactagttattgtgagattgctgtgtaagctaataaacacatttgtaaatacattgtttgcaggacgaaaacttctgagttacagctcaggaaaagcctgctgaatttatgttgtaagcattacttaacacagtataaagatgaaaagacaacaaaaatatcttcatacttcctcatcccctcattggaacaaaaccttaaactgggagaaccttagtcccctctctttcctcttcctcctccacttcccacttattgtcaccttgtaatattcagagagcacttggattatggatctgaatagagaaatgcttacagataatcattagcccacataccagtaactatacttaaagatgggatggagttgtaaagtgcttttataatacaatataattgttaaaggcaagggttgactctttgttttattttgacatggcatgtcctgaaataaatattgattcaatatg

SEQ ID NO: 455860 - DNA, 3111 bp, Homo sapiens
acgcatgcacgcacgcacgcacgcggcggccggcggggccgcaggctcgcgcccgggctcgccccgcgccgctccagaggctcgcgcactcagcaggttgggctgcggcggcggcggcagctgtggaagctcaggcgctgcgcgtgagaggtcccagatacgtctgcggttccggctccgccaccctcagcttctcttccccaggtctgggagccgagtgcggaaggagggaacggccctagctttgggaagccagaggacacccctggctcctgccgacaccgccctccttcccttcccagccgcgggcctcgctcggtgctaggctactctgccgggaggcggcggcggctgccagtctgtggagagtcctgctgccctccagccgggctcctccaccgggccttgcaggggccgagagagctcggtgcccgcccttccgctcgcctttttcgtcagctggctggagcagcatcggtccgggaggtctctaggctgaggcggcgggaatccgctgaggaaattcaagctggtgttcctgggggagcaaagcgttggaaagacatctttgatcaccagattcatgtatgacagttttgacaacacctatcaggcaacaattggcattgactttttatcaaaaactatgtacttggaggatcgaacagtacgattgcaattatgggacacagcaggtcaagagcggttcaggagcttgattcctagctacattcgtgactccactgtggcagttgttgtttatgatatcacaaatgttaactcattccagcaaactacaaagtggattgatgatgtcagaacagaaagaggaagtgatgttatcatcatgctagtaggaaataaaacagatcttgctgacaagaggcaagtgtcaattgaggagggagagaggaaagccaaagagctgaatgttatgtttattgaaactagtgcaaaagctggatacaatgtaaagcagctctttcgacgtgtagcagcagctttgccgggaatggaaagcacacaggacagaagcagagaagatatgattgacataaaactggaaaagcctcaggagcaaccagtcagtgaaggaggctgttcctgctaatctcccatgtcatcttcaaccttcttcagaagctcactgctttggcccccttactctttcattgactgcagtgtgaatattggcttgaaccttttcccttcagtaataacgtattgcaattcatcattgctgcctgtctcgtggagatgatctattagcttcacaagcacaacaaaagtcagtgtcttcattatttatattttacaaaaagccaaaatatttcagcatattccagtgataactttaaaaattagatacattttcttaacatttttttcttttttaatgttatgataatgtacttcaaaatgatggaaatctcaacagtatgagtatggcttggttaacgagcggtatgttcacagcctactttatctctccttgcttttctcacctctcacttacccccattccctattaccctattcttacctagcctcccccgacttcctcaaaacaaacaagagatggcaaagcagcagttctaccaagcccattggaattatcctttaattttacagataccacttgctgtaggctacggaccaagatgtccaaaattattcttgagcactgataaaaattacggtcttctttgaggtcaaaattcagccatcatggtaggcagtgcttgaatgagaaaaggctcctggtgcatcttcaaaatgagtcctaaagaacatactgagtacttagaagtagaagaacataagatgtatttctgactaaaacaaatggctctttcacatgtgctttattagactctgggagagaaaattaaccaagtgcttcagaacaggtttttagtatttaattcttcacggtaagaaaatgaagttctaatgaactgtttctcccaaggttttaaaattgtcaagagttattctgtttgtttaaaaaataagaaacctctttaagcaatagatttgcttgggttttcttttttaaaaacataatactgtgcaggcaaggcactgtaaaagttttaattccttccagaagaaccagtggaagaatttaaatttggcgctacgatcaaaactactgaattagtagaaataatgatgtctaaagcttaccaacaaaagaaccctcagcagaataacaaaaactttgctcaggacatttgaggtcaaattgaagacggaaaccggaaaccgttttcttgtaagcccctagaggcagatcaggtaaagcatacatagtagagggaaaggagagaatggaaataaaactcaatattatgcagatttatgccttattttttagcattttttaaggttgggtctttcaggctggttttggtttgtattagatctgtatagtttaattaactggtgatttagttttatatttaagctacaattaatcttttttctttggtgatatttatttctttgccttttttttttttaacaactttcaatcttcagatgtttcgttgaatctatttagagcttcaccatggcaatatgtatttcccttaaaacactgcaaacaaatatactaggagtgtgcccttttaatctttactagttattgtgagattgctgtgtaagctaataaacacatttgtaaatacattgtttgcaggacgaaaacttctgagttacagctcaggaaaagcctgctgaatttatgttgtaagcattacttaacacagtataaagatgaaaagacaacaaaaatatcttcatacttcctcatcccctcattggaacaaaaccttaaactgggagaaccttagtcccctctctttcctcttcctcctccacttcccacttattgtcaccttgtaatattcagagagcacttggattatggatctgaatagagaaatgcttacagataatcattagcccacataccagtaactatacttaaagatgggatggagttgtaaagtgcttttataatacaatataattgttaaaggcaagggttgactctttgttttattttgacatggcatgtcctgaaataaatattgattcaatatg

SEQ ID NO: 455861 - DNA, 2980 bp, Homo sapiens
acgcatgcacgcacgcacgcacgcggcggccggcggggccgcaggctcgcgcccgggctcgccccgcgccgctccagaggctcgcgcactcagcaggttgggctgcggcggcggcggcagctgtggaagctcaggcgctgcgcgtgagaggtcccagatacgtctgcggttccggctccgccaccctcagcttctcttccccaggtctgggagccgagtgcggaaggagggaacggccctagctttgggaagccagaggacacccctggctcctgccgacaccgccctccttcccttcccagccgcgggcctcgctcggtgctaggctactctgccgggaggcggcggcggctgccagtctgtggagagtcctgctgccctccagccgggctcctccaccgggccttgcaggggccgagagagctcggtgcccgcccttccgctcgcctttttcgtcagctggctggagcagcatcggtccgggaggtctctaggctgaggcggcggccgctcctctagttccacaatgtccacgggcggagacttcgggaatccgctgaggaaattcaagctggtgttcctgggggagcaaagcgttggaaagacatctttgatcaccagattcatgtatgacagttttgacaacacctatcaggcaacaattggcattgactttttatcaaaaactatgtacttggaggatcgaacaatgttaactcattccagcaaactacaaagtggattgatgatgtcagaacagaaagaggaagtgatgttatcatcatgctagtaggaaataaaacagatcttgctgacaagaggcaagtgtcaattgaggagggagagaggaaagccaaagagctgaatgttatgtttattgaaactagtgcaaaagctggatacaatgtaaagcagtgattgacataaaactggaaaagcctcaggagcaaccagtcagtgaaggaggctgttcctgctaatctcccatgtcatcttcaaccttcttcagaagctcactgctttggcccccttactctttcattgactgcagtgtgaatattggcttgaaccttttcccttcagtaataacgtattgcaattcatcattgctgcctgtctcgtggagatgatctattagcttcacaagcacaacaaaagtcagtgtcttcattatttatattttacaaaaagccaaaatatttcagcatattccagtgataactttaaaaattagatacattttcttaacatttttttcttttttaatgttatgataatgtacttcaaaatgatggaaatctcaacagtatgagtatggcttggttaacgagcggtatgttcacagcctactttatctctccttgcttttctcacctctcacttacccccattccctattaccctattcttacctagcctcccccgacttcctcaaaacaaacaagagatggcaaagcagcagttctaccaagcccattggaattatcctttaattttacagataccacttgctgtaggctacggaccaagatgtccaaaattattcttgagcactgataaaaattacggtcttctttgaggtcaaaattcagccatcatggtaggcagtgcttgaatgagaaaaggctcctggtgcatcttcaaaatgagtcctaaagaacatactgagtacttagaagtagaagaacataagatgtatttctgactaaaacaaatggctctttcacatgtgctttattagactctgggagagaaaattaaccaagtgcttcagaacaggtttttagtatttaattcttcacggtaagaaaatgaagttctaatgaactgtttctcccaaggttttaaaattgtcaagagttattctgtttgtttaaaaaataagaaacctctttaagcaatagatttgcttgggttttcttttttaaaaacataatactgtgcaggcaaggcactgtaaaagttttaattccttccagaagaaccagtggaagaatttaaatttggcgctacgatcaaaactactgaattagtagaaataatgatgtctaaagcttaccaacaaaagaaccctcagcagaataacaaaaactttgctcaggacatttgaggtcaaattgaagacggaaaccggaaaccgttttcttgtaagcccctagaggcagatcaggtaaagcatacatagtagagggaaaggagagaatggaaataaaactcaatattatgcagatttatgccttattttttagcattttttaaggttgggtctttcaggctggttttggtttgtattagatctgtatagtttaattaactggtgatttagttttatatttaagctacaattaatcttttttctttggtgatatttatttctttgccttttttttttttaacaactttcaatcttcagatgtttcgttgaatctatttagagcttcaccatggcaatatgtatttcccttaaaacactgcaaacaaatatactaggagtgtgcccttttaatctttactagttattgtgagattgctgtgtaagctaataaacacatttgtaaatacattgtttgcaggacgaaaacttctgagttacagctcaggaaaagcctgctgaatttatgttgtaagcattacttaacacagtataaagatgaaaagacaacaaaaatatcttcatacttcctcatcccctcattggaacaaaaccttaaactgggagaaccttagtcccctctctttcctcttcctcctccacttcccacttattgtcaccttgtaatattcagagagcacttggattatggatctgaatagagaaatgcttacagataatcattagcccacataccagtaactatacttaaagatgggatggagttgtaaagtgcttttataatacaatataattgttaaaggcaagggttgactctttgttttattttgacatggcatgtcctgaaataaatattgattcaatatg

SEQ ID NO: 455862 - DNA, 2281 bp, Homo sapiens
ttgcaggaccctgtggaatcgtggtgctgctgcaccccttctttgctggcaggaggcaagtgtcaattgaggagggagagaggaaagccaaagagctgaatgttatgtttattgaaactagtgcaaaagctggatacaatgtaaagcagctctttcgacgtgtagcagcagctttgccgggaatggaaagcacacaggacagaagcagagaagatatgattgacataaaactggaaaagcctcaggagcaaccagtcagtgaaggaggctgttcctgctaatctcccatgtcatcttcaaccttcttcagaagctcactgctttggcccccttactctttcattgactgcagtgtgaatattggcttgaaccttttcccttcagtaataacgtattgcaattcatcattgctgcctgtctcgtggagatgatctattagcttcacaagcacaacaaaagtcagtgtcttcattatttatattttacaaaaagccaaaatatttcagcatattccagtgataactttaaaaattagatacattttcttaacatttttttcttttttaatgttatgataatgtacttcaaaatgatggaaatctcaacagtatgagtatggcttggttaacgagcggtatgttcacagcctactttatctctccttgcttttctcacctctcacttacccccattccctattaccctattcttacctagcctcccccgacttcctcaaaacaaacaagagatggcaaagcagcagttctaccaagcccattggaattatcctttaattttacagataccacttgctgtaggctacggaccaagatgtccaaaattattcttgagcactgataaaaattacggtcttctttgaggtcaaaattcagccatcatggtaggcagtgcttgaatgagaaaaggctcctggtgcatcttcaaaatgagtcctaaagaacatactgagtacttagaagtagaagaacataagatgtatttctgactaaaacaaatggctctttcacatgtgctttattagactctgggagagaaaattaaccaagtgcttcagaacaggtttttagtatttaattcttcacggtaagaaaatgaagttctaatgaactgtttctcccaaggttttaaaattgtcaagagttattctgtttgtttaaaaaataagaaacctctttaagcaatagatttgcttgggttttcttttttaaaaacataatactgtgcaggcaaggcactgtaaaagttttaattccttccagaagaaccagtggaagaatttaaatttggcgctacgatcaaaactactgaattagtagaaataatgatgtctaaagcttaccaacaaaagaaccctcagcagaataacaaaaactttgctcaggacatttgaggtcaaattgaagacggaaaccggaaaccgttttcttgtaagcccctagaggcagatcaggtaaagcatacatagtagagggaaaggagagaatggaaataaaactcaatattatgcagatttatgccttattttttagcattttttaaggttgggtctttcaggctggttttggtttgtattagatctgtatagtttaattaactggtgatttagttttatatttaagctacaattaatcttttttctttggtgatatttatttctttgccttttttttttttaacaactttcaatcttcagatgtttcgttgaatctatttagagcttcaccatggcaatatgtatttcccttaaaacactgcaaacaaatatactaggagtgtgcccttttaatctttactagttattgtgagattgctgtgtaagctaataaacacatttgtaaatacattgtttgcaggacgaaaacttctgagttacagctcaggaaaagcctgctgaatttatgttgtaagcattacttaacacagtataaagatgaaaagacaacaaaaatatcttcatacttcctcatcccctcattggaacaaaaccttaaactgggagaaccttagtcccctctctttcctcttcctcctccacttcccacttattgtcaccttgtaatattcagagagcacttggattatggatctgaatagagaaatgcttacagataatcattagcccacataccagtaactatacttaaagatgggatggagttgtaaagtgcttttataatacaatataattgttaaaggcaagggttgactctttgttttattttgacatggcatgtcctgaaataaatattgattcaatatg

SEQ ID NO: 455863 - DNA, 1711 bp, Homo sapiens
ctcaacgctttatacttcctcagcttttctttctcaacgctttatacttctaagtactcgagcggtatgttcacagcctactttatctctccttgcttttctcacctctcacttacccccattccctattaccctattcttacctagcctcccccgacttcctcaaaacaaacaagagatggcaaagcagcagttctaccaagcccattggaattatcctttaattttacagataccacttgctgtaggctacggaccaagatgtccaaaattattcttgagcactgataaaaattacggtcttctttgaggtcaaaattcagccatcatggtaggcagtgcttgaatgagaaaaggctcctggtgcatcttcaaaatgagtcctaaagaacatactgagtacttagaagtagaagaacataagatgtatttctgactaaaacaaatggctctttcacatgtgctttattagactctgggagagaaaattaaccaagtgcttcagaacaggtttttagtatttaattcttcacggtaagaaaatgaagttctaatgaactgtttctcccaaggttttaaaattgtcaagagttattctgtttgtttaaaaaataagaaacctctttaagcaatagatttgcttgggttttcttttttaaaaacataatactgtgcaggcaaggcactgtaaaagttttaattccttccagaagaaccagtggaagaatttaaatttggcgctacgatcaaaactactgaattagtagaaataatgatgtctaaagcttaccaacaaaagaaccctcagcagaataacaaaaactttgctcaggacatttgaggtcaaattgaagacggaaaccggaaaccgttttcttgtaagcccctagaggcagatcaggtaaagcatacatagtagagggaaaggagagaatggaaataaaactcaatattatgcagatttatgccttattttttagcattttttaaggttgggtctttcaggctggttttggtttgtattagatctgtatagtttaattaactggtgatttagttttatatttaagctacaattaatcttttttctttggtgatatttatttctttgccttttttttttttaacaactttcaatcttcagatgtttcgttgaatctatttagagcttcaccatggcaatatgtatttcccttaaaacactgcaaacaaatatactaggagtgtgcccttttaatctttactagttattgtgagattgctgtgtaagctaataaacacatttgtaaatacattgtttgcaggacgaaaacttctgagttacagctcaggaaaagcctgctgaatttatgttgtaagcattacttaacacagtataaagatgaaaagacaacaaaaatatcttcatacttcctcatcccctcattggaacaaaaccttaaactgggagaaccttagtcccctctctttcctcttcctcctccacttcccacttattgtcaccttgtaatattcagagagcacttggattatggatctgaatagagaaatgcttacagataatcattagcccacataccagtaactatacttaaagatgggatggagttgtaaagtgcttttataatacaatataattgttaaaggcaagggttgactctttgttttattttgacatggcatgtcctgaaataaatattgattcaatatg

SEQ ID NO: 455864 - DNA, 1332 bp, Homo sapiens
acgcatgcacgcacgcacgcacgcggcggccggcggggccgcaggctcgcgcccgggctcgccccgcgccgctccagaggctcgcgcactcagcaggttgggctgcggcggcggcggcagctgtggaagctcaggcgctgcgcgtgagaggtcccagatacgtctgcggttccggctccgccaccctcagcttctcttccccaggtctgggagccgagtgcggaaggagggaacggccctagctttgggaagccagaggacacccctggctcctgccgacaccgccctccttcccttcccagccgcgggcctcgctcggtgctaggctactctgccgggaggcggcggcggctgccagtctgtggagagtcctgctgccctccagccgggctcctccaccgggccttgcaggggccgagagagctcggtgcccgcccttccgctcgcctttttcgtcagctggctggagcagcatcggtccgggaggtctctaggctgaggcggcggccgctcctctagttccacaatgtccacgggcggagacttcgggaatccgctgaggaaattcaagctggtgttcctgggggagcaaagcgttggaaagacatctttgatcaccagattcatgtatgacagttttgacaacacctatcaggcaacaattggcattgactttttatcaaaaactatgtacttggaggatcgaacagtacgattgcaattatgggacacagcaggtcaagagcggttcaggagcttgattcctagctacattcgtgactccactgtggcagttgttgtttatgatatcacaaatgttaactcattccagcaaactacaaagtggattgatgatgtcagaacagaaagaggaagtgatgttatcatcatgctagtaggaaataaaacagatcttgctgacaagaggcaagtgtcaattgaggagggagagaggaaagccaaagagctgaatgttatgtttattgaaactagtgcaaaagctggatacaatgtaaagcagctctttcgacgtgtagcagcagctttgccgggaatggaaagcacacaggacagaagcagagaagatatgattgacataaaactggaaaagcctcaggagcaaccagtcagtgaaggaggctgttcctgctaatctcccatgtcatcttcaaccttcttcagaagctcactgctttggcccccttactctttcattgactgcagtgtgaatattggcttgaaccttttcccttcagtaataacgtattgcaattcaacacgtgcgtgttgcctgcttttgatgttgctcgagtgatactcatacacggacac

SEQ ID NO: 455865 - DNA, 510 bp, Homo sapiens
cggccgctcctctagttccacaatgtccacgggcggagacttcgggaatccgctgaggaaattcaagctggtgttcctgggggagcaaagcggtgagtgcgtggctcccctactcctggcagctggccgcagcgtccccgcaccgcccccggtcggcccttccgtccgcggaggctccctgcccgcctcgcgtccgcgctcgttgccaccgcagcccttcccgatgtgccccccggtgccactggctcttcgccagtggccgagtttttaccctgttccccgggttcttcaatcctcgactccccggctccgttcctcgcagtccggccatctccggtcgatctgccctccctccccagacctcaccccgcccagcctcttgtccatccctttcttcctccggtctcggtcattgcccgtaccccggccccctttcttgagccccacccttattccttgctcttttcccagttcctcagctctgtgaggcccactcagggaagccccact

SEQ ID NO: 455866 - DNA, 2055 bp, Homo sapiens
ggcgggaattcccgactctaggccggaagcgcgcggagaccatgtagtgagaccctcgcgaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctgccacttggagtggacccctcctactcttcttagcgcctaccctcatacctatctccctcctcccatctcctaggggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctaga

SEQ ID NO: 455867 - DNA, 2018 bp, Homo sapiens
agagagagagagagagagagagagagtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctgccacttggagtggacccctcctactcttcttagcgcctaccctcatacctatctccctcctcccatctcctaggggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctaga

SEQ ID NO: 455868 - DNA, 573 bp, Homo sapiens
gagcaggggacgcgggcgccgccgtttgggaggcgcaggttgagggccgaggggcaggaagaaggattttgccgggggagaccgaaacaccggagaggttcggggtgtagaggcgactgggggccgagtacgtgaggtgggagtgggcggagaggggagatgaagtccggcggaggtaggaggtgagtggtccttgtgcatccctgacggagtcccctcgaggacgctactgaagcatgcctggtattggggtatggcctgggaggagggctgcttgtctgtaacctggctcctctgagtttgtgatctcctccaaactggtccctctgccttctgcgctttggtgcccccgggaaagggccccttgagtggtttgaacgagcggtgctgtgtatagtggggcaggaagtcccctcctgcgtcccgtccttttgcttcctttttcaaatacttcttgtggtttcctgacgtgaatgaaggtgaggtccattgcttggtgttttgtcctggcctccttggaggagaggtagggttttgaatccgacaactgggtaaccgtccgaccataagttg

SEQ ID NO: 455869 - DNA, 2052 bp, Homo sapiens
  misc_feature (19)..(19): n is a, c, g, or t
ttaggctaggtacgaggcnggtgtgaatcggccgaggcatgtagtgagaccctcgcgaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctgccacttggagtggacccctcctactcttcttagcgcctaccctcatacctatctccctcctcccatctcctaggggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctaga

SEQ ID NO: 455870 - DNA, 2062 bp, Homo sapiens
gcagtactcataacggtttaaggtagcgaggctgggtggcgggagaccatgtagtgagaccctcgcgaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctgccacttggagtggacccctcctactcttcttagcgcctaccctcatacctatctccctcctcccatctcctaggggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctaga

SEQ ID NO: 455871 - DNA, 2410 bp, Homo sapiens
cagcggggtccatgtcggctgcccaggcctccccgggcccgggaacaggagtcccagctcacgcattcttcatctgcttcccgcgacgcttggcggcctcgcaccccgcctcctggagcccggactttcaggcaccgccctcagtgtcgcctcagtccgtcccgggaccgcagactcttagggcccctctctttggccatctgcctctaggtcccatcctggggcctgaagcgcttgttctctgcgctgggaaaaggggaacgatggagcgatccagcacccaaacttaccctgtccaggtggcccacgaagctacccaagacatctctgcacagccctagcctttttggcttcacccactccgttcgggagttggggacccggcctctacattccttaggggaactccagctccaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctgccacttggagtggacccctcctactcttcttagcgcctaccctcatacctatctccctcctcccatctcctaggggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctaga

SEQ ID NO: 455872 - DNA, 2091 bp, Homo sapiens
ccatcagaagtatctagcagtgctcggtcacccgcgtttgtttattattcaagtcacgcggctgagcttcatgtacatgctgttgcgatcgctcgcatgtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctgccacttggagtggacccctcctactcttcttagcgcctaccctcatacctatctccctcctcccatctcctaggggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctaga

SEQ ID NO: 455873 - DNA, 1971 bp, Homo sapiens
  misc_feature (19)..(19): n is a, c, g, or t
ttaggctaggtacgaggcnggtgtgaatcggccgaggcatgtagtgagaccctcgcgaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctgccacttggagtggacccctcctactcttcttagcgcctaccctcatacctatctccctcctcccatctcctaggggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctaga

SEQ ID NO: 455874 - DNA, 1998 bp, Homo sapiens
  misc_feature (19)..(19): n is a, c, g, or t
ttaggctaggtacgaggcnggtgtgaatcggccgaggcatgtagtgagaccctcgcgaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctgccacttggagtggacccctcctactcttcttagcgcctaccctcatacctatctccctcctcccatctcctaggggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctaga

SEQ ID NO: 455875 - DNA, 1738 bp, Homo sapiens
  misc_feature (19)..(19): n is a, c, g, or t
ttaggctaggtacgaggcnggtgtgaatcggccgaggcctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctgccacttggagtggacccctcctactcttcttagcgcctaccctcatacctatctccctcctcccatctcctaggggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctaga

SEQ ID NO: 455876 - DNA, 1554 bp, Homo sapiens
  misc_feature (19)..(19): n is a, c, g, or t
ttaggctaggtacgaggcnggtgtgaatcggccgaggctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctgccacttggagtggacccctcctactcttcttagcgcctaccctcatacctatctccctcctcccatctcctaggggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctaga

SEQ ID NO: 455877 - DNA, 1575 bp, Homo sapiens
  misc_feature (19)..(19): n is a, c, g, or t
ttaggctaggtacgaggcnggtgtgaatcggccgaggcatgtagtgagaccctcgcgaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagccaggcgcacttctcaaaccatatctattccccttattttgaaatattgttcagtattccagttcagttatatggtttcttattccctaagtctactgccagcccttgaggtcctattatgttagtttacttctatagggtactgtcttctctatagaaaactcacccatagattgttacttggcggagcaaggagtgtttgagactctgcaatatacagagataggtttgcactgtccagtctagcacatctgtttctggcagtcaactctcaaggtta

SEQ ID NO: 455878 - DNA, 950 bp, Homo sapiens
  misc_feature (4)..(4): n is a, c, g, or t
  misc_feature (6)..(8): n is a, c, g, or t
ggcngnnnaggagagtcaggccaatggggccgcagttctttcttttttttttctttattcttatttttggagacagggtctcgctctgttgcccaggctggagtgcggtggtgcgatcacggttccatgcagcccccgacctcccgggctcaggtgattctcccgcctcagcaccgcgagcagctaggaccacaggcgcgagccactgcgtccggccggcgggacttatttgtcaggcggggattgggttccgccagcctaaagggaggggtaagcgccagaatatgaatcgccgggaagctgggagaaagctccgggaaaccctgagcagccaggtcgcctgctccgcccgctcccgctcccgatctctgattgctcctaactgacgtcactcccggtctgtccccgcccactcggtgctgccattggcagtcggtcgtggcccatctcctaggggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctaga

SEQ ID NO: 455879 - DNA, 2954 bp, Homo sapiens
  misc_feature (19)..(19): n is a, c, g, or t
ttaggctaggtacgaggcnggtgtgaatcggccgaggcatgtagtgagaccctcgcgaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacagttacaggcccaaaaactgcgactggcatacacaaggagctctcattatggtgggtctctgcccaatgttaaccagattggctctggcctggccgagttccagagccccctccactcacctttggattcatctcggagcactcggcaccatgggctggtggaacgggtgcagcgagatcctcgaagaatggtgtccccacttcgccgatacacccgccacattgacagctctccctatagtcctgcctacttatctcctcccccagagtctagctggcgaaggacgatggcctggggcaatttccctgcagagaaggggcagttgtttcgactaccatctgcacttaacaggacaagctctgactctgcccttcatacaagtgtgatgaaccccagtccccaggatacctacccaggccccacacctcccagcatcctgcccagccgacgtgggggtattctggatggtgaaatggaccccaaagtacctgctattgaggagaacttgctagatgacaagcatttgctgaagccatgggatgctaagaagctatcctcatcctcttcccgacctcggtcctgtgaagtccctggaattaacatctttccatctcctgaccagcctgccaatgtgcctgtcctcccacctgccatgaacacggggggctccctacctgacctcaccaacctgcactttcccccaccactgcccacccccctggaccctgaagagacagcctaccctagcctgagtgggggcaacagtacctccaatttgacccacaccatgactcacctgggcatcagcaggggcatgggcctgggcccaggctatgatgcaccaggacttcattcacctctcagccacccatccctgcagtcctccctaagcaatcccaacctccaggcttccctgagcagtcctcagccccagcttcagggctcccacagccacccctctctgcctgcctcctccttggcccgccatgtactgcccaccacctccctgggccacccctcactcagtgctccggctctctcctcctcctcttcctcctcctccacttcatctcctgttttgggcgccccctcttaccctgcttctacccctggggcctccccccaccaccgccgtgtgcccctcagccccctgagtttgctcgcgggcccagccgacgccagaaggtcccaacagcagctgcccaaacagttttcgccaacaatgtcacccaccttgtcttccatcactcagggcgtccccctggataccagtaaactgtccactgaccagcggttacccccatacccatacagctccccaagtctggttctgcctacccagccccacaccccaaagtctctacagcagccagggctgccctctcagtcttgttcagtgcagtcctcaggtgggcagcccccaggcaggcagtctcattatgggacaccgtacccacctgggcccagtgggcatgggcaacagtcttaccaccggccaatgagtgacttcaacctggggaatctggagcagttcagcatggagagcccatcagccagcctggtgctggatccccctggcttttctgaagggcctggatttttagggggtgaggggccaatgggtggcccccaggatccccacaccttcaaccaccagaacttgacccactgttcccgccatggctcagggcctaacatcatcctcacaggggactcctctccaggtttctctaaggagattgcagcagccctggccggagtgcctggctttgaggtgtcagcagctggattggagctagggcttgggctagaagatgagctgcgcatggagccactgggcctggaagggctaaacatgctgagtgacccctgtgccctgctgcctgatcctgctgtggaggagtcattccgcagtgaccggctccaatgagggcacctcatcaccatccctcttcttggccccatcccccaccaccattcctttcctcccttccccctggcaggtagagactctactctctgtccccagatcctctttctagcatgaatgaaggatgccaagaatgagaaaaagcaaggggtttgtccaggtggcccctgaattctgcgcaagggatgggcctgggggaactcaagggagggcctaaagcacttgtaactttgaaccgtctgtctggaggtcagagcctgttggaaagcaggggtagaggggagccctggaagcagggcttttccggatgcctaggggtgggcagtgccagcccctcctcaccactcttccccttgcagtggaggagagagccagagtggatactattttttattaaatatattattatatgttaataaaaaaatcatatcaa

SEQ ID NO: 455880 - DNA, 3029 bp, Homo sapiens
  misc_feature (19)..(19): n is a, c, g, or t
ttaggctaggtacgaggcnggtgtgaatcggccgaggcatgtagtgagaccctcgcgaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacagttacaggcccaaaaactgcgactggcatacacaaggagctctcattatggtgggtctctgcccaatgttaaccagattggctctggcctggccgagttccaggtgagtagaccccagccagggaggagtggagtttcttaggctgcttcctctgctgacttctgtcctttttggcagagccccctccactcacctttggattcatctcggagcactcggcaccatgggctggtggaacgggtgcagcgagatcctcgaagaatggtgtccccacttcgccgatacacccgccacattgacagctctccctatagtcctgcctacttatctcctcccccagagtctagctggcgaaggacgatggcctggggcaatttccctgcagagaaggggcagttgtttcgactaccatctgcacttaacaggacaagctctgactctgcccttcatacaagtgtgatgaaccccagtccccaggatacctacccaggccccacacctcccagcatcctgcccagccgacgtgggggtattctggatggtgaaatggaccccaaagtacctgctattgaggagaacttgctagatgacaagcatttgctgaagccatgggatgctaagaagctatcctcatcctcttcccgacctcggtcctgtgaagtccctggaattaacatctttccatctcctgaccagcctgccaatgtgcctgtcctcccacctgccatgaacacggggggctccctacctgacctcaccaacctgcactttcccccaccactgcccacccccctggaccctgaagagacagcctaccctagcctgagtgggggcaacagtacctccaatttgacccacaccatgactcacctgggcatcagcaggggcatgggcctgggcccaggctatgatgcaccaggacttcattcacctctcagccacccatccctgcagtcctccctaagcaatcccaacctccaggcttccctgagcagtcctcagccccagcttcagggctcccacagccacccctctctgcctgcctcctccttggcccgccatgtactgcccaccacctccctgggccacccctcactcagtgctccggctctctcctcctcctcttcctcctcctccacttcatctcctgttttgggcgccccctcttaccctgcttctacccctggggcctccccccaccaccgccgtgtgcccctcagccccctgagtttgctcgcgggcccagccgacgccagaaggtcccaacagcagctgcccaaacagttttcgccaacaatgtcacccaccttgtcttccatcactcagggcgtccccctggataccagtaaactgtccactgaccagcggttacccccatacccatacagctccccaagtctggttctgcctacccagccccacaccccaaagtctctacagcagccagggctgccctctcagtcttgttcagtgcagtcctcaggtgggcagcccccaggcaggcagtctcattatgggacaccgtacccacctgggcccagtgggcatgggcaacagtcttaccaccggccaatgagtgacttcaacctggggaatctggagcagttcagcatggagagcccatcagccagcctggtgctggatccccctggcttttctgaagggcctggatttttagggggtgaggggccaatgggtggcccccaggatccccacaccttcaaccaccagaacttgacccactgttcccgccatggctcagggcctaacatcatcctcacaggggactcctctccaggtttctctaaggagattgcagcagccctggccggagtgcctggctttgaggtgtcagcagctggattggagctagggcttgggctagaagatgagctgcgcatggagccactgggcctggaagggctaaacatgctgagtgacccctgtgccctgctgcctgatcctgctgtggaggagtcattccgcagtgaccggctccaatgagggcacctcatcaccatccctcttcttggccccatcccccaccaccattcctttcctcccttccccctggcaggtagagactctactctctgtccccagatcctctttctagcatgaatgaaggatgccaagaatgagaaaaagcaaggggtttgtccaggtggcccctgaattctgcgcaagggatgggcctgggggaactcaagggagggcctaaagcacttgtaactttgaaccgtctgtctggaggtcagagcctgttggaaagcaggggtagaggggagccctggaagcagggcttttccggatgcctaggggtgggcagtgccagcccctcctcaccactcttccccttgcagtggaggagagagccagagtggatactattttttattaaatatattattatatgttaataaaaaaatcatatcaa

SEQ ID NO: 455881 - DNA, 2544 bp, Homo sapiens
gagcaggggacgcgggcgccgccgtttgggaggcgcaggttgagggccgaggggcaggaagaaggattttgccgggggagaccgaaacaccggagaggttcggggtgtagaggcgactgggggccgagtacgtgaggtgggagtgggcggagaggggagatgaagtccggcggaggtaggagttacaggcccaaaaactgcgactggcatacacaaggagctctcattatggtgggtctctgcccaatgttaaccagattggctctggcctggccgagttccagagccccctccactcacctttggattcatctcggagcactcggcaccatgggctggtggaacgggtgcagcgagatcctcgaagaatggtgtccccacttcgccgatacacccgccacattgacagctctccctatagtcctgcctacttatctcctcccccagagtctagctggcgaaggacgatggcctggggcaatttccctgcagagaaggggcagttgtttcgactaccatctgcacttaacaggacaagctctgactctgcccttcatacaagtgtgatgaaccccagtccccaggatacctacccaggccccacacctcccagcatcctgcccagccgacgtgggggtattctggatggtgaaatggaccccaaagtacctgctattgaggagaacttgctagatgacaagcatttgctgaagccatgggatgctaagaagctatcctcatcctcttcccgacctcggtcctgtgaagtccctggaattaacatctttccatctcctgaccagcctgccaatgtgcctgtcctcccacctgccatgaacacggggggctccctacctgacctcaccaacctgcactttcccccaccactgcccacccccctggaccctgaagagacagcctaccctagcctgagtgggggcaacagtacctccaatttgacccacaccatgactcacctgggcatcagcaggggcatgggcctgggcccaggctatgatgcaccaggacttcattcacctctcagccacccatccctgcagtcctccctaagcaatcccaacctccaggcttccctgagcagtcctcagccccagcttcagggctcccacagccacccctctctgcctgcctcctccttggcccgccatgtactgcccaccacctccctgggccacccctcactcagtgctccggctctctcctcctcctcttcctcctcctccacttcatctcctgttttgggcgccccctcttaccctgcttctacccctggggcctccccccaccaccgccgtgtgcccctcagccccctgagtttgctcgcgggcccagccgacgccagaaggtcccaacagcagctgcccaaacagttttcgccaacaatgtcacccaccttgtcttccatcactcagggcgtccccctggataccagtaaactgtccactgaccagcggttacccccatacccatacagctccccaagtctggttctgcctacccagccccacaccccaaagtctctacagcagccagggctgccctctcagtcttgttcagtgcagtcctcaggtgggcagcccccaggcaggcagtctcattatgggacaccgtacccacctgggcccagtgggcatgggcaacagtcttaccaccggccaatgagtgacttcaacctggggaatctggagcagttcagcatggagagcccatcagccagcctggtgctggatccccctggcttttctgaagggcctggatttttagggggtgaggggccaatgggtggcccccaggatccccacaccttcaaccaccagaacttgacccactgttcccgccatggctcagggcctaacatcatcctcacaggggactcctctccaggtttctctaaggagattgcagcagccctggccggagtgcctggctttgaggtgtcagcagctggattggagctagggcttgggctagaagatgagctgcgcatggagccactgggcctggaagggctaaacatgctgagtgacccctgtgccctgctgcctgatcctgctgtggaggagtcattccgcagtgaccggctccaatgagggcacctcatcaccatccctcttcttggccccatcccccaccaccattcctttcctcccttccccctggcaggtagagactctactctctgtccccagatcctctttctagcatgaatgaaggatgccaagaatgagaaaaagcaaggggtttgtccaggtggcccctgaattctgcgcaagggatgggcctgggggaactcaagggagggcctaaagcacttgtaactttgaaccgtctgtctggaggtcagagcctgttggaaagcaggggtagaggggagccctggaagcagggcttttccggatgcctaggggtgggcagtgccagcccctcctcaccactcttccccttgcagtggaggagagagccagagtggatactattttttattaaatatattattatatgttaataaaaaaatcatatcaa

SEQ ID NO: 455882 - DNA, 2459 bp, Homo sapiens
gagcaggggacgcgggcgccgccgtttgggaggcgcaggttgagggccgaggggcaggaagaaggattttgccgggggagaccgaaacaccggagagttacaggcccaaaaactgcgactggcatacacaaggagctctcattatggtgggtctctgcccaatgttaaccagattggctctggcctggccgagttccagagccccctccactcacctttggattcatctcggagcactcggcaccatgggctggtggaacgggtgcagcgagatcctcgaagaatggtgtccccacttcgccgatacacccgccacattgacagctctccctatagtcctgcctacttatctcctcccccagagtctagctggcgaaggacgatggcctggggcaatttccctgcagagaaggggcagttgtttcgactaccatctgcacttaacaggacaagctctgactctgcccttcatacaagtgtgatgaaccccagtccccaggatacctacccaggccccacacctcccagcatcctgcccagccgacgtgggggtattctggatggtgaaatggaccccaaagtacctgctattgaggagaacttgctagatgacaagcatttgctgaagccatgggatgctaagaagctatcctcatcctcttcccgacctcggtcctgtgaagtccctggaattaacatctttccatctcctgaccagcctgccaatgtgcctgtcctcccacctgccatgaacacggggggctccctacctgacctcaccaacctgcactttcccccaccactgcccacccccctggaccctgaagagacagcctaccctagcctgagtgggggcaacagtacctccaatttgacccacaccatgactcacctgggcatcagcaggggcatgggcctgggcccaggctatgatgcaccaggacttcattcacctctcagccacccatccctgcagtcctccctaagcaatcccaacctccaggcttccctgagcagtcctcagccccagcttcagggctcccacagccacccctctctgcctgcctcctccttggcccgccatgtactgcccaccacctccctgggccacccctcactcagtgctccggctctctcctcctcctcttcctcctcctccacttcatctcctgttttgggcgccccctcttaccctgcttctacccctggggcctccccccaccaccgccgtgtgcccctcagccccctgagtttgctcgcgggcccagccgacgccagaaggtcccaacagcagctgcccaaacagttttcgccaacaatgtcacccaccttgtcttccatcactcagggcgtccccctggataccagtaaactgtccactgaccagcggttacccccatacccatacagctccccaagtctggttctgcctacccagccccacaccccaaagtctctacagcagccagggctgccctctcagtcttgttcagtgcagtcctcaggtgggcagcccccaggcaggcagtctcattatgggacaccgtacccacctgggcccagtgggcatgggcaacagtcttaccaccggccaatgagtgacttcaacctggggaatctggagcagttcagcatggagagcccatcagccagcctggtgctggatccccctggcttttctgaagggcctggatttttagggggtgaggggccaatgggtggcccccaggatccccacaccttcaaccaccagaacttgacccactgttcccgccatggctcagggcctaacatcatcctcacaggggactcctctccaggtttctctaaggagattgcagcagccctggccggagtgcctggctttgaggtgtcagcagctggattggagctagggcttgggctagaagatgagctgcgcatggagccactgggcctggaagggctaaacatgctgagtgacccctgtgccctgctgcctgatcctgctgtggaggagtcattccgcagtgaccggctccaatgagggcacctcatcaccatccctcttcttggccccatcccccaccaccattcctttcctcccttccccctggcaggtagagactctactctctgtccccagatcctctttctagcatgaatgaaggatgccaagaatgagaaaaagcaaggggtttgtccaggtggcccctgaattctgcgcaagggatgggcctgggggaactcaagggagggcctaaagcacttgtaactttgaaccgtctgtctggaggtcagagcctgttggaaagcaggggtagaggggagccctggaagcagggcttttccggatgcctaggggtgggcagtgccagcccctcctcaccactcttccccttgcagtggaggagagagccagagtggatactattttttattaaatatattattatatgttaataaaaaaatcatatcaa

SEQ ID NO: 455883 - DNA, 2523 bp, Homo sapiens
atcctggtgacagagatggcaaggatggctgaaggaaatagtgctcaggaccctcctgacattcccacttgttccccatgtctcagttacaggcccaaaaactgcgactggcatacacaaggagctctcattatggtgggtctctgcccaatgttaaccagattggctctggcctggccgagttccaggtgagtagaccccagccagggaggagtggagtttcttaggctgcttcctctgctgacttctgtcctttttggcagagccccctccactcacctttggattcatctcggagcactcggcaccatgggctggtggaacgggtgcagcgagatcctcgaagaatggtgtccccacttcgccgatacacccgccacattgacagctctccctatagtcctgcctacttatctcctcccccagagtctagctggcgaaggacgatggcctggggcaatttccctgcagagaaggggcagttgtttcgactaccatctgcacttaacaggacaagctctgactctgcccttcatacaagtgtgatgaaccccagtccccaggatacctacccaggccccacacctcccagcatcctgcccagccgacgtgggggtattctggatggtgaaatggaccccaaagtacctgctattgaggagaacttgctagatgacaagcatttgctgaagccatgggatgctaagaagctatcctcatcctcttcccgacctcggtcctgtgaagtccctggaattaacatctttccatctcctgaccagcctgccaatgtgcctgtcctcccacctgccatgaacacggggggctccctacctgacctcaccaacctgcactttcccccaccactgcccacccccctggaccctgaagagacagcctaccctagcctgagtgggggcaacagtacctccaatttgacccacaccatgactcacctgggcatcagcaggggcatgggcctgggcccaggctatgatgcaccaggacttcattcacctctcagccacccatccctgcagtcctccctaagcaatcccaacctccaggcttccctgagcagtcctcagccccagcttcagggctcccacagccacccctctctgcctgcctcctccttggcccgccatgtactgcccaccacctccctgggccacccctcactcagtgctccggctctctcctcctcctcttcctcctcctccacttcatctcctgttttgggcgccccctcttaccctgcttctacccctggggcctccccccaccaccgccgtgtgcccctcagccccctgagtttgctcgcgggcccagccgacgccagaaggtcccaacagcagctgcccaaacagttttcgccaacaatgtcacccaccttgtcttccatcactcagggcgtccccctggataccagtaaactgtccactgaccagcggttacccccatacccatacagctccccaagtctggttctgcctacccagccccacaccccaaagtctctacagcagccagggctgccctctcagtcttgttcagtgcagtcctcaggtgggcagcccccaggcaggcagtctcattatgggacaccgtacccacctgggcccagtgggcatgggcaacagtcttaccaccggccaatgagtgacttcaacctggggaatctggagcagttcagcatggagagcccatcagccagcctggtgctggatccccctggcttttctgaagggcctggatttttagggggtgaggggccaatgggtggcccccaggatccccacaccttcaaccaccagaacttgacccactgttcccgccatggctcagggcctaacatcatcctcacaggggactcctctccaggtttctctaaggagattgcagcagccctggccggagtgcctggctttgaggtgtcagcagctggattggagctagggcttgggctagaagatgagctgcgcatggagccactgggcctggaagggctaaacatgctgagtgacccctgtgccctgctgcctgatcctgctgtggaggagtcattccgcagtgaccggctccaatgagggcacctcatcaccatccctcttcttggccccatcccccaccaccattcctttcctcccttccccctggcaggtagagactctactctctgtccccagatcctctttctagcatgaatgaaggatgccaagaatgagaaaaagcaaggggtttgtccaggtggcccctgaattctgcgcaagggatgggcctgggggaactcaagggagggcctaaagcacttgtaactttgaaccgtctgtctggaggtcagagcctgttggaaagcaggggtagaggggagccctggaagcagggcttttccggatgcctaggggtgggcagtgccagcccctcctcaccactcttccccttgcagtggaggagagagccagagtggatactattttttattaaatatattattatatgttaataaaaaaatcatatcaa

SEQ ID NO: 455884 - DNA, 2979 bp, Homo sapiens
  misc_feature (19)..(19): n is a, c, g, or t
ttaggctaggtacgaggcnggtgtgaatcggccgaggcatgtagtgagaccctcgcgaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacagttacaggcccaaaaactgcgactggcatacacaaggagctctcattatggtgggtctctgcccaatgttaaccagattggctctggcctggccgagttccagagccccctccactcacctttggattcatctcggagcactcggcaccatgggctggtggaacgggtgcagcgagatcctcgaagaatggtgtccccacttcgccgatacacccgccacattgacagctctccctatagtcctgcctacttatctcctcccccagagtctagctggcgaaggacgatggcctggggcaatttccctgcagagaaggggcagttgtttcgactaccatctgcacttaacaggacaagctctgactctgcccttcatacaagtgtgatgaaccccagtccccaggatacctacccaggccccacacctcccagcatcctgcccagccgacgtgggggtattctggatggtgaaatggaccccaaagtacctgctattgaggagaacttgctagatgacaagcatttgctgaagccatgggatgctaagaagctatcctcatcctcttcccgacctcggtcctgtgaagtccctggaattaacatctttccatctcctgaccagcctgccaatgtgcctgtcctcccacctgccatgaacacggggggctccctacctgacctcaccaacctgcactttcccccaccactgcccacccccctggaccctgaagagacagcctaccctagcctgagtgggggcaacagtacctccaatttgacccacaccatgactcacctgggcatcagcaggggcatgggcctgggcccaggctatgatgcaccaggacttcattcacctctcagccacccatccctgcagtcctccctaagcaatcccaacctccaggcttccctgagcagtcctcagccccagcttcagggctcccacagccacccctctctgcctgcctcctccttggcccgccatgtactgcccaccacctccctgggccacccctcactcagtgctccggctctctcctcctcctcttcctcctcctccacttcatctcctgttttgggcgccccctcttaccctgcttctacccctggggcctccccccaccaccgccgtgtgcccctcagccccctgagtttgctcgcgggcccagccgacgccagaaggtcccaacagcagctgcccaaacagttttcgccaacaatgtcacccaccttgtcttccatcactcagggcgtccccctggataccagtaaactgtccactgaccagcggttacccccatacccatacagctccccaagtctggttctgcctacccagccccacaccccaaagtctctacagcagccagggctgccctctcagtcttgttcagtgcagtcctcaggtgggcagcccccaggcaggcagtctcattatgggacaccgtacccacctgggcccagtgggcatgggcaacagtcttaccaccggccaatgagtgacttcaacctggggaatctggagcagttcagcatggagagcccatcagccagcctggtgctggatccccctggcttttctgaagggcctggatttttagggggtgaggggccaatgggtggcccccaggatccccacaccttcaaccaccagaacttgacccactgttcccgccatggctcagggcctaacatcatcctcacaggggactcctctccaggtttctctaaggagattgcagcagccctggccggagtgcctggctttgaggtgtcagcagctggattggagctagggcttgggctagaagatgagctgcgcatggagccactgggcctggaagggctaaacatgctgagtgacccctgtgccctgctgcctgatcctgctgtggaggagtcattccgcagtgaccggctccaatgagggcacctcatcaccatccctcttcttggccccatcccccaccaccattcctttcctcccttccccctggcaggtagagactctactctctgtccccagatcctctttctagcatgaatgaaggatgccaagaatgagaaaaagcaaggggtttgtccaggtggcccctgaattctgcgcaagggatgggcctgggggaactcaagggagggcctaaagcacttgtaactttgaaccgtctgtctggaggtcagagcctgttggaaagcaggggtagaggggagccctggaagcagggcttttccggatgcctaggggtgggcagtgccagcccctcctcaccactcttccccttgcagtggaggagagagccagagtggatactattttttattaaatatattattatatgttaataaaaaaatcatatcaatacaataaaacaaacctttctctgc

SEQ ID NO: 455885 - DNA, 2205 bp, Homo sapiens
atccacctgcctcggcctcccaaagtgctgggattacaggcatgagccaccatacccggcctccatggagctatttaaagcaggtaggcaagtgagcactgcagccaatgccactgtatcccttgcaggtattctggatggtgaaatggaccccaaaggtatgtgttcctcactgctgtgggtactgaatgccaaagaatttctgggctggtgttgggattgtgtgcaggttcagggagcaggactccttcccacctgcttctgcttcctgtcctgccttactggctctttctccaactctcccatcaccagtctttctctttcaagtacctgctattgaggagaacttgctagatgacaagcatttgctgaagccatgggatgctaagaagctatcctcatcctcttcccgacctcggtcctgtgaagtccctggaattaacatctttccatctcctgaccagcctgccaatgtgcctgtcctcccacctgccatgaacacggggggctccctacctgacctcaccaacctgcactttcccccaccactgcccacccccctggaccctgaagagacagcctaccctagcctgagtgggggcaacagtacctccaatttgacccacaccatgactcacctgggcatcagcaggggcatgggcctgggcccaggctatgatgcaccaggacttcattcacctctcagccacccatccctgcagtcctccctaagcaatcccaacctccaggcttccctgagcagtcctcagccccagcttcagggctcccacagccacccctctctgcctgcctcctccttggcccgccatgtactgcccaccacctccctgggccacccctcactcagtgctccggctctctcctcctcctcttcctcctcctccacttcatctcctgttttgggcgccccctcttaccctgcttctacccctggggcctccccccaccaccgccgtgtgcccctcagccccctgagtttgctcgcgggcccagccgacgccagaaggtcccaacagcagctgcccaaacagttttcgccaacaatgtcacccaccttgtcttccatcactcagggcgtccccctggataccagtaaactgtccactgaccagcggttacccccatacccatacagctccccaagtctggttctgcctacccagccccacaccccaaagtctctacagcagccagggctgccctctcagtcttgttcagtgcagtcctcaggtgggcagcccccaggcaggcagtctcattatgggacaccgtacccacctgggcccagtgggcatgggcaacagtcttaccaccggccaatgagtgacttcaacctggggaatctggagcagttcagcatggagagcccatcagccagcctggtgctggatccccctggcttttctgaagggcctggatttttagggggtgaggggccaatgggtggcccccaggatccccacaccttcaaccaccagaacttgacccactgttcccgccatggctcagggcctaacatcatcctcacaggggactcctctccaggtttctctaaggagattgcagcagccctggccggagtgcctggctttgaggtgtcagcagctggattggagctagggcttgggctagaagatgagctgcgcatggagccactgggcctggaagggctaaacatgctgagtgacccctgtgccctgctgcctgatcctgctgtggaggagtcattccgcagtgaccggctccaatgagggcacctcatcaccatccctcttcttggccccatcccccaccaccattcctttcctcccttccccctggcaggtagagactctactctctgtccccagatcctctttctagcatgaatgaaggatgccaagaatgagaaaaagcaaggggtttgtccaggtggcccctgaattctgcgcaagggatgggcctgggggaactcaagggagggcctaaagcacttgtaactttgaaccgtctgtctggaggtcagagcctgttggaaagcaggggtagaggggagccctggaagcagggcttttccggatgcctaggggtgggcagtgccagcccctcctcaccactcttccccttgcagtggaggagagagccagagtggatactattttttattaaatatattattatatgttaataaaaaaatcatatcaa

SEQ ID NO: 455886 - DNA, 1870 bp, Homo sapiens
ccagggttctctgctgagcactgtcctcattttccatattctcccttctctcctcagctatcctcatcctcttcccgacctcggtcctgtgaagtccctggaattaacatctttccatctcctgaccagcctgccaatgtgcctgtcctcccacctgccatgaacacggggggctccctacctgacctcaccaacctgcactttcccccaccactgcccacccccctggaccctgaagagacagcctaccctagcctgagtgggggcaacagtacctccaatttgacccacaccatgactcacctgggcatcagcaggggcatgggcctgggcccaggctatgatgcaccaggacttcattcacctctcagccacccatccctgcagtcctccctaagcaatcccaacctccaggcttccctgagcagtcctcagccccagcttcagggctcccacagccacccctctctgcctgcctcctccttggcccgccatgtactgcccaccacctccctgggccacccctcactcagtgctccggctctctcctcctcctcttcctcctcctccacttcatctcctgttttgggcgccccctcttaccctgcttctacccctggggcctccccccaccaccgccgtgtgcccctcagccccctgagtttgctcgcgggcccagccgacgccagaaggtcccaacagcagctgcccaaacagttttcgccaacaatgtcacccaccttgtcttccatcactcagggcgtccccctggataccagtaaactgtccactgaccagcggttacccccatacccatacagctccccaagtctggttctgcctacccagccccacaccccaaagtctctacagcagccagggctgccctctcagtcttgttcagtgcagtcctcaggtgggcagcccccaggcaggcagtctcattatgggacaccgtacccacctgggcccagtgggcatgggcaacagtcttaccaccggccaatgagtgacttcaacctggggaatctggagcagttcagcatggagagcccatcagccagcctggtgctggatccccctggcttttctgaagggcctggatttttagggggtgaggggccaatgggtggcccccaggatccccacaccttcaaccaccagaacttgacccactgttcccgccatggctcagggcctaacatcatcctcacaggggactcctctccaggtttctctaaggagattgcagcagccctggccggagtgcctggctttgaggtgtcagcagctggattggagctagggcttgggctagaagatgagctgcgcatggagccactgggcctggaagggctaaacatgctgagtgacccctgtgccctgctgcctgatcctgctgtggaggagtcattccgcagtgaccggctccaatgagggcacctcatcaccatccctcttcttggccccatcccccaccaccattcctttcctcccttccccctggcaggtagagactctactctctgtccccagatcctctttctagcatgaatgaaggatgccaagaatgagaaaaagcaaggggtttgtccaggtggcccctgaattctgcgcaagggatgggcctgggggaactcaagggagggcctaaagcacttgtaactttgaaccgtctgtctggaggtcagagcctgttggaaagcaggggtagaggggagccctggaagcagggcttttccggatgcctaggggtgggcagtgccagcccctcctcaccactcttccccttgcagtggaggagagagccagagtggatactattttttattaaatatattattatatgttaataaaaaaatcatatcaa

SEQ ID NO: 455887 - DNA, 2511 bp, Homo sapiens
  misc_feature (19)..(19): n is a, c, g, or t
ttaggctaggtacgaggcnggtgtgaatcggccgaggcatgtagtgagaccctcgcgaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacagttacaggcccaaaaactgcgactggcatacacaaggagctctcattatggtgggtctctgcccaatgttaaccagattggctctggcctggccgagttccagagccccctccactcacctttggattcatctcggagcactcggcaccatgggctggtggaacgggtgcagcgagatcctcgaagaatggtgtccccacttcgccgatacacccgccacattgacagctctccctatagtcctgcctacttatctcctcccccagagtctagctggcgaaggacgatggcctggggcaatttccctgcagagaaggggcagttgtttcgactaccatctgcacttaacaggacaagctctgactctgcccttcatacaagtgtgatgaaccccagtccccaggatacctacccaggccccacacctcccagcatcctgcccagccgacgtgggggtattctggatggtgaaatggaccccaaagtacctgctattgaggagaacttgctagatgacaagcatttgctgaagccatgggatgctaagaagctatcctcatcctcttcccgacctcggtcctgtgaagtccctggaattaacatctttccatctcctgaccagcctgccaatgtgcctgtcctcccacctgccatgaacacggggggctccctacctgacctcaccaacctgcactttcccccaccactgcccacccccctggaccctgaagagacagcctaccctagcctgagtgggggcaacagtacctccaatttgacccacaccatgactcacctgggcatcagcaggggcatgggcctgggcccaggctatgatgcaccaggacttcattcacctctcagccacccatccctgcagtcctccctaagcaatcccaacctccaggcttccctgagcagtcctcagccccagcttcagggctcccacagccacccctctctgcctgcctcctccttggcccgccatgtactgcccaccacctccctgggccacccctcactcagtgctccggctctctcctcctcctcttcctcctcctccacttcatctcctgttttgggcgccccctcttaccctgcttctacccctggggcctccccccaccaccgccgtgtgcccctcagccccctgagtttgctcgcgggcccagccgacgccagaaggtcccaacagcagctgcccaaacagttttcgccaacaatgtcacccaccttgtcttccatcactcagggcgtccccctggataccagtaaactgtccactgaccagcggttacccccatacccatacagctccccaagtctggttctgcctacccagccccacaccccaaagtctctacagcagccagggctgccctctcagtcttgttcagtgcagtcctcaggtgggcagcccccaggcaggcagtctcattatgggacaccgtacccacctgggcccagtgggcatgggcaacagtcttaccaccggccaatgagtgacttcaacctggggaatctggagcagttcagcatggagagcccatcagccagcctggtgctggatccccctggcttttctgaagggcctggatttttagggggtgaggggccaatgggtggcccccaggatccccacaccttcaaccaccagaacttgacccactgttcccgccatggctcagggcctaacatcatcctcacaggggactcctctccaggtttctctaaggagattgcagcagccctggccggagtgcctggctttgaggtgtcagcagctggattggagctagggcttgggctagaagatgagctgcgcatggagccactggcgggaacagtgggtcaagttctggtggttgaaggtgtggggatcctgggggccacccattggcccctcacccccgccgtcta

SEQ ID NO: 455888 - DNA, 1476 bp, Homo sapiens
  misc_feature (19)..(19): n is a, c, g, or t
ttaggctaggtacgaggcnggtgtgaatcggccgaggcatgtagtgagaccctcgcgaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacagttacaggcccaaaaactgcgactggcatacacaaggagctctcattatggtgggtctctgcccaatgttaaccagattggctctggcctggccgagttccagagccccctccactcacctttggattcatctcggagcactcggcaccatgggctggtggaacgggtgcagcgagatcctcgaagaatggtgtccccacttcgccgatacacccgccacattgacagctctccctatagtcctgcctacttatctcctcccccagagtctagctggcgaaggacgatggcctggggcaatttccctgcagagaaggggcagttgtttcgactaccatctgcacttaacaggacaagctctgactctgcccttcatacaagtgtgatgaaccccagtccccaggatacctacccaggccccacacctcccagcatcctgcccagccgacgtgggggtattctggatggtgaaatggaccccaaagtacctgctattgaggagaacttgctagatgacaagcatttgctgaagccatgggatgctaagaagctatcctcatcctcttcccgacctcggtcctgtgaagtccctggaattaacatctttccatctcctgaccagcctgccaatgtgcctgtcctcccacctgccatgaacacggggggctccctacctgacctcaccaacctgcactttcccccaccactgcccacccccctggaccctgaagagacagcctaccctagcctgagtgggggcaacagtacctccaatttgacccacaccatgactcacctgggcatcagcaggggcatgggcctgggcccaggctatgatgcaccagacttcattcacctctcagagaggccagtgtgcttcggttg

SEQ ID NO: 455889 - DNA, 1003 bp, Homo sapiens
  misc_feature (19)..(19): n is a, c, g, or t
ttaggctaggtacgaggcnggtgtgaatcggccgaggcatgtagtgagaccctcgcgaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacagttacaggcccaaaaactgcgactggcatacacaaggagctctcattatggtgggtctctgcccaatgttaaccagattggctctggcctggccgagttccagagccccctccactcacctttggattcatctcggagcactcggcaccatgggctggtggaacgggtgcagcgagatcctcgaagaatggtgtccccacttcgccgatacacccgccacattgacagctctccctatagtcctgcctaatatgtccttccccaaagtctactgcgaagacgggctcggcaatcctcagagggatggttgacaccgcttttagaggacgtgattcccataagggacagaccagtatacgggcaacaatcacgtgttggagcgaaccacactaacgaaagaaagaaggaaacc

SEQ ID NO: 455890 - DNA, 475 bp, Homo sapiens
cgtgttgaggggttgcaataagtaattaccagtctccaatcagtgcccttcgtggtcatccctcttcttggccccatcccccaccaccattcctttcctcccttccccctggcaggtagagactctactctctgtccccagatcctctttctagcatgaatgaaggatgccaagaatgagaaaaagcaaggggtttgtccaggtggcccctgaattctgcgcaagggatgggcctgggggaactcaagggagggcctaaagcacttgtaactttgaaccgtctgtctggaggtcagagcctgttggaaagcaggggtagaggggagccctggaagcagggcttttccggatgcctaggggtgggcagtgccagcccctcctcaccactcttccccttgcagtggaggagagagccagagtggatactattttttattaaatatattattatatgttaataaaaaaatcatatcaa

SEQ ID NO: 455891 - DNA, 500 bp, Homo sapiens
atgactcacctgggcatcagcaggggcatgggcctgggcccaggctatgatgcaccaggtgagtgactgtcctggccatgtgcccactgggtgctgcctgactggagggatgaaggggaggtaggtttgagcacctgagatcctgctgtgatcacccacaccgcctgtcacctctgcaccccaggattccctcacggcagttctcagccagtgataactggtaggtgtggtgtttcctagaaagaagaggaagggcagtccccagatgggcagtgctgtcagggatagagtagggaggacgttgtgttgccgctttcatagtctggtcactgccacccattctgggtggaaaggggctcagttcccatcagtaatgttggcatctctggttttttgtctgtgcctgcaggacttcattcacctctcagccacccatccctgcagtcctccctaagcaatcccaacctccaggcttccctgagcagtcctcagccccagct

SEQ ID NO: 455892 - DNA, 2435 bp, Homo sapiens
  misc_feature (4)..(4): n is a, c, g, or t
  misc_feature (6)..(8): n is a, c, g, or t
ggcngnnnaggagagtcaggccaatggggccgcagttctttcttttttttttctttattcttatttttggagacagggtctcgctctgttgcccaggctggagtgcggtggtgcgatcacggttccatgcagcccccgacctcccgggctcaggtgattctcccgcctcagcaccgcgagcagctaggaccacaggcgcgagccactgcgtccggccggcgggacttatttgtcaggcggggattgggttccgccagcctaaagggaggggtaagcgccagaatatgaatcgccgggaagctgggagaaagctccgggaaaccctgagcagccaggtcgcctgctccgcccgctcccgctcccgatctctgattgctcctaactgacgtcactcccggtctgtccccgcccactcggtgctgccattggcagtcggtcgtgggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctgccacttggagtggacccctcctactcttcttagcgcctaccctcatacctatctccctcctcccatctcctaggggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctaga

SEQ ID NO: 455893 - DNA, 594 bp, Homo sapiens
tcagacgctgaactatgtggtccagaatgtctacatgtgtccaactataaagtgatgactataagaaagggaaagttgctttaaggacgacctcagtatctggcacactctggcaactgaagcccagagctgaagcataaaaccaaaggaaacaaaaagcagtctcagagcatatgagaaatcaaagaggtttcttatataccgcagatagcaattttaaaaatcagtatttttaagctcagagcattggatgccaacaacacatagttcagcgtctgactcagacgctgaactatgtgcaggggactcctctccaggtttctctaaggagattgcagcagccctggccggagtgcctggctttgaggtgtcagcagctggattggagctagggcttgggctagaagatgagctgcgcatggagccactgggcctggaagggctaaacatgctgagtgacccctgtgccctgctgcctgatcctgctgtggaggagtcattccgcagtgaccggctccaatgagggcacctcatcaccatccctcttcttggccccatcccccaccaccacatagttaagcgtctgacggtacc

SEQ ID NO: 455894 - DNA, 2721 bp, Homo sapiens
cagcggggtccatgtcggctgcccaggcctccccgggcccgggaacaggagtcccagctcacgcattcttcatctgcttcccgcgacgcttggcggcctcgcaccccgcctcctggagcccggactttcaggcaccgccctcagtgtcgcctcagtccgtcccgggaccgcagactcttagggcccctctctttggccatctgcctctaggtcccatcctggggcctgaagcgcttgttctctgcgctgggaaaaggggaacgatggagcgatccagcacccaaacttaccctgtccaggtggcccacgaagctacccaagacatctctgcacagccctagcctttttggcttcacccactccgttcgggagttggggacccggcctctacattccttaggggaactccagctccaggtcctatttggaggcggctcctagtttcctagttttctgggggcaccaggtgaaagggtgatgagatatccatacagcctttctcatgcctcggtttcccccgtgcagtctccctgaataagtcacttgggaaagaaagtgtgagaagagaggaatgttcctggtacaggagtagatgagtcaccctgggtaggggaaggtcacaaagtggctggggccagggagctgcactctgctgaccaagcttccccattccttgccccatcttcctttgcatgatttttcccaaccactctggtctgtcttcctaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctgccacttggagtggacccctcctactcttcttagcgcctaccctcatacctatctccctcctcccatctcctaggggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctaga

SEQ ID NO: 455895 - DNA, 2292 bp, Homo sapiens
cagcggggtccatgtcggctgcccaggcctccccgggcccgggaacaggagtcccagctcacgcattcttcatctgcttcccgcgacgcttggcggcctcgcaccccgcctcctggagcccggactttcaggcaccgccctcagtgtcgcctcagtccgtcccgggaccgcagactcttagggcccctctctttggccatctgcctctaggtcccatcctggggcctgaagcgcttgttctctgcgctgggaaaaggggaacgatggagcgatccagcacccaaacttaccctgtccaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctgccacttggagtggacccctcctactcttcttagcgcctaccctcatacctatctccctcctcccatctcctaggggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctaga

SEQ ID NO: 455896 - DNA, 2575 bp, Homo sapiens
  misc_feature (19)..(19): n is a, c, g, or t
  misc_feature (2061)..(2061): n is a, c, g, or t
  misc_feature (2064)..(2064): n is a, c, g, or t
  misc_feature (2066)..(2067): n is a, c, g, or t
  misc_feature (2070)..(2070): n is a, c, g, or t
  misc_feature (2072)..(2072): n is a, c, g, or t
ttaggctaggtacgaggcnggtgtgaatcggccgaggcatgtagtgagaccctcgcgaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctgccacttggagtggacccctcctactcttcttagcgcctaccctcatacctatctccctcctcccatctcctaggggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctagaaaaaaaaanaanannaananaaaaaaaaaaaaaaaaaaaaaaaaagagggggggcgccgcgcaaaaaaatatccccccgagggggcccaaactcggcggcaccccaggttttgtggggacaaagggggccccaaaaaggggggctaaaaaaaagaagggagggggcggggatattatataaaaagaggcttgtagaagtggggaaaaaagcgggtcaagaactgaggagaacactttgtggagaagaaggagaccatatatcacggtagggggggaggagcgaaaaataattggtgggcaaaaaatatcactcataagaaaagagttttaagacaggtccttgatgaagggggaacaatataatagaaacctttttaagagagggtgttattaggtggggtggtgtaaaacaccaagggcggggatatttatgtagctggagcgataattggaaaagagattgtgtggcctaaataggggtgtagataatattttgggaaaaaattttttattaccggggagt

SEQ ID NO: 455897 - DNA, 2022 bp, Homo sapiens
  misc_feature (19)..(19): n is a, c, g, or t
ttaggctaggtacgaggcnggtgtgaatcggccgaggcatgtagtgagaccctcgcgaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctgccacttggagtggacccctcctactcttcttagcgcctaccctcatacctatctccctcctcccatctcctaggggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctaga

SEQ ID NO: 455898 - DNA, 1872 bp, Homo sapiens
  misc_feature (19)..(19): n is a, c, g, or t
ttaggctaggtacgaggcnggtgtgaatcggccgaggcatgtagtgagaccctcgcgaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctaga

SEQ ID NO: 455899 - DNA, 1790 bp, Homo sapiens
  misc_feature (19)..(19): n is a, c, g, or t
  misc_feature (1616)..(1616): n is a, c, g, or t
  misc_feature (1619)..(1619): n is a, c, g, or t
  misc_feature (1621)..(1621): n is a, c, g, or t
  misc_feature (1634)..(1634): n is a, c, g, or t
  misc_feature (1661)..(1661): n is a, c, g, or t
ttaggctaggtacgaggcnggtgtgaatcggccgaggcatgtagtgagaccctcgcgaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctgccacttggagtggacccctcctactcttcttagcgcctaccctcatacctatctccctcctcccatctcctaggggactggcgccaaatggtctctccctgccaattttggtatcttctctggcctctcagcnctnanctcatttaagtgnaaaaatccttcctttcaagcagatggnggcctccagacctagagggggcgtggccattggcccgacgggggcaaattgggccggaggcggggcgccactgggcccaatgggggtgggcgaaaagggatacaccacacgagagcgccggggggggaa

SEQ ID NO: 455900 - DNA, 1226 bp, Homo sapiens
  misc_feature (19)..(19): n is a, c, g, or t
ttaggctaggtacgaggcnggtgtgaatcggccgaggcatgtagtgagaccctcgcgaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggacctaaaagttctctggcacacattatggaggggatcctctacgatcactca

SEQ ID NO: 455901 - DNA, 2680 bp, Homo sapiens
acaattcccggcggcccccgcgcgcaacaggtcagggctaggctggggccgggttcgcggtgctcgctgaggcggcggtggctacggctggaggagccgggccgaggccgcggcggaggccgcggctggtactgggagggtggcagggagggacggggaaggaagatggcgacgtcgggggcgaacgggcctggttcggccacggcctcggcttccaatccgcgcaaatttagtgagaagattgcgctgcagaagcagcgtcaggccgaggagacggcggccttcgaggaggtgatgatggacatcggctccacccggttacaggcccaaaaactgcgactggcatacacaaggagctctcattatggtgggtctctgcccaatgttaaccagattggctctggcctggccgagttccagagccccctccactcacctttggattcatctcggagcactcggcaccatgggctggtggaacgggtgcagcgagatcctcgaagaatggtgtccccacttcgccgatacacccgccacattgacagctctccctatagtcctgcctacttatctcctcccccagagtctagctggcgaaggacgatggcctggggcaatttccctgcagagaaggggcagttgtttcgactaccatctgcacttaacaggacaagctctgactctgcccttcatacaagtgtgatgaaccccagtccccaggatacctacccaggccccacacctcccagcatcctgcccagccgacgtgggggtattctggatggtgaaatggaccccaaagtacctgctattgaggagaacttgctagatgacaagcatttgctgaagccatgggatgctaagaagctatcctcatcctcttcccgacctcggtcctgtgaagtccctggaattaacatctttccatctcctgaccagcctgccaatgtgcctgtcctcccacctgccatgaacacggggggctccctacctgacctcaccaacctgcactttcccccaccactgcccacccccctggaccctgaagagacagcctaccctagcctgagtgggggcaacagtacctccaatttgacccacaccatgactcacctgggcatcagcaggggcatgggcctgggcccaggctatgatgcaccaggacttcattcacctctcagccacccatccctgcagtcctccctaagcaatcccaacctccaggcttccctgagcagtcctcagccccagcttcagggctcccacagccacccctctctgcctgcctcctccttggcccgccatgtactgcccaccacctccctgggccacccctcactcagtgctccggctctctcctcctcctcttcctcctcctccacttcatctcctgttttgggcgccccctcttaccctgcttctacccctggggcctccccccaccaccgccgtgtgcccctcagccccctgagtttgctcgcgggcccagccgacgccagaaggtcccaacagcagctgcccaaacagttttcgccaacaatgtcacccaccttgtcttccatcactcagggcgtccccctggataccagtaaactgtccactgaccagcggttacccccatacccatacagctccccaagtctggttctgcctacccagccccacaccccaaagtctctacagcagccagggctgccctctcagtcttgttcagtgcagtcctcaggtgggcagcccccaggcaggcagtctcattatgggacaccgtacccacctgggcccagtgggcatgggcaacagtcttaccaccggccaatgagtgacttcaacctggggaatctggagcagttcagcatggagagcccatcagccagcctggtgctggatccccctggcttttctgaagggcctggatttttagggggtgaggggccaatgggtggcccccaggatccccacaccttcaaccaccagaacttgacccactgttcccgccatggctcagggcctaacatcatcctcacaggggactcctctccaggtttctctaaggagattgcagcagccctggccggagtgcctggctttgaggtgtcagcagctggattggagctagggcttgggctagaagatgagctgcgcatggagccactgggcctggaagggctaaacatgctgagtgacccctgtgccctgctgcctgatcctgctgtggaggagtcattccgcagtgaccggctccaatgagggcacctcatcaccatccctcttcttggccccatcccccaccaccattcctttcctcccttccccctggcaggtagagactctactctctgtccccagatcctctttctagcatgaatgaaggatgccaagaatgagaaaaagcaaggggtttgtccaggtggcccctgaattctgcgcaagggatgggcctgggggaactcaagggagggcctaaagcacttgtaactttgaaccgtctgtctggaggtcagagcctgttggaaagcaggggtagaggggagccctggaagcagggcttttccggatgcctaggggtgggcagtgccagcccctcctcaccactcttccccttgcagtggaggagagagccagagtggatactattttttattaaatatattattatatgttaataaaaaaatcatatcaa

SEQ ID NO: 455902 - DNA, 2547 bp, Homo sapiens
  misc_feature (19)..(19): n is a, c, g, or t
ttaggctaggtacgaggcnggtgtgaatcggccgaggcatgtagtgagaccctcgcgaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacagttacaggcccaaaaactgcgactggcatacacaaggagctctcattatggtgggtctctgcccaatgttaaccagattggctctggcctggccgagttccagagccccctccactcacctttggattcatctcggagcactcggcaccatgggctggtggaacgggtgcagcgagatcctcgaagaatggtgtccccacttcgccgatacacccgccacattgacagctctccctatagtcctgcctacttatctcctcccccagagtctagctggcgaaggacgatggcctggggcaatttccctgcagagaaggggcagttgtttcgactaccatctgcacttaacaggacaagctctgactctgcccttcatacaagtgtgatgaaccccagtccccaggatacctacccaggccccacacctcccagcatcctgcccagccgacgtgggggtattctggatggtgaaatggaccccaaagtacctgctattgaggagaacttgctagatgacaagcatttgctgaagccatgggatgctaagaagctatcctcatcctcttcccgacctcggtcctgtgaagtccctggaattaacatctttccatctcctgaccagcctgccaatgtgcctgtcctcccacctgccatgaacacggggggctccctacctgacctcaccaacctgcactttcccccaccactgcccacccccctggaccctgaagagacagcctaccctagcctgagtgggggcaacagtacctccaatttgacccacaccatgactcacctgggcatcagcaggggcatgggcctgggcccaggctatgatgcaccagggcgtccccctggataccagtaaactgtccactgaccagcggttacccccatacccatacagctccccaagtctggttctgcctacccagccccacaccccaaagtctctacagcagccagggctgccctctcagtcttgttcagtgcagtcctcaggtgggcagcccccaggcaggcagtctcattatgggacaccgtacccacctgggcccagtgggcatgggcaacagtcttaccaccggccaatgagtgacttcaacctggggaatctggagcagttcagcatggagagcccatcagccagcctggtgctggatccccctggcttttctgaagggcctggatttttagggggtgaggggccaatgggtggcccccaggatccccacaccttcaaccaccagaacttgacccactgttcccgccatggctcagggcctaacatcatcctcacaggggactcctctccaggtttctctaaggagattgcagcagccctggccggagtgcctggctttgaggtgtcagcagctggattggagctagggcttgggctagaagatgagctgcgcatggagccactgggcctggaagggctaaacatgctgagtgacccctgtgccctgctgcctgatcctgctgtggaggagtcattccgcagtgaccggctccaatgagggcacctcatcaccatccctcttcttggccccatcccccaccaccattcctttcctcccttccccctggcaggtagagactctactctctgtccccagatcctctttctagcatgaatgaaggatgccaagaatgagaaaaagcaaggggtttgtccaggtggcccctgaattctgcgcaagggatgggcctgggggaactcaagggagggcctaaagcacttgtaactttgaaccgtctgtctggaggtcagagcctgttggaaagcaggggtagaggggagccctggaagcagggcttttccggatgcctaggggtgggcagtgccagcccctcctcaccactcttccccttgcagtggaggagagagccagagtggatactattttttattaaatatattattatatgttaataaaaaaatcatatcaa

SEQ ID NO: 455903 - DNA, 3099 bp, Homo sapiens
  misc_feature (19)..(19): n is a, c, g, or t
ttaggctaggtacgaggcnggtgtgaatcggccgaggcatgtagtgagaccctcgcgaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacagttacaggcccaaaaactgcgactggcatacacaaggagctctcattatggtgggtctctgcccaatgttaaccagattggctctggcctggccgagttccagagccccctccactcacctttggattcatctcggagcactcggcaccatgggctggtggaacgggtgcagcgagatcctcgaagaatggtgtccccacttcgccgatacacccgccacattgacagctctccctatagtcctgcctacttatctcctcccccagagtctagctggcgaaggacgatggcctggggcaatttccctgcagagaaggggcagttgtttcgactaccatctgcacttaacaggacaagctctgactctgcccttcatacaagtgtgatgaaccccagtccccaggatacctacccaggccccacacctcccagcatcctgcccagccgacgtgggggtattctggatggtgaaatggaccccaaagtacctgctattgaggagaacttgctagatgacaagcatttgctgaagccatgggatgctaagaagctatcctcatcctcttcccgacctcggtcctgtgaagtccctggaattaacatctttccatctcctgaccagcctgccaatgtgcctgtcctcccacctgccatgaacacggggggctccctacctgacctcaccaacctgcactttcccccaccactgcccacccccctggaccctgaagagacagcctaccctagcctgagtgggggcaacagtacctccaatttgacccacaccatgactcacctgggcatcagcaggggcatgggcctgggcccaggctatgatgcaccaggacttcattcacctctcagccacccatccctgcagtcctccctaagcaatcccaacctccaggcttccctgagcagtcctcagccccagcttcagggctcccacagccacccctctctgcctgcctcctccttggcccgccatgtactgcccaccacctccctgggccacccctcactcagtgctccggctctctcctcctcctcttcctcctcctccacttcatctcctgttttgggcgccccctcttaccctgcttctacccctggggcctccccccaccaccgccgtgtgcccctcagccccctgagtttgctcgcgggcccagccgacgccagaaggtcccaacagcagctgcccaaacagttttcgccaacaatgtcacccaccttgtcttccatcactcagggcgtccccctggataccagtaaactgtccactgaccagcggttacccccatacccatacagctccccaagtctggttctgcctacccagccccacaccccaaagtctctacagcagccagggctgccctctcagtcttgttcagtgcagtcctcaggtgggcagcccccaggcaggcagtctcattatgggacaccgtacccacctgggcccagtgggcatgggcaacagtcttaccaccggccaatgagtgacttcaacctggggaatctggagcagttcagcatggagagcccatcagccagcctggtgctggatccccctggcttttctgaagggcctggatttttagggggtgaggggccaatgggtggcccccaggatccccacaccttcaaccaccagaacttgacccactgttcccgccatggctcagggcctaacatcatcctcacaggggactcctctccaggtttctctaaggagattgcagcagccctggccggagtgcctggctttgaggtgtcagcagctggattggagctagggcttgggctagaagatgagctgcgcatggagccactgggcctggaagggctaaacatgctgagtgacccctgtgccctgctgcctgatcctgctgtggaggagtcattccgcagtgaccggctccaatgagggcacctcatcaccatccctcttcttggccccatcccccaccaccattcctttcctcccttccccctggcaggtagagactctactctctgtccccagatcctctttctagcatgaatgaaggatgccaagaatgagaaaaagcaaggggtttgtccaggtggcccctgaattctgcgcaagggatgggcctgggggaactcaagggagggcctaaagcacttgtaactttgaaccgtctgtctggaggtcagagcctgttggaaagcaggggtagaggggagccctggaagcagggcttttccggatgcctaggggtgggcagtgccagcccctcctcaccactcttccccttgcagtggaggagagagccagagtggatactattttttattaaatatattattatatgttaataaaaaaatcatatcaaacccttggtgtggttagttatttggggcatggctggggatctagggagttatagggccatgggtctttttatctattaggctttttgcatcttcttagcaccactgtgctttgtggaagggccccacagcctcggaatttgtacc

SEQ ID NO: 455904 - DNA, 2405 bp, Homo sapiens
  misc_feature (19)..(19): n is a, c, g, or t
ttaggctaggtacgaggcnggtgtgaatcggccgaggcatgtagtgagaccctcgcgaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacagttacaggcccaaaaactgcgactggcatacacaaggagctctcattatggtgggtctctgcccaatgttaaccagattggctctggcctggccgagttccagagccccctccactcacctttggattcatctcggagcactcggcaccatgggctggtggaacgggtgcagcgagatcctcgaagaatggtgtccccacttcgccgatacacccgccacattgacagctctccctatagtcctgcctacttatctcctcccccagagtctagctggcgaaggacgatggcctggggcaatttccctgcagagaaggggcagttgtttcgactaccatctgcacttaacaggacaagctctgactctgcccttcatacaagtgtgatgaaccccagtccccaggatacctacccaggccccacacctcccagcatcctgcccagccgacgtgggggtattctggatggtgaaatggaccccaaagtacctgctattgaggagaacttgctagatgacaagcatttgctgaagccatgggatgctaagaagctatcctcatcctcttcccgacctcggtcctgtgaagtccctggaattaacatctttccatctcctgaccagcctgccaatgtgcctgtcctcccacctgccatgaacacggggggctccctacctgacctcaccaacctgcactttcccccaccactgcccacccccctggaccctgaagagacagcctaccctagcctgagtgggggcaacagtacctccaatttgacccacaccatgactcacctgggcatcagcaggggcatgggcctgggcccaggctatgatgcaccaggacttcattcacctctcagccacccatccctgcagtcctccctaagcaatcccaacctccaggcttccctgagcagtcctcagccccagcttcagggctcccacagccacccctctctgcctgcctcctccttggcccgccatgtactgcccaccacctccctgggccacccctcactcagtgctccggctctctcctcctcctcttcctcctcctccacttcatctcctgttttgggcgccccctcttaccctgcttctacccctggggcctccccccaccaccgccgtgtgcccctcagccccctgagtttgctcgcgggcccagccgacgccagaaggtcccaacagcagctgcccaaacagttttcgccaacaatgtcacccaccttgtcttccatcactcagggcgtccccctggataccagtaaactgtccactgaccagcggttacccccatacccatacagctccccaagtctggttctgcctgatcctgctgtggaggagtcattccgcagtgaccggctccaatgagggcacctcatcaccatccctcttcttggccccatcccccaccaccattcctttcctcccttccccctggcaggtagagactctactctctgtccccagatcctctttctagcatgaatgaaggatgccaagaatgagaaaaagcaaggggtttgtccaggtggcccctgaattctgcgcaagggatgggcctgggggaactcaagggagggcctaaagcacttgtaactttgaaccgtctgtctggaggtcagagcctgttggaaagcaggggtagaggggagccctggaagcagggcttttccggatgcctaggggtgggcagtgccagcccctcctcaccactcttccccttgcagtggaggagagagccagagtggatactattttttattaaatatattattatatgttaataaaaaaatcatatcaa

SEQ ID NO: 455905 - DNA, 1998 bp, Homo sapiens
  misc_feature (19)..(19): n is a, c, g, or t
ttaggctaggtacgaggcnggtgtgaatcggccgaggcatgtagtgagaccctcgcgaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacagttacaggcccaaaaactgcgactggcatacacaaggagctctcattatggtgggtctctgcccaatgttaaccagattggctctggcctggccgagttccagagccccctccactcacctttggattcatctcggagcactcggcaccatgggctggtggaacgggtgcagcgagatcctcgaagaatggtgtccccacttcgccgatacacccgccacattgacagctctccctatagtcctgcctacttatctcctcccccagagtctagctggcgaaggacgatggcctggggcaatttccctgcagagaaggggcagttgtttcgactaccatctgcacttaacaggacaagctctgactctgcccttcatacaagtgtgatgaaccccagtccccaggatacctacccaggccccacacctcccagcatcctgcccagccgacgtgggggtattctggatggtgaaatggaccccaaagtacctgctattgaggagaacttgctagatgacaagcatttgctgaagccatgggatgctaagaagctatcctcatcctcttcccgacctcggtcctgtgaagtccctggaattaacatctttccatctcctgaccagcctgccaatgtgcctgtcctcccacctgccatgaacacggggggctccctacctgacctcaccaacctgcactttcccccaccactgcccacccccctggaccctgaagagacagcctaccctagcctgagtgggggcaacagtacctccaatttgacccacaccatgactcacctgggcatcagcaggggcatgggcctgggcccaggctatgatgcaccagggcgtccccctggataccagtaaactgtccactgaccagcggttacccccatacccatacagctccccaagtctggttctgcctgatcctgctgtggaggagtcattccgcagtgaccggctccaatgagggcacctcatcaccatccctcttcttggccccatcccccaccaccattcctttcctcccttccccctggcaggtagagactctactctctgtccccagatcctctttctagcatgaatgaaggatgccaagaatgagaaaaagcaaggggtttgtccaggtggcccctgaattctgcgcaagggatgggcctgggggaactcaagggagggcctaaagcacttgtaactttgaaccgtctgtctggaggtcagagcctgttggaaagcaggggtagaggggagccctggaagcagggcttttccggatgcctaggggtgggcagtgccagcccctcctcaccactcttccccttgcagtggaggagagagccagagtggatactattttttattaaatatattattatatgttaataaaaaaatcatatcaa

SEQ ID NO: 455906 - DNA, 1629 bp, Homo sapiens
acaattcccggcggcccccgcgcgcaacaggtcagggctaggctggggccgggttcgcggtgctcgctgaggcggcggtggctacggctggaggagccgggccgaggccgcggcggaggccgcggctggtacacccatccctgcagtcctccctaagcaatcccaacctccaggcttccctgagcagtcctcagccccagcttcagggctcccacagccacccctctctgcctgcctcctccttggcccgccatgtactgcccaccacctccctgggccacccctcactcagtgctccggctctctcctcctcctcttcctcctcctccacttcatctcctgttttgggcgccccctcttaccctgcttctacccctggggcctccccccaccaccgccgtgtgcccctcagccccctgagtttgctcgcgggcccagccgacgccagaaggtcccaacagcagctgcccaaacagttttcgccaacaatgtcacccaccttgtcttccatcactcagggcgtccccctggataccagtaaactgtccactgaccagcggttacccccatacccatacagctccccaagtctggttctgcctacccagccccacaccccaaagtctctacagcagccagggctgccctctcagtcttgttcagtgcagtcctcaggtgggcagcccccaggcaggcagtctcattatgggacaccgtacccacctgggcccagtgggcatgggcaacagtcttaccaccggccaatgagtgacttcaacctggggaatctggagcagttcagcatggagagcccatcagccagcctggtgctggatccccctggcttttctgaagggcctggatttttagggggtgaggggccaatgggtggcccccaggatccccacaccttcaaccaccagaacttgacccactgttcccgccatggctcagggcctaacatcatcctcacaggggactcctctccaggtttctctaaggagattgcagcagccctggccggagtgcctggctttgaggtgtcagcagctggattggagctagggcttgggctagaagatgagctgcgcatggagccactgggcctggaagggctaaacatgctgagtgacccctgtgccctgctgcctgatcctgctgtggaggagtcattccgcagtgaccggctccaatgagggcacctcatcaccatccctcttcttggccccatcccccaccaccattcctttcctcccttccccctggcaggtagagactctactctctgtccccagatcctctttctagcatgaatgaaggatgccaagaatgagaaaaagcaaggggtttgtccaggtggcccctgaattctgcgcaagggatgggcctgggggaactcaagggagggcctaaagcacttgtaactttgaaccgtctgtctggaggtcagagcctgttggaaagcaggggtagaggggagccctggaagcagggcttttccggatgcctaggggtgggcagtgccagcccctcctcaccactcttccccttgcagtggaggagagagccagagtggatactattttttattaaatatattattatatgttaataaaaaaatcatatcaa

SEQ ID NO: 455907 - DNA, 1485 bp, Homo sapiens
  misc_feature (19)..(19): n is a, c, g, or t
  misc_feature (1454)..(1454): n is a, c, g, or t
ttaggctaggtacgaggcnggtgtgaatcggccgaggcatgtagtgagaccctcgcgaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacagttacaggcccaaaaactgcgactggcatacacaaggagctctcattatggtgggtctctgcccaatgttaaccagattggctctggcctggccgagttccagagccccctccactcacctttggattcatctcggagcactcggcaccatgggctggtggaacgggtgcagcgagatcctcgaagaatggtgtccccacttcgccgatacacccgccacattgacagctctccctatagtcctgcctacttatctcctcccccagagtctagctggcgaaggacgatggcctggggcaatttccctgcagagaaggggcagttgtttcgactaccatctgcacttaacaggacaagctctgactctgcccttcatacaagtgtgatgaaccccagtccccaggatacctacccaggccccacacctcccagcatcctgcccagccgacgtgggggtattctggatggtgaaatggaccccaaagtacctgctattgaggagaacttgctagatgacaagcatttgctgaagccatgggatgctaagaagctatcctcatcctcttcccgacctcggtcctgtgaagtccctggaattaacatctttccatctcctgaccagcctgccaatgtgcctgtcctcccacctgccatgaacacggggggctccctacctgacctcaccaacctgcactttcccccaccactgcccacccccctggaccctgaagagacagcctaccctagcctgagtgggggcaacagtacctccaatttgacccacaccatgactcacctgggcatcagcaggggcatgggcctgggcccaggctatgatgcaccagactcattcacctctcagncacaccgacaggtgtgtctaatgtcggtgtg

SEQ ID NO: 455908 - DNA, 1114 bp, Homo sapiens
acaattcccggcggcccccgcgcgcaacaggtcagggctaggctggggccgggttcgcggtgctcgctgaggcggcggtggctacggctggaggagccgggccgaggccgcggcggaggccgcggctggtactgggagggtggcagggagggacggggaaggaagatggcgacgtcgggggcgaacgggcctggttcggccacggcctcggcttccaatccgcgcaaatttagtgagaagattgcgctgcagaagcagcgtcaggccgaggagacggcggccttcgaggaggtgatgatggacatcggctccacccggttacaggcccaaaaactgcgactggcatacacaaggagctctcattatggtgggtctctgcccaatgttaaccagattggctctggcctggccgagttccagagccccctccactcacctttggattcatctcggagcactcggcaccatgggctggtggaacgggtgcagcgagatcctcgaagaatggtgtccccacttcgccgatacacccgccacattgacagctctccctatagtcctgcctacttatctcctcccccagagtctagctggcgaaggacgatggcctggggcaatttccctgcagagaaggggcagttgtttcgactaccatctgcacttaacaggacaagctctgactctgcccttcatacaagtgtgatgaaccccagtccccaggatacctacccaggccccacacctcccagcatcctgcccagccgacgtgggggtattctggatggtgaaatggaccccaaagtacctgctattgaggagaacttgctagatgacaagcatttgctgaagccatgggatgctaagaagctatcctcatcctcttcccgacctcggtcctgtgaagtccctggaattaacatctgtccatctcctgaccaggctgccaagtgtggctgatctccaaactacccagtgaaacaacggaggggctcccctacgctggagcatgaccaaccctgcacaaccccgaaccgaaggccaccacctggaacctgaaccagaccaccgaaccaggcccacaggggccaaagcaccaaaaagacccaaacagaac

SEQ ID NO: 455909 - DNA, 1474 bp, Homo sapiens
taacactcatgtgtcaggaaagtacagtcaatgtatgctaaaaatccacttgaacaattagctcgcttttttccctcatttgctttcagagtaaatgtgctttcagagtattaggtcggcctaatatatgatacattttaagaaggggaggaaagcgcattgtataccctgatgctgggacccaatagaagacaggccccctggctggcctttggttctccctggagctgacaaagggaaggggcttggaaagcagccactgtccccgcctagtttgggcctttacagacacacctttccttttggcagctgctatggcacggattctctatgccagcacgaagctggaaaacctgcctacctggctggtgaaatgagggtggcagctggaggaaacaggcatcttaggagactagaaatgtccttcaaagggacttcagtgagtgctcaggggaccaggggtgactgtgttaagaagggttagaggttgagagggagccatgagcttgggtcatcaccccagtgagaccatccaggcacacagctcccaggcttgggaggccgcctccagtccaccaggaccctcagggagctgtgacttcattgaagctgggtctaaaggcttccttcaaggctcagcaaactgggttttcaaagatttttgatccctgaagctaatttacacgttatgtggggccatggcaaagacttggccctgaagtggacagaaagaggctgtgctgagtgatgaatgagactaaacagtgttctcatgcttggtgattttgatgagaacatactacataagagttaagagcattataattccctttatcaccatataaacatgtcacttatccggaaagcatacaatttatttgtacatgagaatgtaaatttaaaaattttctgaaaactagattaaatcttgagaagcaattttcaagtaaacaaaaacatgccatgttaatcagcactagatctcccccaccccccacataatgtgtatgtacacatttctcaaattcagactgcagtacagctgtctccttggaggcgtcaggggttcctaagcctaaattctacctctagggtcttgatccctcaagagttcatcctgagttaaaattttgttatccccggaagcagagatgcactgactctggtgatctcagtatgaatgtggtatgaaatcttctaggtgtctgtggtggggcctgagggagggtaggaaaggtgacgaggaaaaagtagagggagcctgaacaccctgggtctcaggtacggagtgaagaaatcactaaggtgaaaagacaggctggggcccaggagctcgtccaagtcctgatgaacaacaagtcctgggcaacatcacaggccaccaaacacaccttcagctccagggtcgaatagatggtggaagagcacagcctcaagactttccagtgtgtcagacaggtagaatatcatcatg

SEQ ID NO: 455910 - DNA, 590 bp, Homo sapiens
cctcagaggaccggtccgaaattcccgggtcaactacaactaaattcgcggccgcgtcgacattgaatcaaactcttagacaagctggtgaaagttttaacgactgctggaggcaacatgcttccacactgacagaaatcatctttcaaaaatcctgcacatatctcaggcttatgaaacaaactaattcctaatagttggaaatgaattaaaagcttgcggtgagataaaagatagattttggctggatgtgatgactcatgcctgtgatccctacactttaggagggcacagcaggaggatcgcctgagcccaggaattcaagaccagcctggtcaacatagcaagactctctctctgcaaaaaaaaagaaaaaaaaaaaaacctcccaaaaaaaaggttttactaggcatgaaaatgagtccatttccattctaggccccaggatatcaccatgaccaataaaaacaatctgtggcactcagcaggtgcatgtcaacatgggcaggttctttctccccgtcagcaggacaagaacatctcccctatccaaaaggcacccactgaggatccgcagttctctggaatta

SEQ ID NO: 455911 - DNA, 422 bp, Homo sapiens
  misc_feature (407)..(407): n is a, c, g, or t
ctgctttagcgagagaggctgctttagcgagagaggctgctttagcgagagagggagaccaataaaataggatgacaagtcttacgatgtccctacttctaaagagaaggtaagaaatcccgtgctgaacatccactaggttctgggtatatactttatacacacatggcccctttattcctctcagtgaccctcagggtaggtctcactacccaagtgttagagtgaaggacgctgagaccaagaagaggaacaggtcagggtcagacagagctggaatttggacacagttctgtctgactccagatattccttgtatcacacaatactgtcttctgaagcaagtgattgtccccaacacacacacacacacacacacactctctctctctctctctctctgcttncagcagagctgagga

SEQ ID NO: 455912 - DNA, 4349 bp, Homo sapiens
taacactcatgtgtcaggaaagtacagtcaatgtatgctaaaaatccacttgaacaattagctcgcttttttccctcatttgctttcagagtaaatgtgctttcagagtattaggtcggcctaatatatgatacattttaagaaggggaggaaagcgcattgtataccctgatgctgggacccaatagaagacaggccccctggctggcctttggttctccctggagctgacaaagggaaggggcttggaaagcagccactgtccccgcctagtttgggcctttacagacacacctttccttttggcagctgctatggcacggattctctatgccagcacgaagctggaaaacctgcctacctggctggtgaaatgagggtggcagctggaggaaacaggcatcttaggagactagaaatgtccttcaaagggacttcagtgagtgctcaggggaccaggggtgactgtgttaagaagggttagaggttgagagggagccatgagcttgggtcatcaccccagtgagaccatccaggcacacagctcccaggcttgggaggccgcctccagtccaccaggaccctcagggagctgtgacttcattgaagctgggtctaaaggcttccttcaaggctcagcaaactgggttttcaaagatttttgatccctgaagctaatttacacgttatgtggggccatggcaaagacttggccctgaagtggacagaaagaggctgtgctgagtgatgaatgagactaaacagtgttctcatgcttggtgattttgatgagaacatactacataagagttaagagcattataattccctttatcaccatataaacatgtcacttatccggaaagcatacaatttatttgtacatgagaatgtaaatttaaaaattttctgaaaactagattaaatcttgagaagcaattttcaagtaaacaaaaacatgccatgttaatcagcactagatctcccccaccccccacataatgtgtatgtacacatttctcaaattcagactgcagtacagctgtctccttggaggcgtcaggggttcctaagcctaaattctacctctagggtcttgatccctcaagagttcatcctgagttaaaattttgttatccccggaagcagagatgcactgactctggtgatctcagtatgaatgtggtatgaaatcttctaggtgtctgtggtggggcctgagggagggtaggaaaggtgacgaggaaaaagtagagggagcctgaacaccctgggtctcaggtacggagtgaagaaatcactaaggtgaaaagacaggctggggcccaggagctcgtccaagtcctgatgaacaacaagtcctgggcaacatcacaggccaccaaacacaccttcagctccagggtcgaatagatggtggaagagcacagccatctggaaaatcagaaaaaagtggggaagattttctatcttgaacttgtgagctggagaattaccattagtagcccactaataggttatggccgatgagtcccttcataacacactgagagccacttttgacactcccagaaaaggcaggttaacaaaaccccttgatggaaggaagaccctcattgcccaatgtacccaagcctctttgaaccttgcttagactgaactgcaaatgtcttgactgctctgggctccttagtgcaactccttcccacagaagccatcaggagcctggtccaggaagctcctctcctacacctgccttaaaaggcccagctctgctggggagtaaggttcatgggggccgtcccaatgcaaaagggaatctctgccatcacccactgcaaccacatggtagccactctgcagccggcaggcgtgaggcatgctgcgctaacatgggagggcggaggctctgcctgacttcccagaagcccagtgagaagtccaggacaatcagcaggtgctatgggaaccttggctggcaggcaccatgtcgtcctgtatgatcggcaggaccggctccttcctgaagacaccgattcttggcggctcctgacaaggattgagaggatttgtgggggacagccctgaagccctgagccctcaactcaatgaagggattgtgctggtgtagacccacagcatccagctctgtcactgatgaaggtctgaactgcatactctgcccctttggtgtcagccttaaaggtcagttttaggtgagtttcaaccagtggctgtagatgggtcctttgtttaccagtttccccacatcctgtctgagaccattgctagtttttgtctgcaccagtcttagggaaaacaacctggacaccgtgggtgagatcaccagtgggctccaagccagagcatgggcctgggacagggtgggttaccttggcatactctaacatactcaaacctcatttcttttggggtgatcagacccaacagcaggtcatgggggcgacgaagtccagtggagtccaaggaatgagaaagacagtttgagagacaaaatgggaccagggggctatcacaagtgtggaggctgcaacaaacaggtggtgaggatgtgggggttgaaaggaaacggtgtatcaagtgaatgagaaacatatggctacttgagaacatgggaatgctagaagcaaggagcagcaagtctagcaaacatgcaagccctgcctcagcttctctcccaacactcagcttttcttccaacacatttcatgtgcaaggttctcgtgcccactcctcttgtacagtttggcagcctcatggagcttccctggtaggaaaacacatctgccagaaacaggtcattgttggtctctccccgcttcttcctctcctggaaaaattagaagcaaaggaaatggcctctgcagccatgggcagaaagcagcctttacaaaggttagatgtggctatttcaagtgaggcccctgggccttcctactggaacctgggcttggctcctggctgttgtctctctcccctaggttcccgctgggaaggcttgataacaaaagcaggcttttaccagacaagcaaagatcaaaaaaagatgcaaacctttgtttgtttaatggaaattcctcagggttgctttcctgtgtattccaaagctatgacggaatagtttgaatagtgtgtgctctgactcatccatgacccctaagctcccaagatctcccaaatccgcaggccccgtttggcagagttgtggctcatggggatgacagagcagaatgtttagggtttctgcccaagagggagaccaataaaataggatgacaagtcttacgatgtccctacttctaaagagaaggtaagaaatcccgtgctgaacatccactaggttctgggtatatactttatacacacatggcccctttattcctctcagtgaccctcagggtaggtctcactacccaagtgttagagtgaaggacgctgagaccaagaagaggaacaggtcagggtcagacagagctggaatttggacacagttctgtctgactccagatattccttgtatcacacaatactgtcttctgaagcaagtgattgtccccaacacacacacacacacacacacactctctctctctctctctctctctctctctctctctctctcagcagagctgaggataaagaggaatatcctgcacacttcttccttctgtgtcagggaacatttgcttgtctacagctcgagtatttgtaaacactcagtagcacccaaaccctgagccctagcagtttccttttgcttgtttactagcaagagtagcatgtcggaggacgatgagacattgaatcaaactcttagacaagctggtgaaagttttaacgactgctggaggcaacatgcttccacactgacagaaatcatctttcaaaaatcctgcacatatctcaggcttatgaaacaaactaattcctaatagttggaaatgaattaaaagcttgcggtgagataaaagatagattttggctggatgtgatgactcatgcctgtgatccctacactttaggagggcacagcaggaggatcgcctgagcccaggaattcaagaccagcctggtcaacatagcaagactctctctctgcaaaaaaaaagaaaaaaaaaaaaacctcccaaaaaaaaggttttactaggcatgaaaatgagtccatttccattctaggccccaggatatcaccatgaccaataaaaacaatctgtggcactcagcaggtgcatgtcaacatgggcaggttctttctccccgtcagcaggacaagaacatctcccctatccaaaaggcacccactgaggatccgcagttctctggaatta

SEQ ID NO: 455913 - DNA, 3692 bp, Homo sapiens
taacactcatgtgtcaggaaagtacagtcaatgtatgctaaaaatccacttgaacaattagctcgcttttttccctcatttgctttcagagtaaatgtgctttcagagtattaggtcggcctaatatatgatacattttaagaaggggaggaaagcgcattgtataccctgatgctgggacccaatagaagacaggccccctggctggcctttggttctccctggagctgacaaagggaaggggcttggaaagcagccactgtccccgcctagtttgggcctttacagacacacctttccttttggcagctgctatggcacggattctctatgccagcacgaagctggaaaacctgcctacctggctggtgaaatgagggtggcagctggaggaaacaggcatcttaggagactagaaatgtccttcaaagggacttcagtgagtgctcaggggaccaggggtgactgtgttaagaagggttagaggttgagagggagccatgagcttgggtcatcaccccagtgagaccatccaggcacacagctcccaggcttgggaggccgcctccagtccaccaggaccctcagggagctgtgacttcattgaagctgggtctaaaggcttccttcaaggctcagcaaactgggttttcaaagatttttgatccctgaagctaatttacacgttatgtggggccatggcaaagacttggccctgaagtggacagaaagaggctgtgctgagtgatgaatgagactaaacagtgttctcatgcttggtgattttgatgagaacatactacataagagttaagagcattataattccctttatcaccatataaacatgtcacttatccggaaagcatacaatttatttgtacatgagaatgtaaatttaaaaattttctgaaaactagattaaatcttgagaagcaattttcaagtaaacaaaaacatgccatgttaatcagcactagatctcccccaccccccacataatgtgtatgtacacatttctcaaattcagactgcagtacagctgtctccttggaggcgtcaggggttcctaagcctaaattctacctctagggtcttgatccctcaagagttcatcctgagttaaaattttgttatccccggaagcagagatgcactgactctggtgatctcagtatgaatgtggtatgaaatcttctaggtgtctgtggtggggcctgagggagggtaggaaaggtgacgaggaaaaagtagagggagcctgaacaccctgggtctcaggtacggagtgaagaaatcactaaggtgaaaagacaggctggggcccaggagctcgtccaagtcctgatgaacaacaagtcctgggcaacatcacaggccaccaaacacaccttcagctccagggtcgaatagatggtggaagagcacagccatctggaaaatcagaaaaaagtggggaagattttctatcttgaacttgtgagctggagaattaccattagtagcccactaataggttatggccgatgagtcccttcataacacactgagagccacttttgacactcccagaaaaggcaggttaacaaaaccccttgatggaaggaagaccctcattgcccaatgtacccaagcctctttgaaccttgcttagactgaactgcaaatgtcttgactgctctgggctccttagtgcaactccttcccacagaagccatcaggagcctggtccaggaagctcctctcctacacctgccttaaaaggcccagctctgctggggagtaaggttcatgggggccgtcccaatgcaaaagggaatctctgccatcacccactgcaaccacatggtagccactctgcagccggcaggcgtgaggcatgctgcgctaacatgggagggcggaggctctgcctgacttcccagaagcccagtgagaagtccaggacaatcagcaggtgctatgggaaccttggctggcaggcaccatgtcgtcctgtatgatcggcaggaccggctccttcctgaagacaccgattcttggcggctcctgacaaggattgagaggatttgtgggggacagccctgaagccctgagccctcaactcaatgaagggattgtgctggtgtagacccacagcatccagctctgtcactgatgaaggtctgaactgcatactctgcccctttggtgtcagccttaaaggtcagttttaggtgagtttcaaccagtggctgtagatgggtcctttgtttaccagtttccccacatcctgtctgagaccattgctagtttttgtctgcaccagtcttagggaaaacaacctggacaccgtgggtgagatcaccagtgggctccaagccagagcatgggcctgggacagggtgggttaccttggcatactctaacatactcaaacctcatttcttttggggtgatcagacccaacagcaggtcatgggggcgacgaagtccagtggagtccaaggaatgagaaagacagtttgagagacaaaatgggaccagggggctatcacaagtgtggaggctgcaacaaacaggtggtgaggatgtgggggttgaaaggaaacggtgtatcaagtgaatgagaaacatatggctacttgagaacatgggaatgctagaagcaaggagcagcaagtctagcaaacatgcaagccctgcctcagcttctctcccaacactcagcttttcttccaacacatttcatgtgcaaggttctcgtgcccactcctcttgtacagtttggcagcctcatggagcttccctggtaggaaaacacatctgccagaaacaggtcattgttggtctctccccgcttcttcctctcctggaaaaattagaagcaaaggaaatggcctctgcagccatgggcagaaagcagcctttacaaaggttagatgtggctatttcaagtgaggcccctgggccttcctactggaacctgggcttggctcctggctgttgtctctctcccctaggttcccgctgggaaggcttgataacaaaagcaggcttttaccagacaagcaaagatcaaaaaaagatgcaaacctttgtttgtttaatggaaattcctcagggttgctttcctgtgtattccaaagctatgacggaatagtttgaatagtgtgtgctctgactcatccatgacccctaagctcccaagatctcccaaatccgcaggccccgtttggcagagttgtggctcatggggatgacagagcagaatgtttagggtttctgcccaagagggagaccaataaaataggatgacaagtcttacgatgtccctacttctaaagagaaggtaagaaatcccgtgctgaacatccactaggttctgggtatatactttatacacacatggcccctttattcctctcagtgaccctcagggtaggtctcactacccaagtgttagagtgaaggacgctgagaccaagaagaggaacaggtcagggtcagacagagctggaatttggacacagttctgtctgactccagatattccttgtatcacacaatactgtcttctgaagcaagtgattgtccccaacacacacacacacacacacacactctctctctctctctctctctctctctctctctctctctctctctctaaagagagatagagatagagagatactatgagcgcactctat

SEQ ID NO: 455914 - DNA, 1127 bp, Homo sapiens
ctgctttagcgagagaggctgctttagcgagagaggctgctttagcgagagagggagaccaataaaataggatgacaagtcttacgatgtccctacttctaaagagaaggtaagaaatcccgtgctgaacatccactaggttctgggtatatactttatacacacatggcccctttattcctctcagtgaccctcagggtaggtctcactacccaagtgttagagtgaaggacgctgagaccaagaagaggaacaggtcagggtcagacagagctggaatttggacacagttctgtctgactccagatattccttgtatcacacaatactgtcttctgaagcaagtgattgtccccaacacacacacacacacacacacactctctctctctctctctctctctctctctctctctctctcagcagagctgaggataaagaggaatatcctgcacacttcttccttctgtgtcagggaacatttgcttgtctacagctcgagtatttgtaaacactcagtagcacccaaaccctgagccctagcagtttccttttgcttgtttactagcaagagtagcatgtcggaggacgatgagacattgaatcaaactcttagacaagctggtgaaagttttaacgactgctggaggcaacatgcttccacactgacagaaatcatctttcaaaaatcctgcacatatctcaggcttatgaaacaaactaattcctaatagttggaaatgaattaaaagcttgcggtgagataaaagatagattttggctggatgtgatgactcatgcctgtgatccctacactttaggagggcacagcaggaggatcgcctgagcccaggaattcaagaccagcctggtcaacatagcaagactctctctctgcaaaaaaaaagaaaaaaaaaaaaacctcccaaaaaaaaggttttactaggcatgaaaatgagtccatttccattctaggccccaggatatcaccatgaccaataaaaacaatctgtggcactcagcaggtgcatgtcaacatgggcaggttctttctccccgtcagcaggacaagaacatctcccctatccaaaaggcacccactgaggatccgcagttctctggaatta

SEQ ID NO: 455915 - DNA, 3644 bp, Homo sapiens
  misc_feature (3629)..(3629): n is a, c, g, or t
taacactcatgtgtcaggaaagtacagtcaatgtatgctaaaaatccacttgaacaattagctcgcttttttccctcatttgctttcagagtaaatgtgctttcagagtattaggtcggcctaatatatgatacattttaagaaggggaggaaagcgcattgtataccctgatgctgggacccaatagaagacaggccccctggctggcctttggttctccctggagctgacaaagggaaggggcttggaaagcagccactgtccccgcctagtttgggcctttacagacacacctttccttttggcagctgctatggcacggattctctatgccagcacgaagctggaaaacctgcctacctggctggtgaaatgagggtggcagctggaggaaacaggcatcttaggagactagaaatgtccttcaaagggacttcagtgagtgctcaggggaccaggggtgactgtgttaagaagggttagaggttgagagggagccatgagcttgggtcatcaccccagtgagaccatccaggcacacagctcccaggcttgggaggccgcctccagtccaccaggaccctcagggagctgtgacttcattgaagctgggtctaaaggcttccttcaaggctcagcaaactgggttttcaaagatttttgatccctgaagctaatttacacgttatgtggggccatggcaaagacttggccctgaagtggacagaaagaggctgtgctgagtgatgaatgagactaaacagtgttctcatgcttggtgattttgatgagaacatactacataagagttaagagcattataattccctttatcaccatataaacatgtcacttatccggaaagcatacaatttatttgtacatgagaatgtaaatttaaaaattttctgaaaactagattaaatcttgagaagcaattttcaagtaaacaaaaacatgccatgttaatcagcactagatctcccccaccccccacataatgtgtatgtacacatttctcaaattcagactgcagtacagctgtctccttggaggcgtcaggggttcctaagcctaaattctacctctagggtcttgatccctcaagagttcatcctgagttaaaattttgttatccccggaagcagagatgcactgactctggtgatctcagtatgaatgtggtatgaaatcttctaggtgtctgtggtggggcctgagggagggtaggaaaggtgacgaggaaaaagtagagggagcctgaacaccctgggtctcaggtacggagtgaagaaatcactaaggtgaaaagacaggctggggcccaggagctcgtccaagtcctgatgaacaacaagtcctgggcaacatcacaggccaccaaacacaccttcagctccagggtcgaatagatggtggaagagcacagccatctggaaaatcagaaaaaagtggggaagattttctatcttgaacttgtgagctggagaattaccattagtagcccactaataggttatggccgatgagtcccttcataacacactgagagccacttttgacactcccagaaaaggcaggttaacaaaaccccttgatggaaggaagaccctcattgcccaatgtacccaagcctctttgaaccttgcttagactgaactgcaaatgtcttgactgctctgggctccttagtgcaactccttcccacagaagccatcaggagcctggtccaggaagctcctctcctacacctgccttaaaaggcccagctctgctggggagtaaggttcatgggggccgtcccaatgcaaaagggaatctctgccatcacccactgcaaccacatggtagccactctgcagccggcaggcgtgaggcatgctgcgctaacatgggagggcggaggctctgcctgacttcccagaagcccagtgagaagtccaggacaatcagcaggtgctatgggaaccttggctggcaggcaccatgtcgtcctgtatgatcggcaggaccggctccttcctgaagacaccgattcttggcggctcctgacaaggattgagaggatttgtgggggacagccctgaagccctgagccctcaactcaatgaagggattgtgctggtgtagacccacagcatccagctctgtcactgatgaaggtctgaactgcatactctgcccctttggtgtcagccttaaaggtcagttttaggtgagtttcaaccagtggctgtagatgggtcctttgtttaccagtttccccacatcctgtctgagaccattgctagtttttgtctgcaccagtcttagggaaaacaacctggacaccgtgggtgagatcaccagtgggctccaagccagagcatgggcctgggacagggtgggttaccttggcatactctaacatactcaaacctcatttcttttggggtgatcagacccaacagcaggtcatgggggcgacgaagtccagtggagtccaaggaatgagaaagacagtttgagagacaaaatgggaccagggggctatcacaagtgtggaggctgcaacaaacaggtggtgaggatgtgggggttgaaaggaaacggtgtatcaagtgaatgagaaacatatggctacttgagaacatgggaatgctagaagcaaggagcagcaagtctagcaaacatgcaagccctgcctcagcttctctcccaacactcagcttttcttccaacacatttcatgtgcaaggttctcgtgcccactcctcttgtacagtttggcagcctcatggagcttccctggtaggaaaacacatctgccagaaacaggtcattgttggtctctccccgcttcttcctctcctggaaaaattagaagcaaaggaaatggcctctgcagccatgggcagaaagcagcctttacaaaggttagatgtggctatttcaagtgaggcccctgggccttcctactggaacctgggcttggctcctggctgttgtctctctcccctaggttcccgctgggaaggcttgataacaaaagcaggcttttaccagacaagcaaagatcaaaaaaagatgcaaacctttgtttgtttaatggaaattcctcagggttgctttcctgtgtattccaaagctatgacggaatagtttgaatagtgtgtgctctgactcatccatgacccctaagctcccaagatctcccaaatccgcaggccccgtttggcagagttgtggctcatggggatgacagagcagaatgtttagggtttctgcccaagagggagaccaataaaataggatgacaagtcttacgatgtccctacttctaaagagaaggtaagaaatcccgtgctgaacatccactaggttctgggtatatactttatacacacatggcccctttattcctctcagtgaccctcagggtaggtctcactacccaagtgttagagtgaaggacgctgagaccaagaagaggaacaggtcagggtcagacagagctggaatttggacacagttctgtctgactccagatattccttgtatcacacaatactgtcttctgaagcaagtgattgtccccaacacacacacacacacacacacactctctctctctctctctctctgcttncagcagagctgagga

SEQ ID NO: 455916 - DNA, 3154 bp, Homo sapiens
taacactcatgtgtcaggaaagtacagtcaatgtatgctaaaaatccacttgaacaattagctcgcttttttccctcatttgctttcagagtaaatgtgctttcagagtattaggtcggcctaatatatgatacattttaagaaggggaggaaagcgcattgtataccctgatgctgggacccaatagaagacaggccccctggctggcctttggttctccctggagctgacaaagggaaggggcttggaaagcagccactgtccccgcctagtttgggcctttacagacacacctttccttttggcagctgctatggcacggattctctatgccagcacgaagctggaaaacctgcctacctggctggtgaaatgagggtggcagctggaggaaacaggcatcttaggagactagaaatgtccttcaaagggacttcagtgagtgctcaggggaccaggggtgactgtgttaagaagggttagaggttgagagggagccatgagcttgggtcatcaccccagtgagaccatccaggcacacagctcccaggcttgggaggccgcctccagtccaccaggaccctcagggagctgtgacttcattgaagctgggtctaaaggcttccttcaaggctcagcaaactgggttttcaaagatttttgatccctgaagctaatttacacgttatgtggggccatggcaaagacttggccctgaagtggacagaaagaggctgtgctgagtgatgaatgagactaaacagtgttctcatgcttggtgattttgatgagaacatactacataagagttaagagcattataattccctttatcaccatataaacatgtcacttatccggaaagcatacaatttatttgtacatgagaatgtaaatttaaaaattttctgaaaactagattaaatcttgagaagcaattttcaagtaaacaaaaacatgccatgttaatcagcactagatctcccccaccccccacataatgtgtatgtacacatttctcaaattcagactgcagtacagctgtctccttggaggcgtcaggggttcctaagcctaaattctacctctagggtcttgatccctcaagagttcatcctgagttaaaattttgttatccccggaagcagagatgcactgactctggtgatctcagtatgaatgtggtatgaaatcttctaggtgtctgtggtggggcctgagggagggtaggaaaggtgacgaggaaaaagtagagggagcctgaacaccctgggtctcaggtacggagtgaagaaatcactaaggtgaaaagacaggctggggcccaggagctcgtccaagtcctgatgaacaacaagtcctgggcaacatcacaggccaccaaacacaccttcagctccagggtcgaatagatggtggaagagcacagccatctggaaaatcagaaaaaagtggggaagattttctatcttgaacttgtgagctggagaattaccattagtagcccactaataggttatggccgatgagtcccttcataacacactgagagccacttttgacactcccagaaaaggcaggttaacaaaaccccttgatggaaggaagaccctcattgcccaatgtacccaagcctctttgaaccttgcttagactgaactgcaaatgtcttgactgctctgggctccttagtgcaactccttcccacagaagccatcaggagcctggtccaggaagctcctctcctacacctgccttaaaaggcccagctctgctggggagtaaggttcatgggggccgtcccaatgcaaaagggaatctctgccatcacccactgcaaccacatggtagccactctgcagccggcaggcgtgaggcatgctgcgctaacatgggagggcggaggctctgcctgacttcccagaagcccagtgagaagtccaggacaatcagcaggtgctatgggaaccttggctggcaggcaccatgtcgtcctgtatgatcggcaggaccggctccttcctgaagacaccgattcttggcggctcctgacaaggattgagaggatttgtgggggacagccctgaagccctgagccctcaactcaatgaagggattgtgctggtgtagacccacagcatccagctctgtcactgatgaaggtctgaactgcatactctgcccctttggtgtcagccttaaaggtcagttttaggtgagtttcaaccagtggctgtagatgggtcctttgtttaccagtttccccacatcctgtctgagaccattgctagtttttgtctgcaccagtcttagggaaaacaacctggacaccgtgggtgagatcaccagtgggctccaagccagagcatgggcctgggacagggtgggttaccttggcatactctaacatactcaaacctcatttcttttggggtgatcagacccaacagcaggtcatgggggcgacgaagtccagtggagtccaaggaatgagaaagacagtttgagagacaaaatgggaccagggggctatcacaagtgtggaggctgcaacaaacaggtggtgaggatgtgggggttgaaaggaaacggtgtatcaagtgaatgagaaacatatggctacttgagaacatgggaatgctagaagcaaggagcagcaagtctagcaaacatgcaagccctgcctcagcttctctcccaacactcagcttttcttccaacacatttcatgtgcaaggttctcgtgcccactcctcttgtacagtttggcagcctcatggagcttccctggtaggaaaacacatctgccagaaacaggtcattgttggtctctccccgcttcttcctctcctggaaaaattagaagcaaaggaaatggcctctgcagccatgggcagaaagcagcctttacaaaggttagatgtggctatttcaagtgaggcccctgggccttcctactggaacctgggcttggctcctggctgttgtctctctcccctaggttcccgctgggaaggcttgataacaaaagcaggcttttaccagacaagcaaagatcaaaaaaagatgcaaacctttgtttgtttaatggaaattcctcagggttgctttcctgtgtattccaaaagccgcgagcgggggatcctctaggag

SEQ ID NO: 455917 - DNA, 3165 bp, Homo sapiens
taacactcatgtgtcaggaaagtacagtcaatgtatgctaaaaatccacttgaacaattagctcgcttttttccctcatttgctttcagagtaaatgtgctttcagagtattaggtcggcctaatatatgatacattttaagaaggggaggaaagcgcattgtataccctgatgctgggacccaatagaagacaggccccctggctggcctttggttctccctggagctgacaaagggaaggggcttggaaagcagccactgtccccgcctagtttgggcctttacagacacacctttccttttggcagctgctatggcacggattctctatgccagcacgaagctggaaaacctgcctacctggctggtgaaatgagggtggcagctggaggaaacaggcatcttaggagactagaaatgtccttcaaagggacttcagtgagtgctcaggggaccaggggtgactgtgttaagaagggttagaggttgagagggagccatgagcttgggtcatcaccccagtgagaccatccaggcacacagctcccaggcttgggaggccgcctccagtccaccaggaccctcagggagctgtgacttcattgaagctgggtctaaaggcttccttcaaggctcagcaaactgggttttcaaagatttttgatccctgaagctaatttacacgttatgtggggccatggcaaagacttggccctgaagtggacagaaagaggctgtgctgagtgatgaatgagactaaacagtgttctcatgcttggtgattttgatgagaacatactacataagagttaagagcattataattccctttatcaccatataaacatgtcacttatccggaaagcatacaatttatttgtacatgagaatgtaaatttaaaaattttctgaaaactagattaaatcttgagaagcaattttcaagtaaacaaaaacatgccatgttaatcagcactagatctcccccaccccccacataatgtgtatgtacacatttctcaaattcagactgcagtacagctgtctccttggaggcgtcaggggttcctaagcctaaattctacctctagggtcttgatccctcaagagttcatcctgagttaaaattttgttatccccggaagcagagatgcactgactctggtgatctcagtatgaatgtggtatgaaatcttctaggtgtctgtggtggggcctgagggagggtaggaaaggtgacgaggaaaaagtagagggagcctgaacaccctgggtctcaggtacggagtgaagaaatcactaaggtgaaaagacaggctggggcccaggagctcgtccaagtcctgatgaacaacaagtcctgggcaacatcacaggccaccaaacacaccttcagctccagggtcgaatagatggtggaagagcacagccatctggaaaatcagaaaaaagtggggaagattttctatcttgaacttgtgagctggagaattaccattagtagcccactaataggttatggccgatgagtcccttcataacacactgagagccacttttgacactcccagaaaaggcaggttaacaaaaccccttgatggaaggaagaccctcattgcccaatgtacccaagcctctttgaaccttgcttagactgaactgcaaatgtcttgactgctctgggctccttagtgcaactccttcccacagaagccatcaggagcctggtccaggaagctcctctcctacacctgccttaaaaggcccagctctgctggggagtaaggttcatgggggccgtcccaatgcaaaagggaatctctgccatcacccactgcaaccacatggtagccactctgcagccggcaggcgtgaggcatgctgcgctaacatgggagggcggaggctctgcctgacttcccagaagcccagtgagaagtccaggacaatcagcaggtgctatgggaaccttggctggcaggcaccatgtcgtcctgtatgatcggcaggaccggctccttcctgaagacaccgattcttggcggctcctgacaaggattgagaggatttgtgggggacagccctgaagccctgagccctcaactcaatgaagggattgtgctggtgtagacccacagcatccagctctgtcactgatgaaggtctgaactgcatactctgcccctttggtgtcagccttaaaggtcagttttaggtgagtttcaaccagtggctgtagatgggtcctttgtttaccagtttccccacatcctgtctgagaccattgctagtttttgtctgcaccagtcttagggaaaacaacctggacaccgtgggtgagatcaccagtgggctccaagccagagcatgggcctgggacagggtgggttaccttggcatactctaacatactcaaacctcatttcttttggggtgatcagacccaacagcaggtcatgggggcgacgaagtccagtggagtccaaggaatgagaaagacagtttgagagacaaaatgggaccagggggctatcacaagtgtggaggctgcaacaaacaggtggtgaggatgtgggggttgaaaggaaacggtgtatcaagtgaatgagaaacatatggctacttgagaacatgggaatgctagaagcaaggagcagcaagtctagcaaacatgcaagccctgcctcagcttctctcccaacactcagcttttcttccaacacatttcatgtgcaaggttctcgtgcccactcctcttgtacagtttggcagcctcatggagcttccctggtaggaaaacacatctgccagaaacaggtcattgttggtctctccccgcttcttcctctcctggaaaaattagaagcaaaggaaatggcctctgcagccatgggcagaaagcagcctttacaaaggttagatgtggctatttcaagtgaggcccctgggccttcctactggaacctgggcttggctcctggctgttgtctctctcccctaggttcccgctgggaaggcttgataacaaaagcaggcttttaccagacaagcaaagatcaaaaaaagatgcaaacctttgtttgtttaatggaaattcctcagggttgctttcctgtgtattccaaatcagtgaagacgccaagcgggtaacgctagtcgacctt

SEQ ID NO: 455918 - DNA, 2145 bp, Homo sapiens
taacactcatgtgtcaggaaagtacagtcaatgtatgctaaaaatccacttgaacaattagctcgcttttttccctcatttgctttcagagtaaatgtgctttcagagtattaggtcggcctaatatatgatacattttaagaaggggaggaaagcgcattgtataccctgatgctgggacccaatagaagacaggccccctggctggcctttggttctccctggagctgacaaagggaaggggcttggaaagcagccactgtccccgcctagtttgggcctttacagacacacctttccttttggcagctgctatggcacggattctctatgccagcacgaagctggaaaacctgcctacctggctggtgaaatgagggtggcagctggaggaaacaggcatcttaggagactagaaatgtccttcaaagggacttcagtgagtgctcaggggaccaggggtgactgtgttaagaagggttagaggttgagagggagccatgagcttgggtcatcaccccagtgagaccatccaggcacacagctcccaggcttgggaggccgcctccagtccaccaggaccctcagggagctgtgacttcattgaagctgggtctaaaggcttccttcaaggctcagcaaactgggttttcaaagatttttgatccctgaagctaatttacacgttatgtggggccatggcaaagacttggccctgaagtggacagaaagaggctgtgctgagtgatgaatgagactaaacagtgttctcatgcttggtgattttgatgagaacatactacataagagttaagagcattataattccctttatcaccatataaacatgtcacttatccggaaagcatacaatttatttgtacatgagaatgtaaatttaaaaattttctgaaaactagattaaatcttgagaagcaattttcaagtaaacaaaaacatgccatgttaatcagcactagatctcccccaccccccacataatgtgtatgtacacatttctcaaattcagactgcagtacagctgtctccttggaggcgtcaggggttcctaagcctaaattctacctctagggtcttgatccctcaagagttcatcctgagttaaaattttgttatccccggaagcagagatgcactgactctggtgatctcagtatgaatgtggtatgaaatcttctaggtgtctgtggtggggcctgagggagggtaggaaaggtgacgaggaaaaagtagagggagcctgaacaccctgggtctcaggtacggagtgaagaaatcactaaggtgaaaagacaggctggggcccaggagctcgtccaagtcctgatgaacaacaagtcctgggcaacatcacaggccaccaaacacaccttcagctccagggtcgaatagatggtggaagagcacagccatctggaaaatcagaaaaaagtggggaagattttctatcttgaacttgtgagctggagaattaccattagtagcccactaataggttatggccgatgagtcccttcataacacactgagagccacttttgacactcccagaaaaggcaggttaacaaaaccccttgatggaaggaagaccctcattgcccaatgtacccaagcctctttgaaccttgcttagactgaactgcaaatgtcttgactgctctgggctccttagtgcaactccttcccacagaagccatcaggagcctggtccaggaagctcctctcctacacctgccttaaaaggcccagctctgctggggagtaaggttcatgggggccgtcccaatgcaaaagggaatctctgccatcacccactgcaaccacatggtagccactctgcagccggcaggcgtgaggcatgctgcgctaacatgggagggcggaggctctgcctgacttcccagaagcccagtgagaagtccaggacaatcagcaggtgctatgggaaccttggctggcaggcaccatgtcgtcctgtatgatcggcaggaccggctccttcctgaagacaccgattcttggcggctcctgacaaggattgagaggatttgtgggggacagccctgaagccctgatccacaatcgaagggtgatcctcaagagtcagctctgacacaattcacc

SEQ ID NO: 455919 - DNA, 527 bp, Homo sapiens
cgattccattccagcgtaggcaacatagtgagaccaggtgtgatggcacgtgcctgtagtcccagctacttgggaggctgaggtggggaggactgcgcttccttaatgactgctgcggccagaatgcaacgtggcttaatttctcggttgatccttctccttccccgccttgggtttctagcagcagttttctcttgatttcagattgtcttgggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagctgtatgcaggagctattcttgaagtttgtggatgaaaattgggaaggttccctcaagtccaaggtatataaaatttactccagtaaactgttcagtcatttaaaatcaacattttatgtgaatcgttttcactatatattccca

SEQ ID NO: 455920 - DNA, 1845 bp, Homo sapiens
gagaagaaggcggggctaaaactggcgaaggcgtggcttcttggctgcttgacgaagtgtcgtgaataaaagaaaggagaccgcagaagtaaagaagtggggagtttaggcaagtgcctgatttgggtaatcgaaagcacccagtgattgtatttgatgacttttaagctttcatatgccgttatttaatacctgtcacttccaaatgagagatgtaagggcaacggccgttagcgttctgttttggatcaggctctggagtggacgcccctagcttaggggtccttctaggcagccagaaacctgcggaaaatggtagcgatggcggctgggccgagtgggtgtctggtgccggcgtttgggctacggttgttgttggcgactgtgcttcaagcggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagctgtatgcaggagctattcttgaagtttgtggatgaaaattgggaaggttccctcaagtccaagcttttgttaggagtgataaacccaaactgttcagaggactgcaaatcaagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaagtttcaaaaatctatctgaatttggaattcttctggtttgttctttcatgtttaaaaatgatgtttttcaatgcatttttttcatgtaagccctttttttagccaaaatgtaaaaatggctgtaatatttaaaacttataacatcttattgttggtaatagtgctttatatttgtctgattttatttttcaaagttttttcatttatgaacacattttcattggtatattatttaaggaatatctcttgatatagaatttttatattaaaaatgatttttctttgcttaaaaatct

SEQ ID NO: 455921 - DNA, 1559 bp, Homo sapiens
gagaagaaggcggggctaaaactggcgaaggcgtggcttcttggctgcttgacgaagtgtcgtgaataaaagaaaggagaccgcagaagtaaagaagtggggagtttaggcaagtgcctgatttgggtaatcgaaagcacccagtgattgtatttgatgacttttaagctttcatatgccgttatttaatacctgtcacttccaaatgagagatgtaagggcaacggccgttagcgttctgttttggatcaggctctggagtggacgcccctagcttaggggtccttctaggcagccagaaacctgcggaaaatggtagcgatggcggctgggccgagtgggtgtctggtgccggcgtttgggctacggttgttgttggcgactgtgcttcaagcggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagctgtatgcaggagctattcttgaagtttgtggatgaaaattgggaaggttccctcaagtccaagcttttgttaggagtgataaacccaaactgttcagaggactgcaaatcaagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaagtttcaaaaa

SEQ ID NO: 455922 - DNA, 2057 bp, Homo sapiens
  misc_feature (1563)..(1563): n is a, c, g, or t
gagaagaaggcggggctaaaactggcgaaggcgtggcttcttggctgcttgacgaagtgtcgtgaataaaagaaaggagaccgcagaagtaaagaagtggggagtttaggcaagtgcctgatttgggtaatcgaaagcacccagtgattgtatttgatgacttttaagctttcatatgccgttatttaatacctgtcacttccaaatgagagatgtaagggcaacggccgttagcgttctgttttggatcaggctctggagtggacgcccctagcttaggggtccttctaggcagccagaaacctgcggaaaatggtagcgatggcggctgggccgagtgggtgtctggtgccggcgtttgggctacggttgttgttggcgactgtgcttcaagcggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagctgtatgcaggagctattcttgaagtttgtggatgaaaattgggaaggttccctcaagtccaagcttttgttaggagtgataaacccaaactgttcagaggactgcaaatcaagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaagtttcaaaaaaaanaaaaaaaaaaaaaaaaaaaaaaaaaaaaaaaaaaaaaaaaaaaaaaaaaaaaaaacaaaaaaaaaaaaaaaaaataaaaaataaaacaaactaataaatacaaaaaaaaaaaaaaacttattggcccaattggccctataattagaaatttaacaattaattggccggggttaaacatcgaggccattgggaaaattctgcctaaacgaaaccaaatcaaaattcaaggacatcccttttaacacagctgcaaaagtaaacactagggctaaaccaattaaatttcccaataaaaaaccaccttaccgcaattggaaaatgaaggagaaaccattccgtaaaactcttcccaaaaattttggaaaaccaagtggattttgaaaactttaaggcgaaaatttttaggaaaaaaatttgggttaaaaatttttgaacaaaattagtattttataccaaatgcagctaaaacgagaaatcccttttaaaagaaagag

SEQ ID NO: 455923 - DNA, 1678 bp, Homo sapiens
gagaagaaggcggggctaaaactggcgaaggcgtggcttcttggctgcttgacgaagtgtcgtgaataaaagaaaggagaccgcagaagtaaagaagtggggagtttaggcaagtgcctgatttgggtaatcgaaagcacccagtgattgtatttgatgacttttaagctttcatatgccgttatttaatacctgtcacttccaaatgagagatgtaagggcaacggccgttagcgttctgttttggatcaggctctggagtggacgcccctagcttaggggtccttctaggcagccagaaacctgcggaaaatggtagcgatggcggctgggccgagtgggtgtctggtgccggcgtttgggctacggttgttgttggcgactgtgcttcaagcggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagctgtatgcaggagctattcttgaagtttgtggatgaaaattgggaaggttccctcaagtccaagcttttgttaggagtgataaacccaaactgttcagaggactgcaaatcaagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaagtttcaaaaatggacttttctgtaagaatgtaaaactcaaaatttgccaagtatgtatctgatccacacaatccttagaaaggttttctgtgtagtcttcattaacgcaatctttgtgaatgtttcact

SEQ ID NO: 455924 - DNA, 1568 bp, Homo sapiens
gtatcaacgcagagtggccattatccggggggaaaatggtagcgatggcggctgggccgagtgggtgtctggtgccggcgtttgggctacggttgttgttggcgactgtgcttcaagcggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagctgtatgcaggagctattcttgaagtttgtggatgaaaattgggaaggttccctcaagtccaagcttttgttaggagtgataaacccaaactgttcagaggactgcaaatcaagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaagtttcaaaaatctatctgaatttggaattcttctggtttgttctttcatgtttaaaaatgatgtttttcaatgcatttttttcatgtaagccctttttttagccaaaatgtaaaaatggctgtaatatttaaaacttataacatcttattgttggtaatagtgctttatatttgtctgattttatttttcaaagttttttcatttatgaacacattttcattggtatattatttaaggaatatctcttgatatagaatttttatattaaaaatgatttttctttgcttaaaaatct

SEQ ID NO: 455925 - DNA, 1539 bp, Homo sapiens
gagaagaaggcggggctaaaactggcgaaggcgtggcttcttggctgcttgacgaagtgtcgtgaataaaagaaaggagaccgcagaagtaaagaagtggggagtttaggcaagtgcctgatttgggtaatcgaaagcacccagtgattgtatttgatgacttttaagctttcatatgccgttatttaatacctgtcacttccaaatgagagatgtaagggcaacggccgttagcgttctgttttggatcaggctctggagtggacgcccctagcttaggggtccttctaggcagccagaaacctgcggaaaatggtagcgatggcggctgggccgagtgggtgtctggtgccggcgtttgggctacggttgttgttggcgactgtgcttcaagcggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagctgtatgcaggagctattcttgaagtttgtggatgaaaattgggaaggttccctcaagtccaagcttttgttaggagtgataaacccaaactgttcagaggactgcaaatcaagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatattttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaagtttcaaaaa

SEQ ID NO: 455926 - DNA, 1272 bp, Homo sapiens
gagaagaaggcggggctaaaactggcgaaggcgtggcttcttggctgcttgacgaagtgtcgtgaataaaagaaaggagaccgcagaagtaaagaagtggggagtttaggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagctgtatgcaggagctattcttgaagtttgtggatgaaaattgggaaggttccctcaagtccaagcttttgttaggagtgataaacccaaactgttcagaggactgcaaatcaagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaagtttcaaaaa

SEQ ID NO: 455927 - DNA, 1505 bp, Homo sapiens
gagaagaaggcggggctaaaactggcgaaggcgtggcttcttggctgcttgacgaagtgtcgtgaataaaagaaaggagaccgcagaagtaaagaagtggggagtttaggcaagtgcctgatttgggtaatcgaaagcacccagtgattgtatttgatgacttttaagctttcatatgccgttatttaatacctgtcacttccaaatgagagatgtaagggcaacggccgttagcgttctgttttggatcaggctctggagtggacgcccctagcttaggggtccttctaggcagccagaaacctgcggctacggttgttgttggcgactgtgcttcaagcggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagctgtatgcaggagctattcttgaagtttgtggatgaaaattgggaaggttccctcaagtccaagcttttgttaggagtgataaacccaaactgttcagaggactgcaaatcaagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaagtttcaaaaa

SEQ ID NO: 455928 - DNA, 1256 bp, Homo sapiens
cggcatagggtctgtaggctgtggaggagaggtagtggccgggatttgattctggttgtggtgggaagttgttggaacagaatgacgtggtctgtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagctgtatgcaggagctattcttgaagtttgtggatgaaaattgggaaggttccctcaagtccaagcttttgttaggagtgataaacccaaactgttcagaggactgcaaatcaagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaagtttcaaaaa

SEQ ID NO: 455929 - DNA, 1257 bp, Homo sapiens
gctggagctcaaggatccttaattaaattaatttccccccccccgagaaacctgcggaaaatggtagcgatggcggctgggccgagtgggtgtctggtgccggcgtttgggctacggttgttgttggcgactgtgcttcaagcggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagctgtatgcaggagctattcttgaagtttgtggatgaaaattgggaaggttccctcaagtccaagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaagtttcaaaaa

SEQ ID NO: 455930 - DNA, 1139 bp, Homo sapiens
gctggagctcaaggatccttaattaaattaatttccccccccccgagaaacctgcggaaaatggtagcgatggcggctgggccgagtgggtgtctggtgccggcgtttgggctacggttgttgttggcgactgtgcttcaagcgctgtatgcaggagctattcttgaagtttgtggatgaaaattgggaaggttccctcaagtccaagcttttgttaggagtgataaacccaaactgttcagaggactgcaaatcaagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaagtttcaaaaa

SEQ ID NO: 455931 - DNA, 1050 bp, Homo sapiens
  misc_feature (19)..(19): n is a, c, g, or t
  misc_feature (29)..(30): n is a, c, g, or t
taaaaataaaaaaaaaaanaataggggannagttaggtataagtactaacttaagctgtatgcaggagctattcttgaagtttgtggatgaaaattgggaaggttccctcaagtccaagcttttgttaggagtgataaacccaaactgttcagaggactgcaaatcaagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaagtttcaaaaa

SEQ ID NO: 455932 - DNA, 1509 bp, Homo sapiens
gagaagaaggcggggctaaaactggcgaaggcgtggcttcttggctgcttgacgaagtgtcgtgaataaaagaaaggagaccgcagaagtaaagaagtggggagtttaggcaagtgcctgatttgggtaatcgaaagcacccagtgattgtatttgatgacttttaagctttcatatgccgttatttaatacctgtcacttccaaatgagagatgtaagggcaacggccgttagcgttctgttttggatcaggctctggagtggacgcccctagcttaggggtccttctaggcagccagaaacctgcggaaaatggtagcgatggcggctgggccgagtgggtgtctggtgccggcgtttgggctacggttgttgttggcgactgtgcttcaagcggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagctgtatgcaggagctattcttgaagtttgtggatgaaaattgggaaggttccctcaagtccaagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaagtttcaaaaa

SEQ ID NO: 455933 - DNA, 1505 bp, Homo sapiens
gagaagaaggcggggctaaaactggcgaaggcgtggcttcttggctgcttgacgaagtgtcgtgaataaaagaaaggagaccgcagaagtaaagaagtggggagtttaggcaagtgcctgatttgggtaatcgaaagcacccagtgattgtatttgatgacttttaagctttcatatgccgttatttaatacctgtcacttccaaatgagagatgtaagggcaacggccgttagcgttctgttttggatcaggctctggagtggacgcccctagcttaggggtccttctaggcagccagaaacctgcggaaaatggtagcgatggcggctgggccgagtgggtgtctggtgccggcgtttgggctacggttgttgttggcgactgtgcttcaagcggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagctgtatgcaggagctattcttgaagtttgtggatgaaaattgggaaggttccctcaagtccaagcttttgttaggagtgataaacccaaactgttcagaggactgcaaatcaagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaagtttcaaaaa

SEQ ID NO: 455934 - DNA, 1351 bp, Homo sapiens
gctggagctcaaggatccttaattaaattaatttccccccccccgagaaacctgcggaaaatggtagcgatggcggctgggccgagtgggtgtctggtgccggcgtttgggctacggttgttgttggcgactgtgcttcaagcggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagctgtatgcaggagctattcttgaagtttgtggatgaaaattgggaaggttccctcaagtccaagcttttgttaggagtgataaacccaaactgttcagaggactgcaaatcaagagtgattaagaggtcctattgctccacatcctcaccagctttagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaagtttcaaaaa

SEQ ID NO: 455935 - DNA, 1222 bp, Homo sapiens
gagaagaaggcggggctaaaactggcgaaggcgtggcttcttggctgcttgacgaagtgtcgtgaataaaagaaaggagaccgcagaagtaaagaagtggggagtttaggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagctgtatgcaggagctattcttgaagtttgtggatgaaaattgggaaggttccctcaagtccaagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaagtttcaaaaa

SEQ ID NO: 455936 - DNA, 1603 bp, Homo sapiens
gagaagaaggcggggctaaaactggcgaaggcgtggcttcttggctgcttgacgaagtgtcgtgaataaaagaaaggagaccgcagaagtaaagaagtggggagtttaggcaagtgcctgatttgggtaatcgaaagcacccagtgattgtatttgatgacttttaagctttcatatgccgttatttaatacctgtcacttccaaatgagagatgtaagggcaacggccgttagcgttctgttttggatcaggctctggagtggacgcccctagcttaggggtccttctaggcagccagaaacctgcggaaaatggtagcgatggcggctgggccgagtgggtgtctggtgccggcgtttgggctacggttgttgttggcgactgtgcttcaagcggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagctgtatgcaggagctattcttgaagtttgtggatgaaaattgggaaggttccctcaagtccaagcttttgttaggagtgataaacccaaactgttcagaggactgcaaatcaagagtgattaagaggtcctattgctccacatcctcaccagctttagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaagtttcaaaaa

SEQ ID NO: 455937 - DNA, 982 bp, Homo sapiens
taagttactttatccaaatcgatcgatactaatgacgccgacaccaccttacttttgttaggagtgataaacccaaactgttcagaggactgcaaatcaagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaagtttcaaaaa

SEQ ID NO: 455938 - DNA, 1298 bp, Homo sapiens
gctggagctcaaggatccttaattaaattaatttccccccccccgagaaacctgcggaaaatggtagcgatggcggctgggccgagtgggtgtctggtgccggcgtttgggctacggttgttgttggcgactgtgcttcaagcggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagtattcatccattgtttctaagcaagaatgccatcactcaaactgtatgcaggagctattcttgaagtttgtggatgaaaattgggaaggttccctcaagtccaagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaagtttcaaaaa

SEQ ID NO: 455939 - DNA, 1203 bp, Homo sapiens
gctggagctcaaggatccttaattaaattaatttccccccccccgagaaacctgcggaaaatggtagcgatggcggctgggccgagtgggtgtctggtgccggcgtttgggctacggttgttgttggcgactgtgcttcaagcggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagctgtatgcaggagctattcttgaagtttgtggatgtaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaagtttcaaaaa

SEQ ID NO: 455940 - DNA, 991 bp, Homo sapiens
gagcaccagactgtaattattaagttcgcgtacattgcgtatcgatccaaaccacttagcttttagactaggagtgatattccaaactgttcagaggactgcaaatcaagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaagtttcaaaaa

SEQ ID NO: 455941 - DNA, 938 bp, Homo sapiens
tccgccggctctaccgcggtgtcttaatatatttgagagagaaagaaggaaccttagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaagtttcaaaaa

SEQ ID NO: 455942 - DNA, 531 bp, Homo sapiens
  misc_feature (29)..(29): n is a, c, g, or t
agtgcacctgaatgcctgactgagtcgantctagagtatcccttcatttaggcaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaagtttcaaaaa

SEQ ID NO: 455943 - DNA, 458 bp, Homo sapiens
gctggagctcaaggatccttaattaaattaatttccccccccccgagaaacctgcggaaaatggtagcgatggcggctgggccgagtgggtgtctggtgccggcgtttgggctacggttgttgttggcgactgtgcttcaagcggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagctgtatgcaggagctattcttgaagtttgtggatgaaaattgggaaggttccctcaagtccaagagtctcactgtcgcccacactggagtgcagtggcgcaatttcagctcaccgcaacctctgcctcccaggttcaagtgattct

SEQ ID NO: 455944 - DNA, 301 bp, Homo sapiens
ggaggtggaggttgcagtgagctgagattgtgccactacactgcagcctgggtgacagagcaagaccctttctcatgaatgaatgaatgaatgaatgagtgatttttttaattctcctttttttccgaaatcctgtaaaactcttctccttaaagatttcctttaagacttgtttattgtcatgtctaaaagcctttttttaattactaaatttaaactggattgaattgctttgtcttagatgaggctgagaaggttgtttctgaacagaaagtaatgatgacgtccctcttttttgtag

SEQ ID NO: 455945 - DNA, 1593 bp, Homo sapiens
gctggagctcaaggatccttaattaaattaatttccccccccccgagaaacctgcggaaaatggtagcgatggcggctgggccgagtgggtgtctggtgccggcgtttgggctacggttgttgttggcgactgtgcttcaagcggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagctgtatgcaggagctattcttgaagtttgtggatgaaaattgggaaggttccctcaagtccaagcttttgttaggagtgataaacccaaactgttcagaggactgcaaatcaagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaagtttcaaaaatctatctgaatttggaattcttctggtttgttctttcatgtttaaaaatgatgtttttcaatgcatttttttcatgtaagccctttttttagccaaaatgtaaaaatggctgtaatatttaaaacttataacatcttattgttggtaatagtgctttatatttgtctgattttatttttcaaagttttttcatttatgaacacattttcattggtatattatttaaggaatatctcttgatatagaatttttatattaaaaatgatttttctttgcttaaaaatct

SEQ ID NO: 455946 - DNA, 1348 bp, Homo sapiens
gctggagctcaaggatccttaattaaattaatttccccccccccgagaaacctgcggaaaatggtagcgatggcggctgggccgagtgggtgtctggtgccggcgtttgggctacggttgttgttggcgactgtgcttcaagcggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagtattcatccattgtttctaagcaagaatgccatcactcaaactgtatgcaggagctattcttgaagtttgtggatgaaaattgggaaggttccctcaagtccaagcttttgttaggagtgataaacccaaactgttcagaggactgcaaatcaagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaagtttcaaaaa

SEQ ID NO: 455947 - DNA, 1287 bp, Homo sapiens
gctggagctcaaggatccttaattaaattaatttccccccccccgagaaacctgcggaaaatggtagcgatggcggctgggccgagtgggtgtctggtgccggcgtttgggctacggttgttgttggcgactgtgcttcaagcggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagcttttgttaggagtgataaacccaaactgttcagaggactgcaaatcaagagtgattaagaggtcctattgctccacatcctcaccagctttagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaagtttcaaaaa

SEQ ID NO: 455948 - DNA, 463 bp, Homo sapiens
gctggagctcaaggatccttaattaaattaatttccccccccccgagaaacctgcggaaaatggtagcgatggcggctgggccgagtgggtgtctggtgccggcgtttgggctacggttgttgttggcgactgtgcttcaagcggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagctgtatgcaggagctattcttgaagtttgtggatgaaaattgggaaggttccctcaagtccaagccttttttgggtttttttttaaaaggggggggcccaaaaagggggctttttgggggtcaaaaattttttaacctgtattaaagcttt

SEQ ID NO: 455949 - DNA, 1337 bp, Homo sapiens
ctaggtcgaggctgggtgtgaatcggcacgaggcaggctggccagcttcctctgcgctccggaaagctgcggcccagcgcggactagtgaggacctccacagctcctgacattgccaggagtcctgtcggcgttttctcccagcctccgccatgccggcggtgctgggttttgaaggcagcgccaataagattggcgtgggcgtggtgcgggatggcaaggtgctggcgaacccgcggcggacttacgtcacgcctcctggcacaggattccttccaggtgatacagccaggcatcaccgagctgttatcctagacctgctgcaggaggcactaacagagtctggattaacctcccaggatatcgactgcattgcatacaccaagggccctggcatgggtgccccactggtttctgtggctgttgtggcccgtactgtggcccagctgtggaataagccattggtgggtgtgaaccactgtataggccacattgagatgggccgcctcatcactggagccaccagcccaaccgtgttgtatgtgagtggaggaaatacgcaggtgattgcatactcggaacatcgttaccgtatctttggggaaaccatcgatattgcagtgggtaattgtctggatcgttttgctcgagtgctgaagatttctaacgacccaagtccaggatacaacattgaacagatggcaaagcgaggcaagaagctagttgagctgccatacactgtaaaggggatggacgtctcattctcagggatcctgtctttcattgaggatgtagcccatcggatgctggccacaggcgagtgtactcctgaggatctgtgtttctccctgcaggaaactgtgtttgcaatgctggtagagatcacagagcgagccatggcacattgtggctcccaggaggccctcattgtgggaggagtggggtgtaatgtgaggctacaggagatgatggcaacaatgtgccaggaacgtggagcccggctttttgctacagatgagagattctgtattgacaatggagcgatgatagcccaggctggctgggagatgtttcgggctggacacaggaccccactcagtgattctggggttacacagaggtatcggacagatgaagtagaggtgacctggagggactaataagatcaacagaatcagagtagatagttccttaatcggaacccaaaggaccccgtgcctcaatctctatcctgatgtcatgggagtcctagcaaagctatagactccaagcaaggcttggggtcctttatggaaccccaggatgactcagcaataaaatatttttggttttttggtt

SEQ ID NO: 455950 - DNA, 663 bp, Homo sapiens
tcccatcttaaaaaggtcatatacgtacccaaacaactttagtctgcacctataaatataaaataccttctggccggccttggtgaatacacgcctataatcccagcactttgagaggctgaggcaggtagattgcttgagaccaggagtttgagaccaggctgggcaacatagtgagacccccatctctacaaaaatataaaaataagccacacatggtagcccagctactcaggaagctgaggtgggaggatcctttgagcctaggaggtggaggctacagtgagctatgatcacaccactccactccagcctgggagacagagcgagaccctgtctcaaaaaaaaattaccactgccactgtgtcataatttagaaggattcatgttctctgcctccaagcagaaaagccagttacctactatcaagactgcatttaagggatatattaggaacttctaagccggaaaaccaatgtatttgaaatgacaatttatttctgcctgaacctacactgtctaggaatctgttcctggaatcctcagggtatacagatttcttctcaaatcagagctgtaaaaactacccattcaccatttgggccacctattgaaattgagaatcactacacatcagagaatcgaccgaccgactataggtac

SEQ ID NO: 455951 - DNA, 1596 bp, Homo sapiens
aaaaaaaaaaaaaaaaacccaatctttcttgtgtacaaaattgtgcggccgctcgcgatgaactagccagcacattgtgtgacactgacttaagattctaactatgtgcaagagggaaaaaaacagtggagaaggctgggctggaccacgggaaagagataggaaaacggatacgaatgtaaggcacagagttggctcggcgtccctggcagttaggaagacaggtccctggaggggccttggcgggtctccgctcgcgggagttccgcggtgtctttcccagtgctatctgcaggctggccagcttcctctgcgctccggaaagctgcggcccagcgcggactagtgaggacctccacagctcctgacattgccaggagtcctgtcggcgttttctcccagcctccgccatgccggcggtgctgggttttgaaggcagcgccaataagattggcgtgggcgtggtgcgggatggcaaggtgctggcgaacccgcggcggacttacgtcacgcctcctggcacaggattccttccaggtgatacagccaggcatcaccgagctgttatcctagacctgctgcaggaggcactaacagagtctggattaacctcccaggatatcgactgcattgcatacaccaagggccctggcatgggtgccccactggtttctgtggctgttgtggcccgtactgtggcccagctgtggaataagccattggtgggtgtgaaccactgtataggccacattgagatgggccgcctcatcactggagccaccagcccaaccgtgttgtatgtgagtggaggaaatacgcaggtgattgcatactcggaacatcgttaccgtatctttggggaaaccatcgatattgcagtgggtaattgtctggatcgttttgctcgagtgctgaagatttctaacgacccaagtccaggatacaacattgaacagatggcaaagcgaggcaagaagctagttgagctgccatacactgtaaaggggatggacgtctcattctcagggatcctgtctttcattgaggatgtagcccatcggatgctggccacaggcgagtgtactcctgaggatctgtgtttctccctgcaggaaactgtgtttgcaatgctggtagagatcacagagcgagccatggcacattgtggctcccaggaggccctcattgtgggaggagtggggtgtaatgtgaggctacaggagatgatggcaacaatgtgccaggaacgtggagcccggctttttgctacagatgagagattctgtattgacaatggagcgatgatagcccaggctggctgggagatgtttcgggctggacacaggaccccactcagtgattctggggttacacagaggtatcggacagatgaagtagaggtgacctggagggactaataagatcaacagaatcagagtagatagttccttaatcggaacccaaaggaccccgtgcctcaatctctatcctgatgtcatgggagtcctagcaaagctatagactccaagcaaggcttggggtcctttatggaaccccaggatgactcagcaataaaatatttttggttttttggtt

SEQ ID NO: 455952 - DNA, 1550 bp, Homo sapiens
ctaggtcgaggctgggtgtgaatcggcacgaggcaggctggccagcttcctctgcgctccggaaagctgcggcccagcgcggactagtgaggacctccacagctcctgacattgccaggagtcctgtcggcgttttctcccagcctccgccatgccggcggtgctgggttttgaaggcagcgccaataagattggcgtgggcgtggtgcgggatggcaaggtgctggcgaacccgcggcggacttacgtcacgcctcctggcacaggattccttccaggtgatacagccaggcatcaccgagctgttatcctagacctgctgcaggaggcactaacagagtctggattaacctcccaggatatcgactgcattgcatacaccaagggccctggcatgggtgccccactggtttctgtggctgttgtggcccgtactgtggcccagctgtggaataagccattggtgggtgtgaaccactgtataggccacattgagatgggccgcctcatcactggagccaccagcccaaccgtgttgtatgtgagtggaggaaatacgcaggtgattgcatactcggaacatcgttaccgtatctttggggaaaccatcgatattgcagtgggtaattgtctggatcgttttgctcgagtgctgaagatttctaacgacccaagtccaggatacaacattgaacagatggcaaagcgaggcaagaagctagttgagctgccatacactgtaaaggggatggacgtctcattctcagggatcctgtctttcattgaggatgtagcccatcggatgctggccacaggcgagtgtactcctgaggatctgtgtttctccctgcaggaaactgtgtttgcaatgctggtagagatcacagagcgagccatggcacattgtggctcccaggaggccctcattgtgggaggagtggggtgtatgtattattgaaaagtgttcctctttcctattcttaacactatgcgtcttcctcctggtactctaaatcattaagcgtttggagtaggcttcccaatccttgcccctaatcccctatgtcattgttctaagtgagtgcacatgacgtgttctgctggaccatgaagagatggctaaaactaagctaatcctgttccctgcctctttgtaggtaatgtgaggctacaggagatgatggcaacaatgtgccaggaacgtggagcccggctttttgctacagatgagagattctgtattgacaatggagcgatgatagcccaggctggctgggagatgtttcgggctggacacaggaccccactcagtgattctggggttacacagaggtatcggacagatgaagtagaggtgacctggagggactaataagatcaacagaatcagagtagatagttccttaatcggaacccaaaggaccccgtgcctcaatctctatcctgatgtcatgggagtcctagcaaagctatagactccaagcaaggcttggggtcctttatggaaccccaggatgactcagcaataaaatatttttggttttttggtt

SEQ ID NO: 455953 - DNA, 1720 bp, Homo sapiens
  misc_feature (1563)..(1563): n is a, c, g, or t
ctaggtcgaggctgggtgtgaatcggcacgaggcaggctggccagcttcctctgcgctccggaaagctgcggcccagcgcggactagtgaggacctccacagctcctgacattgccaggagtcctgtcggcgttttctcccagcctccgccatgccggcggtgctgggttttgaaggcagcgccaataagattggcgtgggcgtggtgcgggatggcaaggtgctggcgaacccgcggcggacttacgtcacgcctcctggcacaggattccttccaggtgatacagccaggcatcaccgagctgttatcctagacctgctgcaggaggcactaacagagtctggattaacctcccaggatatcgactgcattgcatacaccaagggccctggcatgggtgccccactggtttctgtggctgttgtggcccgtactgtggcccagctgtggaataagccattggtgggtgtgaaccactgtataggccacattgagatgggccgcctcatcactggagccaccagcccaaccgtgttgtatgtgagtggaggaaatacgcaggtgattgcatactcggaacatcgttaccgtatctttggggaaaccatcgatattgcagtgggtaattgtctggatcgttttgctcgagtgctgaagatttctaacgacccaagtccaggatacaacattgaacagatggcaaagcgaggcaagaagctagttgagctgccatacactgtaaaggggatggacgtctcattctcagggatcctgtctttcattgaggatgtagcccatcggatgctggccacaggcgagtgtactcctgaggatctgtgtttctccctgcaggaaactgtgtttgcaatgctggtagagatcacagagcgagccatggcacattgtggctcccaggaggccctcattgtgggaggagtggggtgtatgtattattgaaaagtgttcctctttcctattcttaacactatgcgtcttcctcctggtactctaaatcattaagcgtttggagtaggcttcccaatccttgcccctaatcccctatgtcattgttctaagtgagtgcacatgacgtgttctgctggaccatgaagagatggctaaaactaagctaatcctgttccctgcctctttgtaggtaatgtgaggctacaggagatgatggcaacaatgtgccaggaacgtggagcccggctttttgctacagatgagagattctgtattgacaatggagcgatgatagcccaggctggctgggagatgtttcgggctggacacaggaccccactcagtgattctggggttacacagaggtatcggacagatgaagtagaggtgacctggagggactaataagatcaacagaatcagagtagatagttccttaatcggaacccaaaggaccccgtgcctcaatctctatcctgatgtcatgggagtcctagcaaagctatagactccaagcaaggcttggggtcctttatggaaccccaggatgactcagcaataaaatatttttggttttttggttaaaaaaaaaaaanatatatcctttcatccttaccccaaatttttcttataaattctcttataaaaaccttccagatagtcccctttccaaattaaccttttcccgctccctacctttccatggccgtgcctttaaaattcatgggtggaaaaccttgagctttccaatct

SEQ ID NO: 455954 - DNA, 1296 bp, Homo sapiens
  misc_feature (23)..(23): n is a, c, g, or t
cttcaggctagtagaggcgggtngactgcggcccagcgcggactagtgaggacctccacagctcctgacattgccaggagtcctgtcggcgttttctcccagcctccgccatgccggcggtgctgggttttgaaggcagcgccaataagattggcgtgggcgtggtgcgggatggcaaggtgctggcgaacccgcggcggacttacgtcacgcctcctggcacaggattccttccaggtgatacagccaggcatcaccgagctgttatcctagacctgctgcaggaggcactaacagagtctggattaacctcccaggatatcgactgcattgcatacaccaagggccctggcatgggtgccccactggtttctgtggctgttgtggcccgtactgtggcccagctgtggaataagccattggtgggtgtgaaccactgtataggccacattgagatgggccgcctcatcactggagccaccagcccaaccgtgttgtatgtgagtggaggaaatacgcaggtgattgcatactcggaacatcgttaccgtatctttggggaaaccatcgatattgcagtgggtaattgtctggatcgttttgctcgagtgctgaagatttctaacgacccaagtccaggatacaacattgaacagatggcaaagcgaggcaagaagctagttgagctgccatacactgtaaaggggatggacgtctcattctcagggatcctgtctttcattgaggatgtagcccatcggatgctggccacaggcgagtgtactcctgaggatctgtgtttctccctgcaggaaactgtgtttgcaatgctggtagagatcacagagcgagccatggcacattgtggctcccaggaggccctcattgtgggaggagtggggtgtaatgtgaggctacaggagatgatggcaacaatgtgccaggaacgtggagcccggctttttgctacagatgagagattctgtattgacaatggagcgatgatagcccaggctggctgggagatgtttcgggctggacacaggaccccactcagtgattctggggttacacagaggtatcggacagatgaagtagaggtgacctggagggactaataagatcaacagaatcagagtagatagttccttaatcggaacccaaaggaccccgtgcctcaatctctatcctgatgtcatgggagtcctagcaaagctatagactccaagcaaggcttggggtcctttatggaaccccaggatgactcagcaataaaatatttttggttttttggtt

SEQ ID NO: 455955 - DNA, 1104 bp, Homo sapiens
  misc_feature (888)..(888): n is a, c, g, or t
ctaggtcgaggctgggtgtgaatcggcacgaggcaggctggccagcttcctctgcgctccggaaagctgcggcccagcgcggactagtgaggacctccacagctcctgacattgccaggagtcctgtcggcgttttctcccagcctccgccatgccggcggtgctgggttttgaaggcagcgccaataagattggcgtgggcgtggtgcgggatggcaaggtgctggcgaacccgcggcggacttacgtcacgcctcctggcacaggattccttccaggtgatacagccaggcatcaccgagctgttatcctagacctgctgcaggaggcactaacagagtctggattaacctcccaggatatcgactgcattgcatacaccaagggccctggcatgggtgccccactggtttctgtggctgttgtggcccgtactgtggcccagctgtggaataagccattggtgggtgtgaaccactgtataggccacattgagatgggccgcctcatcactggagccaccagcccaaccgtgttgtatgtgagtggaggaaatacgcaggtgattgcatactcggaacatcgttaccgtatctttggggaaaccatcgatattgcagtgggtaattgtctggatcgttttgctcgagtgctgaagatttctaacgacccaagtccaggatacaacattgaacagatggcaaagcgaggcaagaagctagttgagctgccatacactgtaaaggggatggacgtctcattctcagggatcctgtctttcattgaggatgtagcccatcggatgctggccacaggcgagtgtactcctgaggatctgtgtttctccctgcagaaacgtcgttttgccgcctcgctagattcacacgngcgcccggggccttggggttccccgaaggcccatgtgtgagacggggcgtatgtgtagggccacggaatatgttccattgtccgaaagagccggttcgttgacatcgaactcttgtctaggcgaaacacggccgcgtcgtatgtgttgcggccccctttgttgcgttcataagacggcgggaaagaatatgtagccgcccctgtgctacagaccac

SEQ ID NO: 455956 - DNA, 2592 bp, Homo sapiens
cggacgcgtgggtcgacccacgcgtccggttctagatcgcgagcggcctccctaagtgctgggattacaggcgtgagccaccatgcccggccagaaggtattttaaatttataggtgaagctaaagttgtttgggttaccttatatgacctttttaaggttgggattggattcttttccaacagaacacttgattatcattagaaatagttcagcattgtccccagctcatgaaagggttgtgtcgagaagatgaggcacatgtttcccatgaaaatgatgcagaaacttcagcaggtagagggcaagtagttggttgaggcctgaaggatgacatacaaggtcagagacttgggttgtggaaagtataatggaggctacaagagttgatgaaaggagcagtgacggttttgtcttcctcttctcttttaatgtttgcttaggtgtaagaaacagggagggtgattaggtggagaggagtggatagcagaagcagaaaggcaggatttttccttcgcctttgttactgtctttttgacagcagattaagatctgtatcagaaagggaagaaatccctaacagcactgggaagggaaagggacttcttaaggttcgtaggaagccctcggtgttataagtctgcagaatatgtgtcagtaagggacagatattctctgtgctaaaagttggtcacatatgaagaacggccttaatacaaaaaagtggtggtgggtgcctgtaattccagctgcttgggaggctgaggcaggagaattgcttgaacctgggaggcagaggttgcagtgagctgagatcacgccattgcactccagcctaggcgacagaacaagactctgtctcagaaaaaaaaaaaaaagaaaagaaaaatggccttaagtgaattgccattgctgacttggctgggccattagtctgactccatatgagatttttgagttcttcagctctgcttcttggttctaaataccactgcccagctgcatacggtggttcacacctataatcccagcactttgagaggctgaggcaggtagattgcttgagaccaggagtttgagaccaggctgggcaacatagtgagacccccatctctacaaaaatataaaaataagccacacatggtagcccagctactcaggaagctgaggtgggaggatcctttgagcctaggaggtggaggctacagtgagctatgatcacaccactccactccagcctgggagacagagcgagaccctgtctcaaaaaaaaattaccactgccactgtgtcataatttagaaggattcatgttctctgcctccaagcagaaaagccagttacctactatcaagactgcatttaagggatatattaggaacttctaagccggaaaaccaatgtatttgaaatgacaatttatttctgcctgaacctacactgtctaggaatctgttcctggaatcctcagggtatacagatttcttctcaaatcagagctgtaaaaactacccattcaccatttgggaaacacctttcttccacttcttattggaagccctggtggtcatgttgatcctctgctatgtttttctcccaaagccaaataatcctctttacagacttggggtttcatggacatcctcatcacccttaggtgattgcatactcggaacatcgttaccgtatctttggggaaaccatcgatattgcagtgggtaattgtctggatcgttttgctcgagtgctgaaggtaagccagtggggcttgcagagaacataaaatgtggggtgaattttttgggaagccatgggaggtggagggaggaaatagtaaatgagcttcttatgcttcctgcatatctgatttcatcctcttccattccctccttccttatttttttcttctgctagatttctaacgacccaagtccaggatacaacattgaacagatggcaaagcgaggcaagaagctagttgagctgccatacactgtaaaggggatggacgtctcattctcagggatcctgtctttcattgaggatgtagcccatcggatgctggccacaggcgagtgtactcctgaggatctgtgtttctccctgcaggaaactgtgtttgcaatgctggtagagatcacagagcgagccatggcacattgtggctcccaggaggccctcattgtgggaggagtggggtgtaatgtgaggctacaggagatgatggcaacaatgtgccaggaacgtggagcccggctttttgctacagatgagagattctgtattgacaatggagcgatgatagcccaggctggctgggagatgtttcgggctggacacaggaccccactcagtgattctggggttacacagaggtatcggacagatgaagtagaggtgacctggagggactaataagatcaacagaatcagagtagatagttccttaatcggaacccaaaggaccccgtgcctcaatctctatcctgatgtcatgggagtcctagcaaagctatagactccaagcaaggcttggggtcctttatggaaccccaggatgactcagcaataaaatatttttggttttttggtt

SEQ ID NO: 455957 - DNA, 1151 bp, Homo sapiens
ctaggtcgaggctgggtgtgaatcggcacgaggcaggctggccagcttcctctgcgctccggaaagctgcggcccagcgcggactagtgaggacctccacagctcctgacattgccaggagtcctgtcggcgttttctcccagcctccgccatgccggcggtgctgggttttgaaggcagcgccaataagattggcgtgggcgtggtgcgggatggcaaggtgctggcgaacccgcggcggacttacgtcacgcctcctggcacaggattccttccaggtgatacagccaggcatcaccgagctgttatcctagacctgctgcaggaggcactaacagagtctggattaacctcccaggatatcgactgcattgcatacaccaagggccctggcatgggtgccccactggtttctgtggctgttgtggcccgtactgtggcccagctgtggaataagccattggtgggtgtgaaccactgtataggccacattgagatgggccgcctcatcactggagccaccagcccaaccgtgttgtatgtgagtggaggaaatacgcaggtgattgcatactcggaacatcgttaccgtatctttggggaaaccatcgatattgcagtgggtaattgtctggatcgttttgctcgagtgctgaagatttctaacgacccaagtccaggatacaacattgaacagatggcaaagcgaggcaagaagctagttgagctgccatacactgtaaaggggatggacgtctcattctcagggatcctgtctttcattgaggtgagtgtgagaggtgatgagacgggcactttcatgctttttaaatgaagcatatctgttttacttacgattatatttcgtatagctcagtatattcatgtagcacagtactggtccatatcatgtgctgggtaaattcatttagaaggtattcattgaatatctctgtgtgccacatgctgttctagatagtagagatgcagcatggagcaaaacaaaaatccctgtctacatggagcttagattctaaatggggggcgggggagataagaaagaggaaaataatgaagtgccagatgatgatgagtacaggtgaaaaattaagcaggataagtaaggggtgagagatgtcaggacaagtatt

SEQ ID NO: 455958 - DNA, 1434 bp, Homo sapiens
ctttgggacaagctaaggccctgaataccgaatcgagctccggaacccaaccttggtcagtgacagagctgagactgtctcaaaagagaaaaaaaaaaaaaagatgcacgaaagggtatgaggtagataccacttgcattgagacctgaaggctgagtagggtaagaagaagagcatttctgaaagttgaatagcctatatagaagccggaaagagtagatgtgaaaatgtggaagataggatgcttggggaaagtgaaaggactcttactacatcactaaaactcctgttgctttctttaacttcctacctacctttgctacagaaaatccctgtgatctctgacctatgttcattttctaggattccttccaggtgatacagccaggcatcaccgagctgttatcctagacctgctgcaggaggcactaacagagtctggattaacctcccaggatatcgactgcattgcatacaccaagggccctggcatgggtgccccactggtttctgtggctgttgtggcccgtactgtggcccagctgtggaataagccattggtgggtgtgaaccactgtataggccacattgagatgggccgcctcatcactggagccaccagcccaaccgtgttgtatgtgagtggaggaaatacgcaggtgattgcatactcggaacatcgttaccgtatctttggggaaaccatcgatattgcagtgggtaattgtctggatcgttttgctcgagtgctgaagatttctaacgacccaagtccaggatacaacattgaacagatggcaaagcgaggcaagaagctagttgagctgccatacactgtaaaggggatggacgtctcattctcagggatcctgtctttcattgaggatgtagcccatcggatgctggccacaggcgagtgtactcctgaggatctgtgtttctccctgcaggaaactgtgtttgcaatgctggtagagatcacagagcgagccatggcacattgtggctcccaggaggccctcattgtgggaggagtggggtgtaatgtgaggctacaggagatgatggcaacaatgtgccaggaacgtggagcccggctttttgctacagatgagagattctgtattgacaatggagcgatgatagcccaggctggctgggagatgtttcgggctggacacaggaccccactcagtgattctggggttacacagaggtatcggacagatgaagtagaggtgacctggagggactaataagatcaacagaatcagagtagatagttccttaatcggaacccaaaggaccccgtgcctcaatctctatcctgatgtcatgggagtcctagcaaagctatagactccaagcaaggcttggggtcctttatggaaccccaggatgactcagcaataaaatatttttggttttttggtt

SEQ ID NO: 455959 - DNA, 1372 bp, Homo sapiens
ctaggtcgaggctgggtgtgaatcggcacgaggcaggctggccagcttcctctgcgctccggaaagctgcggcccagcgcggactagtgaggacctccacagctcctgacattgccaggagtcctgtcggcgttttctcccagcctccgccatgccggcggtgctgggttttgaaggcagcgccaataagattggcgtgggcgtggtgcgggatggcaaggtgctggcgaacccgcggcggacttacgtcacgcctcctggcacaggattccttccaggtgatacagccaggcatcaccgagctgttatcctagacctgctgcaggaggcactaacagagtctggattaacctcccaggatatcgactgcattgcatacaccaagggccctggcatgggtgccccactggtttctgtggctgttgtggcccgtactgtggcccagctgtggaataagccattggtgggtgtgaaccactgtataggccacattgagatgggccgcctcatcactggagccaccagcccaaccgtgttgtatgtgagtggaggaaatacgcagacttggggtttcatggacatcctcatcacccttaggtgattgcatactcggaacatcgttaccgtatctttggggaaaccatcgatattgcagtgggtaattgtctggatcgttttgctcgagtgctgaagatttctaacgacccaagtccaggatacaacattgaacagatggcaaagcgaggcaagaagctagttgagctgccatacactgtaaaggggatggacgtctcattctcagggatcctgtctttcattgaggatgtagcccatcggatgctggccacaggcgagtgtactcctgaggatctgtgtttctccctgcaggaaactgtgtttgcaatgctggtagagatcacagagcgagccatggcacattgtggctcccaggaggccctcattgtgggaggagtggggtgtaatgtgaggctacaggagatgatggcaacaatgtgccaggaacgtggagcccggctttttgctacagatgagagattctgtattgacaatggagcgatgatagcccaggctggctgggagatgtttcgggctggacacaggaccccactcagtgattctggggttacacagaggtatcggacagatgaagtagaggtgacctggagggactaataagatcaacagaatcagagtagatagttccttaatcggaacccaaaggaccccgtgcctcaatctctatcctgatgtcatgggagtcctagcaaagctatagactccaagcaaggcttggggtcctttatggaaccccaggatgactcagcaataaaatatttttggttttttggtt

SEQ ID NO: 455960 - DNA, 1922 bp, Homo sapiens
ctaggtcgaggctgggtgtgaatcggcacgaggcaggctggccagcttcctctgcgctccggaaagctgcggcccagcgcggactagtgaggacctccacagctcctgacattgccaggagtcctgtcggcgttttctcccagcctccgccatgccggcggtgctgggttttgaaggcagcgccaataagattggcgtgggcgtggtgcgggatggcaaggtgctggcgaacccgcggcggacttacgtcacgcctcctggcacaggattccttccaggtgatacagccaggcatcaccgagctgttatcctagacctgctgcaggaggcactaacagagtctggattaacctcccaggatatcgactgcattgcatacaccaagggccctggcatgggtgccccactggtttctgtggctgttgtggcccgtactgtggcccagctgtggaataagccattggtgggtgtgaaccactgtataggccacattgagatgggccgcctcatcactggagccaccagcccaaccgtgttgtatgtgagtggaggaaatacgcaggtatttagagggctctacccactccatctcaatttctgaggcactgaaccagtattttctttgttctatctgagtcatgggaatgtcaggaacaaagatggacttatctgaacctaaaatactgtagaccagaaaacccccaacagagtttgtaacattgcaaattttggcagcatgatcagaacattagatggcttatcattatcagactttatatctgattataaagattaggaatttctacttcaggaaaggaatgaatgggattgaaaaggattgaaatcttcaaaataatgaatatctgaaagctcttgcattattttgaagcttattttttctataaatcttagcaattgaaactaacagttgctgggtatggcaactcatgcgtgcctgtaatcctagcaactccggaggctgggcaggagaatcacttgaacccaggaggcagaagttgcggtgaaccgagatcgcaccattgcattccagcctgggcaacaagagcaaaactccgtctcaaacaaacaaacaaacaaaaaacaaaaaaaaacaactaaaggacactacctgatttattattttggggtgattgcatactcggaacatcgttaccgtatctttggggaaaccatcgatattgcagtgggtaattgtctggatcgttttgctcgagtgctgaagatttctaacgacccaagtccaggatacaacattgaacagatggcaaagcgaggcaagaagctagttgagctgccatacactgtaaaggggatggacgtctcattctcagggatcctgtctttcattgaggatgtagcccatcggatgctggccacaggcgagtgtactcctgaggatctgtgtttctccctgcaggaaactgtgtttgcaatgctggtagagatcacagagcgagccatggcacattgtggctcccaggaggccctcattgtgggaggagtggggtgtaatgtgaggctacaggagatgatggcaacaatgtgccaggaacgtggagcccggctttttgctacagatgagagattctgtattgacaatggagcgatgatagcccaggctggctgggagatgtttcgggctggacacaggaccccactcagtgattctggggttacacagaggtatcggacagatgaagtagaggtgacctggagggactaataagatcaacagaatcagagtagatagttccttaatcggaacccaaaggaccccgtgcctcaatctctatcctgatgtcatgggagtcctagcaaagctatagactccaagcaaggcttggggtcctttatggaaccccaggatgactcagcaataaaatatttttggttttttggtt

SEQ ID NO: 455961 - DNA, 1010 bp, Homo sapiens
ccccctgggttttatcggcacgaggctccaggatatcgactgcattgcatacaccaagggccctggcatgggtgccccactggtttctgtggctgttgtggcccgtactgtggcccagctgtggaataagccattggtgggtgtgaaccactgtataggccacattgagatgggccgcctcatcactggagccaccagcccaaccgtgttgtatgtgagtggaggaaatacgcaggtgattgcatactcggaacatcgttaccgtatctttggggaaaccatcgatattgcagtgggtaattgtctggatcgttttgctcgagtgctgaagatttctaacgacccaagtccaggatacaacattgaacagatggcaaagcgaggcaagaagctagttgagctgccatacactgtaaaggggatggacgtctcattctcagggatcctgtctttcattgaggatgtagcccatcggatgctggccacaggcgagtgtactcctgaggatctgtgtttctccctgcaggaaactgtgtttgcaatgctggtagagatcacagagcgagccatggcacattgtggctcccaggaggccctcattgtgggaggagtggggtgtaatgtgaggctacaggagatgatggcaacaatgtgccaggaacgtggagcccggctttttgctacagatgagagattctgtattgacaatggagcgatgatagcccaggctggctgggagatgtttcgggctggacacaggaccccactcagtgattctggggttacacagaggtatcggacagatgaagtagaggtgacctggagggactaataagatcaacagaatcagagtagatagttccttaatcggaacccaaaggaccccgtgcctcaatctctatcctgatgtcatgggagtcctagcaaagctatagactccaagcaaggcttggggtcctttatggaaccccaggatgactcagcaataaaatatttttggttttttggtt

SEQ ID NO: 455962 - DNA, 2200 bp, Homo sapiens
ctttgggacaagctaaggccctgaataccgaatcgagctccggaacccaaccttggtcagtgacagagctgagactgtctcaaaagagaaaaaaaaaaaaaagatgcacgaaagggtatgaggtagataccacttgcattgagacctgaaggctgagtagggtaagaagaagagcatttctgaaagttgaatagcctatatagaagccggaaagagtagatgtgaaaatgtggaagataggatgcttggggaaagtgaaaggactcttactacatcactaaaactcctgttgctttctttaacttcctacctacctttgctacagaaaatccctgtgatctctgacctatgttcattttctaggattccttccaggtgatacagccaggcatcaccgagctgttatcctagacctgctgcaggaggcactaacagagtctggattaacctcccaggatatcgactgcattgcatacaccaaggggtatggctgggagagtggtcaacgatggaggaatatacctgcaacctggctaggtcaaaatagccaacaccttacctctgccaccatcactacccctaccccacctcacatcccttatgtcccccacctattgtttttttccaatctctaggattataacttccatttctatctccctaggccctggcatgggtgccccactggtttctgtggctgttgtggcccgtactgtggcccagctgtggaataagccattggtgggtgtgaaccactgtataggccacattgagatgggccgcctcatcactggagccaccagcccaaccgtgttgtatgtgagtggaggaaatacgcaggtatttagagggctctacccactccatctcaatttctgaggcactgaaccagtattttctttgttctatctgagtcatgggaatgtcaggaacaaagatggacttatctgaacctaaaatactgtagaccagaaaacccccaacagagtttgtaacattgcaaattttggcagcatgatcagaacattagatggcttatcattatcagactttatatctgattataaagattaggaatttctacttcaggaaaggaatgaatgggattgaaaaggattgaaatcttcaaaataatgaatatctgaaagctcttgcattattttgaagcttattttttctataaatcttagcaattgaaactaacagttgctgggtatggcaactcatgcgtgcctgtaatcctagcaactccggaggctgggcaggagaatcacttgaacccaggaggcagaagttgcggtgaaccgagatcgcaccattgcattccagcctgggcaacaagagcaaaactccgtctcaaacaaacaaacaaacaaaaaacaaaaaaaaacaactaaaggacactacctgatttattattttggggtgattgcatactcggaacatcgttaccgtatctttggggaaaccatcgatattgcagtgggtaattgtctggatcgttttgctcgagtgctgaagatttctaacgacccaagtccaggatacaacattgaacagatggcaaagcgaggcaagaagctagttgagctgccatacactgtaaaggggatggacgtctcattctcagggatcctgtctttcattgaggatgtagcccatcggatgctggccacaggcgagtgtactcctgaggatctgtgtttctccctgcaggaaactgtgtttgcaatgctggtagagatcacagagcgagccatggcacattgtggctcccaggaggccctcattgtgggaggagtggggtgtaatgtgaggctacaggagatgatggcaacaatgtgccaggaacgtggagcccggctttttgctacagatgagagattctgtattgacaatggagcgatgatagcccaggctggctgggagatgtttcgggctggacacaggaccccactcagtgattctggggttacacagaggtatcggacagatgaagtagaggtgacctggagggactaataagatcaacagaatcagagtagatagttccttaatcggaacccaaaggaccccgtgcctcaatctctatcctgatgtcatgggagtcctagcaaagctatagactccaagcaaggcttggggtcctttatggaaccccaggatgactcagcaataaaatatttttggttttttggtt

SEQ ID NO: 455963 - DNA, 1410 bp, Homo sapiens
aaaaaaaaaaaaaaaaacccaatctttcttgtgtacaaaattgtgcggccgctcgcgatgaactagccagcacattgtgtgacactgacttaagattctaactatgtgcaagagggaaaaaaacagtggagaaggctgggctggaccacgggaaagagataggaaaacggatacgaatgtaaggcacagagttggctcggcgtccctggcagttaggaagacaggtccctggaggggccttggcgggtctccgctcgcgggagttccgcggtgtctttcccagtgctatctgcaggctggccagcttcctctgcgctccggaaagctgcggcccagcgcggactagtgaggacctccacagctcctgacattgccaggagtcctgtcggcgttttctcccagcctccgccatgccggcggtgctgggttttgaaggcagcgccaataagattggcgtgggcgtggtgcgggatggcaaggtgctggcgaacccgcggcggacttacgtcacgcctcctggcacaggattccttccaggtgatacagccaggcatcaccgagctgttatcctagacctgctgcaggaggcactaacagagtctggattaacctcccaggatatcgactgcattgcatacaccaagggccctggcatgggtgccccactggtttctgtggctgttgtggcccgtactgtggcccagctgtggaataagccattggtgggtgtgaaccactgtataggccacattgagatgggccgcctcatcactggagccaccagcccaaccgtgttgtatgtgagtggaggaaatacgcaggtgattgcatactcggaacatcgttaccgtatctttggggaaaccatcgatattgcagtgggtaattgtctggatcgttttgctcgagtgctgaagatttctaacgacccaagtccaggatacaacattgaacagatggcaaagcgaggcaagaagctagttgagctgccatacactgtaaaggggatggacgtctcattctcagggatcctgtctttcattgaggtgagtgtgagaggtgatgagacgggcactttcatgctttttaaatgaagcatatctgttttacttacgattatatttcgtatagctcagtatattcatgtagcacagtactggtccatatcatgtgctgggtaaattcatttagaaggtattcattgaatatctctgtgtgccacatgctgttctagatagtagagatgcagcatggagcaaaacaaaaatccctgtctacatggagcttagattctaaatggggggcgggggagataagaaagaggaaaataatgaagtgccagatgatgatgagtacaggtgaaaaattaagcaggataagtaaggggtgagagatgtcaggacaagtatt

SEQ ID NO: 455964 - DNA, 2916 bp, Homo sapiens
cggacgcgtgggtcgacccacgcgtccggttctagatcgcgagcggcctccctaagtgctgggattacaggcgtgagccaccatgcccggccagaaggtattttaaatttataggtgaagctaaagttgtttgggttaccttatatgacctttttaaggttgggattggattcttttccaacagaacacttgattatcattagaaatagttcagcattgtccccagctcatgaaagggttgtgtcgagaagatgaggcacatgtttcccatgaaaatgatgcagaaacttcagcaggtagagggcaagtagttggttgaggcctgaaggatgacatacaaggtcagagacttgggttgtggaaagtataatggaggctacaagagttgatgaaaggagcagtgacggttttgtcttcctcttctcttttaatgtttgcttaggtgtaagaaacagggagggtgattaggtggagaggagtggatagcagaagcagaaaggcaggatttttccttcgcctttgttactgtctttttgacagcagattaagatctgtatcagaaagggaagaaatccctaacagcactgggaagggaaagggacttcttaaggttcgtaggaagccctcggtgttataagtctgcagaatatgtgtcagtaagggacagatattctctgtgctaaaagttggtcacatatgaagaacggccttaatacaaaaaagtggtggtgggtgcctgtaattccagctgcttgggaggctgaggcaggagaattgcttgaacctgggaggcagaggttgcagtgagctgagatcacgccattgcactccagcctaggcgacagaacaagactctgtctcagaaaaaaaaaaaaaagaaaagaaaaatggccttaagtgaattgccattgctgacttggctgggccattagtctgactccatatgagatttttgagttcttcagctctgcttcttggttctaaataccactgcccagctgcatacggtggttcacacctataatcccagcactttgagaggctgaggcaggtagattgcttgagaccaggagtttgagaccaggctgggcaacatagtgagacccccatctctacaaaaatataaaaataagccacacatggtagcccagctactcaggaagctgaggtgggaggatcctttgagcctaggaggtggaggctacagtgagctatgatcacaccactccactccagcctgggagacagagcgagaccctgtctcaaaaaaaaattaccactgccactgtgtcataatttagaaggattcatgttctctgcctccaagcagaaaagccagttacctactatcaagactgcatttaagggatatattaggaacttctaagccggaaaaccaatgtatttgaaatgacaatttatttctgcctgaacctacactgtctaggaatctgttcctggaatcctcagggtatacagatttcttctcaaatcagagctgtaaaaactacccattcaccatttgggaaacacctttcttccacttcttattggaagccctggtggtcatgttgatcctctgctatgtttttctcccaaagccaaataatcctctttacagacttggggtttcatggacatcctcatcacccttaggtgattgcatactcggaacatcgttaccgtatctttggggaaaccatcgatattgcagtgggtaattgtctggatcgttttgctcgagtgctgaaggtaagccagtggggcttgcagagaacataaaatgtggggtgaattttttgggaagccatgggaggtggagggaggaaatagtaaatgagcttcttatgcttcctgcatatctgatttcatcctcttccattccctccttccttatttttttcttctgctagatttctaacgacccaagtccaggatacaacattgaacagatggcaaagcgaggcaagaagctagttgagctgccatacactgtaaaggggatggacgtctcattctcagggatcctgtctttcattgaggatgtagcccatcggatgctggccacaggcgagtgtactcctgaggatctgtgtttctccctgcaggtaatgcagtaaaaaactgggacagaaagttggggctgaaggttttatattgtagagcagaactaatctgggatgcccctctaatattttctccttatctgtccctgacaggaaactgtgtttgcaatgctggtagagatcacagagcgagccatggcacattgtggctcccaggaggccctcattgtgggaggagtggggtgtatgtattattgaaaagtgttcctctttcctattcttaacactatgcgtcttcctcctggtactctaaatcattaagcgtttggagtaggcttcccaatccttgcccctaatcccctatgtcattgttctaagtgagtgcacatgacgtgttctgctggaccatgaagagatggctaaaactaagctaatcctgttccctgcctctttgtaggtaatgtgaggctacaggagatgatggcaacaatgtgccaggaacgtggagcccggctttttgctacagatgagagattctgtattgacaatggagcgatgatagcccaggctggctgggagatgtttcgggctggacacaggaccccactcagtgattctggggttacacagaggtatcggacagatgaagtagaggtgacctggagggactaataagatcaacagaatcagagtagatagttccttaatcggaacccaaaggaccccgtgcctcaatctctatcctgatgtcatgggagtcctagcaaagctatagactccaagcaaggcttggggtcctttatggaaccccaggatgactcagcaataaaatatttttggttttttggtt

SEQ ID NO: 455965 - DNA, 774 bp, Homo sapiens
ggcagctgaatcagcagtcaagggcctgcctgtttggtactacagcttcaaggcggagattaagaaaacaaatagtgccacgggaggagatcggatcctgagtgcttgcaccggcctaggcctgaactgctttgggggcctcatgacggaccgacctggctcctctgtagcagcagcctcagcaacgcattctcctcgcctggttccgcttcatccactatgtacacgcttgctcccccgctcctcccacaggcgagtgtactcctgaggatctgtgtttctccctgcaggaaactgtgtttgcaatgctggtagagatcacagagcgagccatggcacattgtggctcccaggaggccctcattgtgggaggagtggggtgtaatgtgaggctacaggagatgatggcaacaatgtgccaggaacgtggagcccggctttttgctacagatgagagattctgtattgacaatggagcgatgatagcccaggctggctgggagatgtttcgggctggacacaggaccccactcagtgattctggggttacacagaggtatcggacagatgaagtagaggtgacctggagggactaataagatcaacagaatcagagtagatagttccttaatcggaacccaaaggaccccgtgcctcaatctctatcctgatgtcatgggagtcctagcaaagctatagactccaagcaaggcttggggtcctttatggaaccccaggatgactcagcaataaaatatttttggttttttggtt

SEQ ID NO: 455966 - DNA, 934 bp, Homo sapiens
ctctcgtgtaatcccaaaaccatgatttgttgattcttttgtttttccctttaattgtaggatgtagcccatcggatgctggccacaggcgagtgtactcctgaggatctgtgtttctccctgcaggtaatgcagtaaaaaactgggacagaaagttggggctgaaggttttatattgtagagcagaactaatctgggatgcccctctaatattttctccttatctgtccctgacaggaaactgtgtttgcaatgctggtagagatcacagagcgagccatggcacattgtggctcccaggaggccctcattgtgggaggagtggggtgtatgtattattgaaaagtgttcctctttcctattcttaacactatgcgtcttcctcctggtactctaaatcattaagcgtttggagtaggcttcccaatccttgcccctaatcccctatgtcattgttctaagtgagtgcacatgacgtgttctgctggaccatgaagagatggctaaaactaagctaatcctgttccctgcctctttgtaggtaatgtgaggctacaggagatgatggcaacaatgtgccaggaacgtggagcccggctttttgctacagatgagagattctgtattgacaatggagcgatgatagcccaggctggctgggagatgtttcgggctggacacaggaccccactcagtgattctggggttacacagaggtatcggacagatgaagtagaggtgacctggagggactaataagatcaacagaatcagagtagatagttccttaatcggaacccaaaggaccccgtgcctcaatctctatcctgatgtcatgggagtcctagcaaagctatagactccaagcaaggcttggggtcctttatggaaccccaggatgactcagcaataaaatatttttggttttttggtt

SEQ ID NO: 455967 - DNA, 1783 bp, Homo sapiens
cggacgcgtgggtcgacccacgcgtccggttctagatcgcgagcggcctccctaagtgctgggattacaggcgtgagccaccatgcccggccagaaggtattttaaatttataggtgaagctaaagttgtttgggttaccttatatgacctttttaaggttgggattggattcttttccaacagaacacttgattatcattagaaatagttcagcattgtccccagctcatgaaagggttgtgtcgagaagatgaggcacatgtttcccatgaaaatgatgcagaaacttcagcaggtagagggcaagtagttggttgaggcctgaaggatgacatacaaggtcagagacttgggttgtggaaagtataatggaggctacaagagttgatgaaaggagcagtgacggttttgtcttcctcttctcttttaatgtttgcttaggtgtaagaaacagggagggtgattaggtggagaggagtggatagcagaagcagaaaggcaggatttttccttcgcctttgttactgtctttttgacagcagattaagatctgtatcagaaagggaagaaatccctaacagcactgggaagggaaagggacttcttaaggttcgtaggaagccctcggtgttataagtctgcagaatatgtgtcagtaagggacagatattctctgtgctaaaagttggtcacatatgaagaacggccttaatacaaaaaagtggtggtgggtgcctgtaattccagctgcttgggaggctgaggcaggagaattgcttgaacctgggaggcagaggttgcagtgagctgagatcacgccattgcactccagcctaggcgacagaacaagactctgtctcagaaaaaaaaaaaaaagaaaagaaaaatggccttaagtgaattgccattgctgacttggctgggccattagtctgactccatatgagatttttgagttcttcagctctgcttcttggttctaaataccactgcccagctgcatacggtggttcacacctataatcccagcactttgagaggctgaggcaggtagattgcttgagaccaggagtttgagaccaggctgggcaacatagtgagacccccatctctacaaaaatataaaaataagccacacatggtagcccagctactcaggaagctgaggtgggaggatcctttgagcctaggaggtggaggctacagtgagctatgatcacaccactccactccagcctgggagacagagcgagaccctgtctcaaaaaaaaattaccactgccactgtgtcataatttagaaggattcatgttctctgcctccaagcagaaaagccagttacctactatcaagactgcatttaagggatatattaggaacttctaagccggaaaaccaatgtatttgaaatgacaatttatttctgcctgaacctacactgtctaggaatctgttcctggaatcctcagggtatacagatttcttctcaaatcagagctgtaaaaactacccattcaccatttgggaaacacctttcttccacttcttattggaagccctggtggtatcggacagatgaagtagaggtgacctggagggactaataagatcaacagaatcagagtagatagttccttaatcggaacccaaaggaccccgtgcctcaatctctatcctgatgtcatgggagtcctagcaaagctatagactccaagcaaggcttggggtcctttatggaaccccaggatgactcagcaataaaatatttttggttttttggtt

SEQ ID NO: 455968 - DNA, 900 bp, Homo sapiens
aaaaaaaaaaaaaaaaacccaatctttcttgtgtacaaaattgtgcggccgctcgcgatgaactagccagcacattgtgtgacactgacttaagattctaactatgtgcaagagggaaaaaaacagtggagaaggctgggctggaccacgggaaagagataggaaaacggatacgaatgtaaggcacagagttggctcggcgtccctggcagttaggaagacaggtccctggaggggccttggcgggtctccgctcgcgggagttccgcggtgtctttcccagtgctatctgcaggctggccagcttcctctgcgctccggaaagctgcggcccagcgcggactagtgaggacctccacagctcctgacattgccaggagtcctgtcggcgttttctcccagcctccgccatgccggcggtgctgggttttgaaggcagcgccaataagattggcgtgggcgtggtgcgggatggcaaggtgctggcgaacccgcggcggacttacgtcacgcctcctggcacaggattccttccaggtgatacagccaggcatcaccgagctgttatcctagacctgctgcaggaggcactaacagagtctggattaacctcccaggatatcgactgcattgcatacaccaaggacaggaccccactcagtgattctggggttacacagaggtatcggacagatgaagtagaggtgacctggagggactaataagatcaacagaatcagagtagatagttccttaatcggaacccaaaggaccccgtgcctcaatctctatcctgatgtcatgggagtcctagcaaagctatagactccaagcaaggcttggggtcctttatggaaccccaggatgactcagcaataaaatatttttggttttttggtt

SEQ ID NO: 455969 - DNA, 1005 bp, Homo sapiens
aaaaaaaaaaaaaaaaacccaatctttcttgtgtacaaaattgtgcggccgctcgcgatgaactagccagcacattgtgtgacactgacttaagattctaactatgtgcaagagggaaaaaaacagtggagaaggctgggctggaccacgggaaagagataggaaaacggatacgaatgtaaggcacagagttggctcggcgtccctggcagttaggaagacaggtccctggaggggccttggcgggtctccgctcgcgggagttccgcggtgtctttcccagtgctatctgcaggctggccagcttcctctgcgctccggaaagctgcggcccagcgcggactagtgaggacctccacagctcctgacattgccaggagtcctgtcggcgttttctcccagcctccgccatgccggcggtgctgggttttgaaggcagcgccaataagattggcgtgggcgtggtgcgggatggcaaggtgctggcgaacccgcggcggacttacgtcacgcctcctggcacaggttggtgagtaggggacttaagagttttccgcgcacttccccgcacagaatcagccttccatcttcctaaatactagtgaggtgcagctttcgatccgagtctcattgaaattatgtgacattattaacgtcacaaggctgatgactagaagagttacaggcacttggacgtggatctgatgagttcatttaccttttactgagcgcattttatgtgctaagtattcagaaatagatgttatactgctgtggagtcagacatataaatagatgtttatactacagcatgataaacagtataatagagatggactcgaaatattctgtttaaaaaacgcttagcaggagtatagattccagttgccctgaatatacactccctttttaaaaaaaaattattttttgaaatattctaggatgagtagagagatgagagtggaaagactcccggcttacatgtcagacagaactggctggctt

SEQ ID NO: 455970 - DNA, 460 bp, Homo sapiens
ttatatctgattataaagattaggaatttctacttcaggaaaggaatgaatgggattgaaaaggattgaaatcttcaaaataatgaatatctgaaagctcttgcattattttgaagcttattttttctataaatcttagcaattgaaactaacagttgctgggtatggcaactcatgcctgtaattccagcactttgggaggtcgaggcgggtggatcatctgaggtcaggagtttgagcccagcctggccaacgtggcaaaaccccatctgtactaaaaataacaaaaattaatttgatgtggtggcaggtgtgcctgtaatcctagcaactccggaggctgggcaggagaatcacttgaacccaggaggcagaagttgcggtgaaccgagatcgcaccattgcattccagcctgggcaacaagagcaaaactccgtctcaaacaaacaaacaaacaaa

SEQ ID NO: 455971 - DNA, 1993 bp, Homo sapiens
ctaggtcgaggctgggtgtgaatcggcacgaggcaggctggccagcttcctctgcgctccggaaagctgcggcccagcgcggactagtgaggacctccacagctcctgacattgccaggagtcctgtcggcgttttctcccagcctccgccatgccggcggtgctgggttttgaaggcagcgccaataagattggcgtgggcgtggtgcgggatggcaaggtgctggcgaacccgcggcggacttacgtcacgcctcctggcacaggattccttccaggtgatacagccaggcatcaccgagctgttatcctagacctgctgcaggaggcactaacagagtctggattaacctcccaggatatcgactgcattgcatacaccaagggccctggcatgggtgccccactggtttctgtggctgttgtggcccgtactgtggcccagctgtggaataagccattggtgggtgtgaaccactgtataggccacattgagatgggccgcctcatcactggagccaccagcccaaccgtgttgtatgtgagtggaggaaatacgcaggtgattgcatactcggaacatcgttaccgtatctttggggaaaccatcgatattgcagtgggtaattgtctggatcgttttgctcgagtgctgaagatttctaacgacccaagtccaggatacaacattgaacagatggcaaagcgaggcaagaagctagttgagctgccatacactgtaaaggggatggacgtctcattctcagggatcctgtctttcattgaggatgtagcccatcggatgctggccacaggcgagtgtactcctgaggatctgtgtttctccctgcaggaaactgtgtttgcaatgctggtagagatcacagagcgagccatggcacattgtggctcccaggaggccctcattgtgggaggagtggggtgtaatgtgaggctacaggagatgatggcaacaatgtgccaggaacgtggagcccggctttttgctacagatgagagattctgtattgacaatggagcgatgatagcccaggctggctgggagatgtttcgggctggacacaggaccccactcagtgattctggggttacacagaggtatcggacagatgaagtagaggtgacctggagggactaataagatcaacagaatcagagtagatagttccttaatcggaacccaaaggaccccgtgcctcaatctctatcctgatgtcatgggagtcctagcaaagctatagactccaagcaaggcttggggtcctttatggaaccccaggatgactcagcaataaaatatttttggttttttggtttgtatgtggtgattggattgtgttgttcaggaccaatgtagatttggtgctggataaattcttgttggagcttgctgctgtggaaccaagaatgaggtatctttttttttttttttaagaaacggaatcttgctgtgtttcccaggctggtctcgaactgggctcaagcagtcttaccacctcagcctcctgagtaaggatgccattgtgcctggcaacaatagtagtatcataactattattatagcatcgggtcccgtgctaactgctttacattcattctctcatttaaattctttgaagtaggtgtgcaagacttctctcaaaatagcctggaggctcacacctgttatcccagtgctgtgggaggccaagtcaggaggatcccttgagcccaggagtttgagcccagcctgggcaaatagcaagacaccatctatttgaaaaatgtaaaaattatctgggcatggtggcgcacatctgtagtcccagctccaagggaggctgaggcgggaagatagcttgagcccaggagtttgaggttgcagtgagctgtgattgagccactgcattccagcctgagtgacagaacaaaaccttgtctcttaaaaacaaacaaacaaacagcctggagattggtctaacttgtaactcta

SEQ ID NO: 455972 - DNA, 1691 bp, Homo sapiens
ctaggtcgaggctgggtgtgaatcggcacgaggcaggctggccagcttcctctgcgctccggaaagctgcggcccagcgcggactagtgaggacctccacagctcctgacattgccaggagtcctgtcggcgttttctcccagcctccgccatgccggcggtgctgggttttgaaggcagcgccaataagattggcgtgggcgtggtgcgggatggcaaggtgctggcgaacccgcggcggacttacgtcacgcctcctggcacaggattccttccaggtgatacagccaggcatcaccgagctgttatcctagacctgctgcaggaggcactaacagagtctggattaacctcccaggatatcgactgcattgcatacaccaagggccctggcatgggtgccccactggtttctgtggctgttgtggcccgtactgtggcccagctgtggaataagccattggtgggtgtgaaccactgtataggccacattgagatgggccgcctcatcactggagccaccagcccaaccgtgttgtatgtgagtggaggaaatacgcaggtgattgcatactcggaacatcgttaccgtatctttggggaaaccatcgatattgcagtgggtaattgtctggatcgttttgctcgagtgctgaagatttctaacgacccaagtccaggatacaacattgaacagatggcaaagcgaggcaagaagctagttgagctgccatacactgtaaaggggatggacgtctcattctcagggatcctgtctttcattgaggatgtagcccatcggatgctggccacaggcgagtgtactcctgaggatctgtgtttctccctgcaggaaactgtgtttgcaatgctggtagagatcacagagcgagccatggcacattgtggctcccaggaggccctcattgtgggaggagtggggtgtatgtattattgaaaagtgttcctctttcctattcttaacactatgcgtcttcctcctggtactctaaatcattaagcgtttggagtaggcttcccaatccttgcccctaatcccctatgtcattgttctaagtgagtgcacatgacgtgttctgctggaccatgaagagatggctaaaactaagctaatcctgttccctgcctctttgtaggtaatgtgaggctacaggagatgatggcaacaatgtgccaggaacgtggagcccggctttttgctacagatgagagattctgtattgacaatggagcgatgatagcccaggctggctgggagatgtttcgggctggacacaggaccccactcagtgattctggggttacacagagggtgagtgattcacctcttggtgagggtagattattgggacatagacaaaaacagcagggaagagtccaggaacatgagggcagagaagaatgaaggatgttaagggctcgctctccaccatgtttcttctgtttttccacgtatcggacagatgaagtagaggtgacctggagggactaataagatcaacagaatcagagtagatagttccttaatcggaacccaaaggaccccgtgcctcaatctctatcctgatgtcatgggagtcctagcaaagctatagactccaagcaaggcttggggtcctttatggaaccccaggatgactcagcaataaaatatttttggttttttggtt

SEQ ID NO: 455973 - DNA, 1252 bp, Homo sapiens
ctaggtcgaggctgggtgtgaatcggcacgaggcaggctggccagcttcctctgcgctccggaaagctgcggcccagcgcggactagtgaggacctccacagctcctgacattgccaggagtcctgtcggcgttttctcccagcctccgccatgccggcggtgctgggttttgaaggcagcgccaataagattggcgtgggcgtggtgcgggatggcaaggtgctggcgaacccgcggcggacttacgtcacgcctcctggcacaggattccttccaggtgatacagccaggcatcaccgagctgttatcctagacctgctgcaggaggcactaacagagtctggattaacctcccaggatatcgactgcattgcatacaccaagggccctggcatgggtgccccactggtttctgtggctgttgtggcccgtactgtggcccagctgtggaataagccattggtgggtgtgaaccactgtataggccacattgagatgggccgcctcatcactggagccaccagcccaaccgtgttgtatgtgagtggaggaaatacgcaggtgattgcatactcggaacatcgttaccgtatctttggggaaaccatcgatattgcagtgggtaattgtctggatcgttttgctcgagtgctgaagatttctaacgacccaagtccaggatacaacattgaacagatggcaaagcgaggcaagaagctagttgagctgccatacactgtaaaggggatggacgtctcattctcagggatcctgtctttcattgaggatgtagcccatcggatgctggccacaggcgagtgtactcctgaggatctgtgtttctccctgcaggaaactgtgtttgcaatgctggtagagatcacagagcgagccatggcacattgtggctcccaggaggccctcattgtgggaggagtggggtgtaatgtgaggctacaggagatgatggcaacaatgtgccaggaacgtggagcccggctttttgctacagatgagagattctgtattgacaatggagcgatgatagcccaggctggctgggagatgtttcgggctggacacaggaccccactcagtgattctggggttacacagagcagaagttatctgaaccagatgaagtagaagtggacctgtaggggacttaaataggaataactcggaattcagaaggttgaaaggttcccttaaattcgtaacctcgggacccccggggcctttttttttttg

SEQ ID NO: 455974 - DNA, 1498 bp, Homo sapiens
ctaggtcgaggctgggtgtgaatcggcacgaggcaggctggccagcttcctctgcgctccggaaagctgcggcccagcgcggactagtgaggacctccacagctcctgacattgccaggagtcctgtcggcgttttctcccagcctccgccatgccggcggtgctgggttttgaaggcagcgccaataagattggcgtgggcgtggtgcgggatggcaaggtgctggcgaacccgcggcggacttacgtcacgcctcctggcacaggattccttccaggtgatacagccaggcatcaccgagctgttatcctagacctgctgcaggaggcactaacagagtctggattaacctcccaggatatcgactgcattgcatacaccaagggccctggcatgggtgccccactggtttctgtggctgttgtggcccgtactgtggcccagctgtggaataagccattggtgggtgtgaaccactgtataggccacattgagatgggccgcctcatcactggagccaccagcccaaccgtgttgtatgtgagtggaggaaatacgcaggtgattgcatactcggaacatcgttaccgtatctttggggaaaccatcgatattgcagtgggtaattgtctggatcgttttgctcgagtgctgaaggtaagccagtggggcttgcagagaacataaaatgtggggtgaattttttgggaagccatgggaggtggagggaggaaatagtaaatgagcttcttatgcttcctgcatatctgatttcatcctcttccattccctccttccttatttttttcttctgctagatttctaacgacccaagtccaggatacaacattgaacagatggcaaagcgaggcaagaagctagttgagctgccatacactgtaaaggggatggacgtctcattctcagggatcctgtctttcattgaggatgtagcccatcggatgctggccacaggcgagtgtactcctgaggatctgtgtttctccctgcaggaaactgtgtttgcaatgctggtagagatcacagagcgagccatggcacattgtggctcccaggaggccctcattgtgggaggagtggggtgtaatgtgaggctacaggagatgatggcaacaatgtgccaggaacgtggagcccggctttttgctacagatgagagattctgtattgacaatggagcgatgatagcccaggctggctgggagatgtttcgggctggacacaggaccccactcagtgattctggggttacacagaggtatcggacagatgaagtagaggtgacctggagggactaataagatcaacagaatcagagtagatagttccttaatcggaacccaaaggaccccgtgcctcaatctctatcctgatgtcatgggagtcctagcaaagctatagactccaagcaaggcttggggtcctttatggaaccccaggatgactcagcaataaaatatttttggttttttggtt

SEQ ID NO: 455975 - DNA, 1533 bp, Homo sapiens
ctaggtcgaggctgggtgtgaatcggcacgaggcaggctggccagcttcctctgcgctccggaaagctgcggcccagcgcggactagtgaggacctccacagctcctgacattgccaggagtcctgtcggcgttttctcccagcctccgccatgccggcggtgctgggttttgaaggcagcgccaataagattggcgtgggcgtggtgcgggatggcaaggtgctggcgaacccgcggcggacttacgtcacgcctcctggcacaggattccttccaggtgatacagccaggcatcaccgagctgttatcctagacctgctgcaggaggcactaacagagtctggattaacctcccaggatatcgactgcattgcatacaccaagggccctggcatgggtgccccactggtttctgtggctgttgtggcccgtactgtggcccagctgtggaataagccattggtgggtgtgaaccactgtataggccacattgagatgggccgcctcatcactggagccaccagcccaaccgtgttgtatgtgagtggaggaaatacgcaggtgcctgtaatcctagcaactccggaggctgggcaggagaatcacttgaacccaggaggcagaagttgcggtgaaccgagatcgcaccattgcattccagcctgggcaacaagagcaaaactccgtctcaaacaaacaaacaaacaaaaaacaaaaaaaaacaactaaaggacactacctgatttattattttggggtgattgcatactcggaacatcgttaccgtatctttggggaaaccatcgatattgcagtgggtaattgtctggatcgttttgctcgagtgctgaagatttctaacgacccaagtccaggatacaacattgaacagatggcaaagcgaggcaagaagctagttgagctgccatacactgtaaaggggatggacgtctcattctcagggatcctgtctttcattgaggatgtagcccatcggatgctggccacaggcgagtgtactcctgaggatctgtgtttctccctgcaggaaactgtgtttgcaatgctggtagagatcacagagcgagccatggcacattgtggctcccaggaggccctcattgtgggaggagtggggtgtaatgtgaggctacaggagatgatggcaacaatgtgccaggaacgtggagcccggctttttgctacagatgagagattctgtattgacaatggagcgatgatagcccaggctggctgggagatgtttcgggctggacacaggaccccactcagtgattctggggttacacagaggtatcggacagatgaagtagaggtgacctggagggactaataagatcaacagaatcagagtagatagttccttaatcggaacccaaaggaccccgtgcctcaatctctatcctgatgtcatgggagtcctagcaaagctatagactccaagcaaggcttggggtcctttatggaaccccaggatgactcagcaataaaatatttttggttttttggtt

SEQ ID NO: 455976 - DNA, 1072 bp, Homo sapiens
  misc_feature (14)..(14): n is a, c, g, or t
  misc_feature (22)..(22): n is a, c, g, or t
  misc_feature (32)..(32): n is a, c, g, or t
ctgatctagagttncctctgtnattcaagcantcgagctgttatcctagacctgctgcaggaggcactaacagagtctggattaacctcccaggatatcgactgcattgcatacaccaagggccctggcatgggtgccccactggtttctgtggctgttgtggcccgtactgtggcccagctgtggaataagccattggtgggtgtgaaccactgtataggccacattgagatgggccgcctcatcactggagccaccagcccaaccgtgttgtatgtgagtggaggaaatacgcaggtgattgcatactcggaacatcgttaccgtatctttggggaaaccatcgatattgcagtgggtaattgtctggatcgttttgctcgagtgctgaagatttctaacgacccaagtccaggatacaacattgaacagatggcaaagcgaggcaagaagctagttgagctgccatacactgtaaaggggatggacgtctcattctcagggatcctgtctttcattgaggatgtagcccatcggatgctggccacaggcgagtgtactcctgaggatctgtgtttctccctgcaggaaactgtgtttgcaatgctggtagagatcacagagcgagccatggcacattgtggctcccaggaggccctcattgtgggaggagtggggtgtaatgtgaggctacaggagatgatggcaacaatgtgccaggaacgtggagcccggctttttgctacagatgagagattctgtattgacaatggagcgatgatagcccaggctggctgggagatgtttcgggctggacacaggaccccactcagtgattctggggttacacagaggtatcggacagatgaagtagaggtgacctggagggactaataagatcaacagaatcagagtagatagttccttaatcggaacccaaaggaccccgtgcctcaatctctatcctgatgtcatgggagtcctagcaaagctatagactccaagcaaggcttggggtcctttatggaaccccaggatgactcagcaataaaatatttttggttttttggtt

SEQ ID NO: 455977 - DNA, 1777 bp, Homo sapiens
aaaaaaaaaaaaaaaaacccaatctttcttgtgtacaaaattgtgcggccgctcgcgatgaactagccagcacattgtgtgacactgacttaagattctaactatgtgcaagagggaaaaaaacagtggagaaggctgggctggaccacgggaaagagataggaaaacggatacgaatgtaaggcacagagttggctcggcgtccctggcagttaggaagacaggtccctggaggggccttggcgggtctccgctcgcgggagttccgcggtgtctttcccagtgctatctgcaggctggccagcttcctctgcgctccggaaagctgcggcccagcgcggactagtgaggacctccacagctcctgacattgccaggagtcctgtcggcgttttctcccagcctccgccatgccggcggtgctgggttttgaaggcagcgccaataagattggcgtgggcgtggtgcgggatggcaaggtgctggcgaacccgcggcggacttacgtcacgcctcctggcacaggattccttccaggtgatacagccaggcatcaccgagctgttatcctagacctgctgcaggaggcactaacagagtctggattaacctcccaggatatcgactgcattgcatacaccaaggggtatggctgggagagtggtcaacgatggaggaatatacctgcaacctggctaggtcaaaatagccaacaccttacctctgccaccatcactacccctaccccacctcacatcccttatgtcccccacctattgtttttttccaatctctaggattataacttccatttctatctccctaggccctggcatgggtgccccactggtttctgtggctgttgtggcccgtactgtggcccagctgtggaataagccattggtgggtgtgaaccactgtataggccacattgagatgggccgcctcatcactggagccaccagcccaaccgtgttgtatgtgagtggaggaaatacgcaggtgattgcatactcggaacatcgttaccgtatctttggggaaaccatcgatattgcagtgggtaattgtctggatcgttttgctcgagtgctgaagatttctaacgacccaagtccaggatacaacattgaacagatggcaaagcgaggcaagaagctagttgagctgccatacactgtaaaggggatggacgtctcattctcagggatcctgtctttcattgaggatgtagcccatcggatgctggccacaggcgagtgtactcctgaggatctgtgtttctccctgcaggaaactgtgtttgcaatgctggtagagatcacagagcgagccatggcacattgtggctcccaggaggccctcattgtgggaggagtggggtgtaatgtgaggctacaggagatgatggcaacaatgtgccaggaacgtggagcccggctttttgctacagatgagagattctgtattgacaatggagcgatgatagcccaggctggctgggagatgtttcgggctggacacaggaccccactcagtgattctggggttacacagaggtatcggacagatgaagtagaggtgacctggagggactaataagatcaacagaatcagagtagatagttccttaatcggaacccaaaggaccccgtgcctcaatctctatcctgatgtcatgggagtcctagcaaagctatagactccaagcaaggcttggggtcctttatggaaccccaggatgactcagcaataaaatatttttggttttttggtt

SEQ ID NO: 455978 - DNA, 1595 bp, Homo sapiens
ctaggtcgaggctgggtgtgaatcggcacgaggcaggctggccagcttcctctgcgctccggaaagctgcggcccagcgcggactagtgaggacctccacagctcctgacattgccaggagtcctgtcggcgttttctcccagcctccgccatgccggcggtgctgggttttgaaggcagcgccaataagattggcgtgggcgtggtgcgggatggcaaggtgctggcgaacccgcggcggacttacgtcacgcctcctggcacaggattccttccaggtgatacagccaggcatcaccgagctgttatcctagacctgctgcaggaggcactaacagagtctggattaacctcccaggatatcgactgcattgcatacaccaagggccctggcatgggtgccccactggtttctgtggctgttgtggcccgtactgtggcccagctgtggaataagccattggtgggtgtgaaccactgtataggccacattgagatgggccgcctcatcactggagccaccagcccaaccgtgttgtatgtgagtggaggaaatacgcaggtgcctgtaatcctagcaactccggaggctgggcaggagaatcacttgaacccaggaggcagaagttgcggtgaaccgagatcgcaccattgcattccagcctgggcaacaagagcaaaactccgtctcaaacaaacaaacaaacaaaaaacaaaaaaaaacaactaaaggacactacctgatttattattttggggtgattgcatactcggaacatcgttaccgtatctttggggaaaccatcgatattgcagtgggtaattgtctggatcgttttgctcgagtgctgaagatttctaacgacccaagtccaggatacaacattgaacagatggcaaagcggtaaggggacataaggtggaagcaggctggctgctggggcttcagggatttccccatatacgaggcaagaagctagttgagctgccatacactgtaaaggggatggacgtctcattctcagggatcctgtctttcattgaggatgtagcccatcggatgctggccacaggcgagtgtactcctgaggatctgtgtttctccctgcaggaaactgtgtttgcaatgctggtagagatcacagagcgagccatggcacattgtggctcccaggaggccctcattgtgggaggagtggggtgtaatgtgaggctacaggagatgatggcaacaatgtgccaggaacgtggagcccggctttttgctacagatgagagattctgtattgacaatggagcgatgatagcccaggctggctgggagatgtttcgggctggacacaggaccccactcagtgattctggggttacacagaggtatcggacagatgaagtagaggtgacctggagggactaataagatcaacagaatcagagtagatagttccttaatcggaacccaaaggaccccgtgcctcaatctctatcctgatgtcatgggagtcctagcaaagctatagactccaagcaaggcttggggtcctttatggaaccccaggatgactcagcaataaaatatttttggttttttggtt

SEQ ID NO: 455979 - DNA, 1822 bp, Homo sapiens
ctaggtcgaggctgggtgtgaatcggcacgaggcaggctggccagcttcctctgcgctccggaaagctgcggcccagcgcggactagtgaggacctccacagctcctgacattgccaggagtcctgtcggcgttttctcccagcctccgccatgccggcggtgctgggttttgaaggcagcgccaataagattggcgtgggcgtggtgcgggatggcaaggtgctggcgaacccgcggcggacttacgtcacgcctcctggcacaggattccttccaggtgatacagccaggcatcaccgagctgttatcctagacctgctgcaggaggcactaacagagtctggattaacctcccaggatatcgactgcattgcatacaccaagggccctggcatgggtgccccactggtttctgtggctgttgtggcccgtactgtggcccagctgtggaataagccattggtgggtgtgaaccactgtataggccacattgagatgggccgcctcatcactggagccaccagcccaaccgtgttgtatgtgagtggaggaaatacgcaggtgattgcatactcggaacatcgttaccgtatctttggggaaaccatcgatattgcagtgggtaattgtctggatcgttttgctcgagtgctgaaggtaagccagtggggcttgcagagaacataaaatgtggggtgaattttttgggaagccatgggaggtggagggaggaaatagtaaatgagcttcttatgcttcctgcatatctgatttcatcctcttccattccctccttccttatttttttcttctgctagatttctaacgacccaagtccaggatacaacattgaacagatggcaaagcgaggcaagaagctagttgagctgccatacactgtaaaggggatggacgtctcattctcagggatcctgtctttcattgaggatgtagcccatcggatgctggccacaggcgagtgtactcctgaggatctgtgtttctccctgcaggtaatgcagtaaaaaactgggacagaaagttggggctgaaggttttatattgtagagcagaactaatctgggatgcccctctaatattttctccttatctgtccctgacaggaaactgtgtttgcaatgctggtagagatcacagagcgagccatggcacattgtggctcccaggaggccctcattgtgggaggagtggggtgtatgtattattgaaaagtgttcctctttcctattcttaacactatgcgtcttcctcctggtactctaaatcattaagcgtttggagtaggcttcccaatccttgcccctaatcccctatgtcattgttctaagtgagtgcacatgacgtgttctgctggaccatgaagagatggctaaaactaagctaatcctgttccctgcctctttgtaggtaatgtgaggctacaggagatgatggcaacaatgtgccaggaacgtggagcccggctttttgctacagatgagagattctgtattgacaatggagcgatgatagcccaggctggctgggagatgtttcgggctggacacaggaccccactcagtgattctggggttacacagaggtatcggacagatgaagtagaggtgacctggagggactaataagatcaacagaatcagagtagatagttccttaatcggaacccaaaggaccccgtgcctcaatctctatcctgatgtcatgggagtcctagcaaagctatagactccaagcaaggcttggggtcctttatggaaccccaggatgactcagcaataaaatatttttggttttttggtt

SEQ ID NO: 455980 - DNA, 1136 bp, Homo sapiens
  misc_feature (924)..(924): n is a, c, g, or t
  misc_feature (935)..(935): n is a, c, g, or t
  misc_feature (939)..(939): n is a, c, g, or t
  misc_feature (943)..(943): n is a, c, g, or t
  misc_feature (949)..(949): n is a, c, g, or t
  misc_feature (951)..(951): n is a, c, g, or t
  misc_feature (953)..(953): n is a, c, g, or t
  misc_feature (955)..(955): n is a, c, g, or t
  misc_feature (961)..(961): n is a, c, g, or t
  misc_feature (968)..(969): n is a, c, g, or t
  misc_feature (973)..(974): n is a, c, g, or t
  misc_feature (980)..(980): n is a, c, g, or t
aaaaaaaaaaaaaaaaacccaatctttcttgtgtacaaaattgtgcggccgctcgcgatgaactagccagcacattgtgtgacactgacttaagattctaactatgtgcaagagggaaaaaaacagtggagaaggctgggctggaccacgggaaagagataggaaaacggatacgaatgtaaggcacagagttggctcggcgtccctggcagttaggaagacaggtccctggaggggccttggcgggtctccgctcgcgggagttccgcggtgtctttcccagtgctatctgcaggctggccagcttcctctgcgctccggaaagctgcggcccagcgcggactagtgaggacctccacagctcctgacattgccaggagtcctgtcggcgttttctcccagcctccgccatgccggcggtgctgggttttgaaggcagcgccaataagattggcgtgggcgtggtgcgggatggcaaggtgctggcgaacccgcggcggacttacgtcacgcctcctggcacaggattccttccaggtgatacagccaggcatcaccgagctgttatcctagacctgctgcaggaggcactaacagagtctggattaacctcccaggatatcgactgcattgcatacaccaagggccctggcatgggtgccccactggtttctgtggctgttgtggcccgtactgtggcccagctgtggaataagccattggtgggtgtgaaccactgtataggccacattgagatgggccgcctcatcactggagccaccagcccaaccgtgttgtatgtgagtggaggaaatacgcaggtgattgcatactcggaacatcgttaccgtatctttggggaaaccatcgatattgcagtgggtaattgtctggatcgttttgctcgagtgctgaagattctancgaccagtccnggtncacnttgacngntngncagcgnggcaganntggnnggtgcntacctggacgggggggggcctcccaggctgctcctgggggggccctcggtgcccgcgggtcctgggactgtccccgcaccgtggcgcggccacacgccgcattgcccgccttggggggtgtggccccaccccaggcgtaaattggaccgcggtgcc

SEQ ID NO: 455981 - DNA, 704 bp, Homo sapiens
gatacgctagtacgaggctgggttatgaatcggccgagggtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctgccagggtttgtggagcaggctgaggctctgaaggccaagggagtccaggtggtggcctgtctgagtgttaatgatgcctttgtgactggcgagtggggccgagcccacaaggcggaaggcaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggcca

SEQ ID NO: 455982 - DNA, 917 bp, Homo sapiens
ccacgcgtcggacccacgcgtcctggccgtggggcgggtatgggactagctggcgtgtgcgccctgagacgctcagcgggctatatactcgtcggtggggccggcggtcagtctgcggcagcggcagcaagacggtgcagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctgccagggtttgtggagcaggctgaggctctgaaggccaagggagtccaggtggtggcctgtctgagtgttaatgatgcctttgtgactggcgagtggggccgagcccacaaggcggaaggcaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggccaaaaacagagacaccacagacataagaaacaaaaaggggcggggcataaagaaaccccgagggagccggtaggagagcaccggtgtagtaaaggaggcccaaaggggggtatag

SEQ ID NO: 455983 - DNA, 889 bp, Homo sapiens
cccttcggctaggtacgaggcctcggtgtttactcggcggtgtcgccgctgtgccgctagcggtgccccgcctgctgcggtggcaccagccaggaggcggagtggaagtggccgtggggcgggtatgggactagctggcgtgtgcgccctgagacgctcagcgggctatatactcgtcggtggggccggcggtcagtctgcggcagcggcagcaagacggtgcagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctgccagggtttgtggagcaggctgaggctctgaaggccaagggagtccaggtggtggcctgtctgagtgttaatgatgcctttgtgactggcgagtggggccgagcccacaaggcggaaggcaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggcca

SEQ ID NO: 455984 - DNA, 1483 bp, Homo sapiens
  misc_feature (1483)..(1483): n is a, c, g, or t
tcgcgcctgcgcagtggaggcggccaggcccgccttccgcagggtgtcgccgctgtgccgctagcggtgccccgcctgctgcggtggcaccagccaggaggcggagtggaagtggccgtggggcgggtatgggactagctggcgtgtgcgccctgagacgctcagcgggctatatactcgtcggtggggccggcggtcagtctgcggcagcggcagcaagacggtgcagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctgccagggtttgtggagcaggctgaggctctgaaggccaagggagtccaggtggtggcctgtctgagtgttaatgatgcctttgtgactggcgagtggggccgagcccacaaggcggaaggcaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggccaaaaaaaaaaaaaaaaaaaaaaaaaaaaaaaaaaaaaaaaacaaaaaaaaaaaaaacaaaaaaaaaaaaaacacagagcaacaacacaaaatacaacaaacaaaggcgagaggggcggcgctccccaaaagaaacatcccacagccggggggacacaacaggagaaaagcctgagcaccgacggattcatttaccaacacagaggagtcgacaccatcatggggaactgcacctttaacaaccagaaacaagcacgcgcgcagaggaattactaaaccaaacgctccgcgtaagagcgtaagaacaaaccgaacagcctgcggccaaaccatcagggggagagcacaaaacaccaacccacacagggacgccgagcacacacaacgtaggcgatgcacacacaccaccccccaacagagcacatgacgagcacggtgccgccgcggcatccaacacctaacaacccacctcaaccagcatgcacataccgagtggcctccgcaacacacgacgtgcatatcagatcacagctgcagagacagaaaaaagaggcaagaaaggcgcaagatagctacaagacacaccctcccn

SEQ ID NO: 455985 - DNA, 1031 bp, Homo sapiens
  misc_feature (915)..(915): n is a, c, g, or t
tcgcgcctgcgcagtggaggcggccaggcccgccttccgcagggtgtcgccgctgtgccgctagcggtgccccgcctgctgcggtggcaccagccaggaggcggagtggaagtggccgtggggcgggtatgggactagctggcgtgtgcgccctgagacgctcagcgggctatatactcgtcggtggggccggcggtcagtctgcggcagcggcagcaagacggtgcagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctgccagggtttgtggagcaggctgaggctctgaaggccaagggagtccaggtggtggcctgtctgagtgttaatgatgcctttgtgactggcgagtggggccgagcccacaaggcggaaggcaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggccaggggcaaaaaaaaaaaaaaatnatatacgaaagcacagaataagtataaatagcaaggggggaaaatagaaaaagagagagaaaataaaaaaggggtggtaaaaggagagtgaatgggagagataaagaaagagaata

SEQ ID NO: 455986 - DNA, 1006 bp, Homo sapiens
tcgcgcctgcgcagtggaggcggccaggcccgccttccgcagggtgtcgccgctgtgccgctagcggtgccccgcctgctgcggtggcaccagccaggaggcggagtggaagtggccgtggggcgggtatgggactagctggcgtgtgcgccctgagacgctcagcgggctatatactcgtcggtggggccggcggtcagtctgcggcagcggcagcaagacggtgcagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctgccagggtttgtggagcaggctgaggctctgaaggccaagggagtccaggtggtggcctgtctgagtgttaatgatgcctttgtgactggcgagtggggccgagcccacaaggcggaaggcaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggccaaaaacagagacaccacagacataagaaacaaaaaggggcggggcataaagaaaccccgagggagccggtaggagagcaccggtgtagtaaaggaggcccaaaggggggtatag

SEQ ID NO: 455987 - DNA, 960 bp, Homo sapiens
tcgcgcctgcgcagtggaggcggccaggcccgccttccgcagggtgtcgccgctgtgccgctagcggtgccccgcctgctgcggtggcaccagccaggaggcggagtggaagtggccgtggggcgggtatgggactagctggcgtgtgcgccctgagacgctcagcgggctatatactcgtcggtggggccggcggtcagtctgcggcagcggcagcaagacggtgcagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctgccagggtttgtggagcaggctgaggctctgaaggccaagggagtccaggtggtggcctgtctgagtgttaatgatgcctttgtgactggcgagtggggccgagcccacaaggcggaaggcaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggccacatatataagaatatattcgtttcttacgacagtaaacataaatgtgaattatctgcgtattcgtat

SEQ ID NO: 455988 - DNA, 944 bp, Homo sapiens
tcgcgcctgcgcagtggaggcggccaggcccgccttccgcagggtgtcgccgctgtgccgctagcggtgccccgcctgctgcggtggcaccagccaggaggcggagtggaagtggccgtggggcgggtatgggactagctggcgtgtgcgccctgagacgctcagcgggctatatactcgtcggtggggccggcggtcagtctgcggcagcggcagcaagacggtgcagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctgccagggtttgtggagcaggctgaggctctgaaggccaagggagtccaggtggtggcctgtctgagtgttaatgatgcctttgtgactggcgagtggggccgagcccacaaggcggaaggcaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggccaaaaaaaaaagtcgacgcggccgcgaatttagtagtagtagtaggcggccgc

SEQ ID NO: 455989 - DNA, 624 bp, Homo sapiens
ggaacctggcccttttcgagaacaccggcggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctgccagggtttgtggagcaggctgaggctctgaaggccaagggagtccaggtggtggcctgtctgagtgttaatgatgcctttgtgactggcgagtggggccgagcccacaaggcggaaggcaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggcca

SEQ ID NO: 455990 - DNA, 1531 bp, Homo sapiens
  misc_feature (1531)..(1531): n is a, c, g, or t
tcgcgcctgcgcagtggaggcggccaggcccgccttccgcagggtgtcgccgctgtgccgctagcggtgccccgcctgctgcggtggcaccagccaggaggcggagtggaagtggccgtggggcgggtatgggactagctggcgtgtgcgccctgagacgctcagcgggctatatactcgtcggtggggccggcggtcagtctgcggcagcggcagcaagacggtgcagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctgccagggtttgtggagcaggctgaggctctgaaggccaagggagtccaggtggtggcctgtctgagtgttaatgatgcctttgtgactggcgagtggggccgagcccacaaggcggaaggcaaggttcggctcctggctgatcccactggggcctttgggaaggagacagacttattactagatgattcgctggtgtccatctttgggaatcgacgtctcaagagcctccaagcccaagctgatgcagctgcctgggcccctctttccggcaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggccaaaaaaaaaaaaaaaaaaaaaaaaaaaaaaaaaaaaaaaaacaaaaaaaaaaaaaacaaaaaaaaaaaaaacacagagcaacaacacaaaatacaacaaacaaaggcgagaggggcggcgctccccaaaagaaacatcccacagccggggggacacaacaggagaaaagcctgagcaccgacggattcatttaccaacacagaggagtcgacaccatcatggggaactgcacctttaacaaccagaaacaagcacgcgcgcagaggaattactaaaccaaacgctccgcgtaagagcgtaagaacaaaccgaacagcctgcggccaaaccatcagggggagagcacaaaacaccaacccacacagggacgccgagcacacacaacgtaggcgatgcacacacaccaccccccaacagagcacatgacgagcacggtgccgccgcggcatccaacacctaacaacccacctcaaccagcatgcacataccgagtggcctccgcaacacacgacgtgcatatcagatcacagctgcagagacagaaaaaagaggcaagaaaggcgcaagatagctacaagacacaccctcccn

SEQ ID NO: 455991 - DNA, 843 bp, Homo sapiens
tcgcgcctgcgcagtggaggcggccaggcccgccttccgcagggtgtcgccgctgtgccgctagcggtgccccgcctgctgcggtggcaccagccaggaggcggagtggaagtggccgtggggcgggtatgggactagctggcgtgtgcgccctgagacgctcagcgggctatatactcgtcggtggggccggcggtcagtctgcggcagcggcagcaagacggtgcagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctgccagggtttgtggagcaggctgaggctctgaaggccaagggagtccaggtggtggcctgtctgagtgttaatgatgcctttgtgactggcgagtggggccgagcccacaaggcggaaggcaaggttcggctcctggctgatcccactggggcctttgggaaggagacagacttattactagatgattcgctggtgtccatctttgggaatcgacgtctcaagagcagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggcca

SEQ ID NO: 455992 - DNA, 626 bp, Homo sapiens
tcgcgcctgcgcagtggaggcggccaggcccgccttccgcagggtgtcgccgctgtgccgctagcggtgccccgcctgctgcggtggcaccagccaggaggcggagtggaagtggccgtggggcgggtatgggactagctggcgtgtgcgccctgagacgctcagcgggctatatactcgtcggtggggccggcggtcagtctgcggcagcggcagcaagacggtgcagtgaaggagagtgggcgtctggcggggtccgcagtttcagcagagccgctgcagccatggccccaatcaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggcca

SEQ ID NO: 455993 - DNA, 761 bp, Homo sapiens
tcgcgcctgcgcagtggaggcggccaggcccgccttccgcagggtgtcgccgctgtgccgctagcggtgccccgcctgctgcggtggcaccagccaggaggcggagtggaagtggccgtggggcgggtatgggactagctggcgtgtgcgccctgagacgctcagcgggctatatactcgtcggtggggccggcggtcagtctgcggcagcggcagcaagacggtgcagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggcca

SEQ ID NO: 455994 - DNA, 923 bp, Homo sapiens
gggaaaccttccctccctttctctgttgtcaccaatggccccttaagaggagcagggccaccttgaaacttggaggatatggggtaacccagtgggagcgggcagggagggcccttggaaactgacagggctggagtatcctgctgggtttcagccccggttcctgcaggcacagctgccaggctctctgttcaccttcctgcctctggtttgccccggctccctcaccccccttaccctggagtccttccttctaggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctgccagggtttgtggagcaggctgaggctctgaaggccaagggagtccaggtggtggcctgtctgagtgttaatgatgcctttgtgactggcgagtggggccgagcccacaaggcggaaggcaaggtgaggtgaggggcctgcagggagtcaggaccaggtaggatattcttcttgtgacctttactttctctgcaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggcca

SEQ ID NO: 455995 - DNA, 677 bp, Homo sapiens
tcgcgcctgcgcagtggaggcggccaggcccgccttccgcagggtgtcgccgctgtgccgctagcggtgccccgcctgctgcggtggcaccagccaggaggcggagtggaagtggccgtggggcgggtatgggactagctggcgtgtgcgccctgagacgctcagcgggctatatactcgtcggtggggccggcggtcagtctgcggcagcggcagcaagacggtgcagtgaaggagagtgggcgtctggcggggtccgcagtttcagcagagccgctgcagccatggccccaatcaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggccaaaaaaaaaagtcgacgcggccgcgaatttagtagtagtagtaggcggccgc

SEQ ID NO: 455996 - DNA, 893 bp, Homo sapiens
tcgcgcctgcgcagtggaggcggccaggcccgccttccgcagggtgtcgccgctgtgccgctagcggtgccccgcctgctgcggtggcaccagccaggaggcggagtggaagtggccgtggggcgggtatgggactagctggcgtgtgcgccctgagacgctcagcgggctatatactcgtcggtggggccggcggtcagtctgcggcagcggcagcaagacggtgcagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctgccagggtttgtggagcaggctgaggctctgaaggccaagggagtccaggtggtggcctgtctgagtgttaatgatgcctttgtgactggcgagtggggccgagcccacaaggcggaaggcaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggcca

SEQ ID NO: 455997 - DNA, 923 bp, Homo sapiens
  misc_feature (923)..(923): n is a, c, g, or t
attcgctggtgtccatcttgggaatcatctagtaataaggtctgtctccttcccaaaggccccagtgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggccaaaaaaaaaaaaaacaaaaaaaaaaaaaacaaaaaaaaaaaaaacacagagcaacaacacaaaatacaacaaacaaaggcgagaggggcggcgctccccaaaagaaacatcccacagccggggggacacaacaggagaaaagcctgagcaccgacggattcatttaccaacacagaggagtcgacaccatcatggggaactgcacctttaacaaccagaaacaagcacgcgcgcagaggaattactaaaccaaacgctccgcgtaagagcgtaagaacaaaccgaacagcctgcggccaaaccatcagggggagagcacaaaacaccaacccacacagggacgccgagcacacacaacgtaggcgatgcacacacaccaccccccaacagagcacatgacgagcacggtgccgccgcggcatccaacacctaacaacccacctcaaccagcatgcacataccgagtggcctccgcaacacacgacgtgcatatcagatcacagctgcagagacagaaaaaagaggcaagaaaggcgcaagatagctacaagacacaccctcccn

SEQ ID NO: 455998 - DNA, 1023 bp, Homo sapiens
tcgcgcctgcgcagtggaggcggccaggcccgccttccgcagggtgtcgccgctgtgccgctagcggtgccccgcctgctgcggtggcaccagccaggaggcggagtggaagtggccgtggggcgggtatgggactagctggcgtgtgcgccctgagacgctcagcgggctatatactcgtcggtggggccggcggtcagtctgcggcagcggcagcaagacggtgcagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctgccagggtttgtggagcaggctgaggctctgaaggccaagggagtccaggtggtggcctgtctgagtgttaatgatgcctttgtgactggcgagtggggccgagcccacaaggcggaaggcaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggccaaaaaaaaaaaaaaaaaaaaaaaaaaaactgggggtttttttggtggggaaaaagggttttgagggctggctattttgtccgccctttttgtaaggggaatgggggcccaaaggggcgtttataaagagtt

SEQ ID NO: 455999 - DNA, 915 bp, Homo sapiens
tcgcgcctgcgcagtggaggcggccaggcccgccttccgcagggtgtcgccgctgtgccgctagcggtgccccgcctgctgcggtggcaccagccaggaggcggagtggaagtggccgtggggcgggtatgggactagctggcgtgtgcgccctgagacgctcagcgggctatatactcgtcggtggggccggcggtcagtctgcggcagcggcagcaagacggtgcagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctgccagggtttgtggagcaggctgaggctctgaaggccaagggagtccaggtggtggcctgtctgagtgttaatgatgcctttgtgactggcgagtggggccgagcccacaaggcggaaggcaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggccacatctccttggttatgaatggc

SEQ ID NO: 456000 - DNA, 1456 bp, Homo sapiens
  misc_feature (1456)..(1456): n is a, c, g, or t
tcgcgcctgcgcagtggaggcggccaggcccgccttccgcagggtgtcgccgctgtgccgctagcggtgccccgcctgctgcggtggcaccagccaggaggcggagtggaagtggccgtggggcgggtatgggactagctggcgtgtgcgccctgagacgctcagcgggctatatactcgtcggtggggccggcggtcagtctgcggcagcggcagcaagacggtgcagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctgccagggtttgtggagcaggctgaggctctgaaggccaagggagtccaggtggtggcctgtctgagtgttaatgatgcctttgtgactggcgagtggggccgagcccacaaggcggaaggcaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggccaaaaaaaaaaaaaacaaaaaaaaaaaaaacaaaaaaaaaaaaaacacagagcaacaacacaaaatacaacaaacaaaggcgagaggggcggcgctccccaaaagaaacatcccacagccggggggacacaacaggagaaaagcctgagcaccgacggattcatttaccaacacagaggagtcgacaccatcatggggaactgcacctttaacaaccagaaacaagcacgcgcgcagaggaattactaaaccaaacgctccgcgtaagagcgtaagaacaaaccgaacagcctgcggccaaaccatcagggggagagcacaaaacaccaacccacacagggacgccgagcacacacaacgtaggcgatgcacacacaccaccccccaacagagcacatgacgagcacggtgccgccgcggcatccaacacctaacaacccacctcaaccagcatgcacataccgagtggcctccgcaacacacgacgtgcatatcagatcacagctgcagagacagaaaaaagaggcaagaaaggcgcaagatagctacaagacacaccctcccn

SEQ ID NO: 456001 - DNA, 1076 bp, Homo sapiens
cccttcggctaggtacgaggcctcggtgtttactcggcggtgtcgccgctgtgccgctagcggtgccccgcctgctgcggtggcaccagccaggaggcggagtggaagtggccgtggggcgggtatgggactagctggcgtgtgcgccctgagacgctcagcgggctatatactcgtcggtggggccggcggtcagtctgcggcagcggcagcaagacggtgcagtgaaggagagtgggcgtctggcggggtccgcagtttcagcagagccgctgcagccatggccccaatcaaggctggagtgcagtgacgcaatctctgctcactgcagcctccgcctcccgggttcaagcgattctactgcctcagcctcctgagtagctgggactacagatgcgagccaccacgcccagctattgtatttttagtagagacgggatttcaccccgttgttcagattggtctcgaactcctgacctcaggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctgccagggtttgtggagcaggctgaggctctgaaggccaagggagtccaggtggtggcctgtctgagtgttaatgatgcctttgtgactggcgagtggggccgagcccacaaggcggaaggcaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggcca

SEQ ID NO: 456002 - DNA, 481 bp, Homo sapiens
accctttgttccccttcctcagacacacctgccagggtttgtggagcaggctgaggctctgaaggccaagggagtccaggtggtggcctgtctgagtgttaatgatgcctttgtgactggcgagtggggccgagcccacaaggcggaaggcaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggcca

SEQ ID NO: 456003 - DNA, 2001 bp, Homo sapiens
  misc_feature (2001)..(2001): n is a, c, g, or t
tcgcgcctgcgcagtggaggcggccaggcccgccttccgcagggtgtcgccgctgtgccgctagcggtgccccgcctgctgcggtggcaccagccaggaggcggagtggaagtggccgtggggcgggtatgggactagctggcgtgtgcgccctgagacgctcagcgggctatatactcgtcggtggggccggcggtcagtctgcggcagcggcagcaagacggtgcagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctgccagggtttgtggagcaggctgaggctctgaaggccaagggagtccaggtggtggcctgtctgagtgttaatgatgcctttgtgactggcgagtggggccgagcccacaaggcggaaggcaaggttcggctcctggctgatcccactggggcctttgggaaggagacagacttattactagatgattcgctggtgtccatctttgggaatcgacgtctcaagagggtaaaagtggagagtcctctgtggagagagtcctctgtgggagagagtcctctgtgggagagagtcctctgtggagagggtcctctgtgggaagagtcgtctgtgggggagagtcctctgtgtgggagagtcgtctgtggggagagtcctgtgtggggagagtcctctgtggagagagtcctctgtgggggagagtcctgtgtgggggagagtcctctgtggggagagtcctctgtgtggagagagtcctgtgtgggagagagtcctgtgtggggagagtcttctgtaggggagagtcctctggggagagagtcctgtgtgggggagagttctctgtggggagagtcctctgtgtggagagagtcctgtgtggtggtgagtcctctgtgggggagagtcctctgtggggggagtcctctctggagttctcttgggcccctggctgttcactgcctgtctccatgcccagcctccaagcccaagctgatgcagctgcctgggcccctctttccggcaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggccaaaaaaaaaaaaaaaaaaaaaaaaaaaaaaaaaaaaaaaaacaaaaaaaaaaaaaacaaaaaaaaaaaaaacacagagcaacaacacaaaatacaacaaacaaaggcgagaggggcggcgctccccaaaagaaacatcccacagccggggggacacaacaggagaaaagcctgagcaccgacggattcatttaccaacacagaggagtcgacaccatcatggggaactgcacctttaacaaccagaaacaagcacgcgcgcagaggaattactaaaccaaacgctccgcgtaagagcgtaagaacaaaccgaacagcctgcggccaaaccatcagggggagagcacaaaacaccaacccacacagggacgccgagcacacacaacgtaggcgatgcacacacaccaccccccaacagagcacatgacgagcacggtgccgccgcggcatccaacacctaacaacccacctcaaccagcatgcacataccgagtggcctccgcaacacacgacgtgcatatcagatcacagctgcagagacagaaaaaagaggcaagaaaggcgcaagatagctacaagacacaccctcccn

SEQ ID NO: 456004 - DNA, 966 bp, Homo sapiens
  misc_feature (772)..(772): n is a, c, g, or t
tcgcgcctgcgcagtggaggcggccaggcccgccttccgcagggtgtcgccgctgtgccgctagcggtgccccgcctgctgcggtggcaccagccaggaggcggagtggaagtggccgtggggcgggtatgggactagctggcgtgtgcgccctgagacgctcagcgggctatatactcgtcggtggggccggcggtcagtctgcggcagcggcagcaagacggtgcagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggccaaaaaaaaaaanaaaacaacactcctccatcccacccccccacacacacccctcaccccccccccccgcctcacccgcccacgcctcgcaccgccccccccggctggcgccccccccccccacccgggccacccccacccccaccgcccgccgcggctcctcccccccgcccccccccccgctctgcacccccccctcccagcgcc

SEQ ID NO: 456005 - DNA, 741 bp, Homo sapiens
  misc_feature (448)..(448): n is a, c, g, or t
  misc_feature (461)..(461): n is a, c, g, or t
  misc_feature (479)..(479): n is a, c, g, or t
  misc_feature (503)..(503): n is a, c, g, or t
  misc_feature (521)..(521): n is a, c, g, or t
  misc_feature (525)..(526): n is a, c, g, or t
  misc_feature (534)..(534): n is a, c, g, or t
  misc_feature (543)..(543): n is a, c, g, or t
  misc_feature (546)..(546): n is a, c, g, or t
  misc_feature (548)..(548): n is a, c, g, or t
  misc_feature (554)..(554): n is a, c, g, or t
  misc_feature (566)..(566): n is a, c, g, or t
  misc_feature (572)..(572): n is a, c, g, or t
  misc_feature (578)..(578): n is a, c, g, or t
  misc_feature (603)..(603): n is a, c, g, or t
  misc_feature (610)..(610): n is a, c, g, or t
  misc_feature (618)..(618): n is a, c, g, or t
  misc_feature (643)..(643): n is a, c, g, or t
  misc_feature (646)..(646): n is a, c, g, or t
  misc_feature (651)..(651): n is a, c, g, or t
  misc_feature (654)..(654): n is a, c, g, or t
  misc_feature (658)..(659): n is a, c, g, or t
  misc_feature (663)..(663): n is a, c, g, or t
  misc_feature (669)..(671): n is a, c, g, or t
  misc_feature (674)..(675): n is a, c, g, or t
  misc_feature (678)..(678): n is a, c, g, or t
  misc_feature (681)..(681): n is a, c, g, or t
  misc_feature (684)..(685): n is a, c, g, or t
  misc_feature (689)..(689): n is a, c, g, or t
  misc_feature (691)..(691): n is a, c, g, or t
  misc_feature (695)..(695): n is a, c, g, or t
  misc_feature (710)..(710): n is a, c, g, or t
  misc_feature (723)..(724): n is a, c, g, or t
tcgcgcctgcgcagtggaggcggccaggcccgccttccgcagggtgtcgccgctgtgccgctagcggtgccccgcctgctgcggtggcaccagccaggaggcggagtggaagtggccgtggggcgggtatgggactagctggcgtgtgcgccctgagacgctcagcgggctatatactcgtcggtggggccggcggtcagtctgcggcagcggcagcaagacggtgcagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctggccangggtttgtgggancaaggctgaaggctctgnaaggccaaagggagttccaaggtnggttggccctgtctagantgtnnaaagaatngcctttgtngantnggcganattggggccgancccacnaaggcngggaacggccaagggtccggctccnggggctngatcccantggggggccttttgggaaaggaganaanacttnttntctnngatntgctcnnntgnnggnganatnngggngngtgngatgatgtgatatgngtgtgatgtgtgnntatgatgatgatgatga

SEQ ID NO: 456006 - DNA, 6196 bp, Homo sapiens
  misc_feature (174)..(174): n is a, c, g, or t
  misc_feature (1714)..(1714): n is a, c, g, or t
  misc_feature (1724)..(1724): n is a, c, g, or t
  misc_feature (4328)..(4328): n is a, c, g, or t
  misc_feature (4360)..(4360): n is a, c, g, or t
tgtccatgtatactattgattagctcccacttgcaaatgagaacacgtggtatttgattttcttttctgggttagttcacttaggatgatggtctccagctccatgttgctgcaaaggacatgatttcgttctttttttatggctgcctcttttgtttcttaaatctgaatttncatgtggcttcaatgctagtctggcctaccctttccttcccaaagtcaccaccaactcactcccacccccacctcatgcagtgcacccctcacagcccccacccttggcagtgacatttggatttccagggcctttcctgatcctttagagacatcctctcccggccaagtcctgcaagggagacttgagtcagaggttcgatgggctggggtgaggtgggccacacaattaccacacccactcccaggcctattcccggtgatctaagcacacagaagcaggctggtacttagggaagaaggcaccagtgtatgccagagcttaggatggcgtgaggaccaaatggaaagatagatattgtaagtggttgttgggagaaggaaggctggaggtgggggtactttgtgggctgcttccaggagctcccacccacaggcacaagtcttcctagctggcagaagaagccaggaacaaggctgaattctgacagaacccgcctggagctccatttcagttgcagagacctttatcttatgcagctgtcttttgcccagcctcctctgcagatgccataggacctcctctttcttttcttttctttctttttttttgagactgagtcttgctctatgaccagactggaatgcagtggcacaatctcagctcactgcaacctccgcctcccgggttcaggcgattctcctccctcagcctcccaaatagctgggattataggcatgcgccaccatgcccagctaatttttgtatttttagtagagacagggtttcactgtgttggccaggatggtctccatctcttgacctcgtgattcacctgcctcggcctcccaaagtgctgggattacaggcatgacccaccgtgccctgccaggacttcctctttctttttttttttttctttttttttttgagacggagtttcactcttgttgcccaggctgaagtgcaatggcacgatctcggctcaccgcaacctccgcctcccaggttcaagcgattctcctgcctcagcacccccgagaagctgggattacaggcacgcaccaccacgcccggctaattttgtatttttagtagagatgaggtttcttcatgttagtcaggctggtctcgaactcccgacctcaggtgatccgcccacctcggcctcccaaagtgctgggattacaggcatgagccaccgcgccctgccaggacctcctctttctgatataacacctgcatttgtttggcagacatctgtgtagttctgttcacaggagaaaaaagtcagattactaaacaccagtgtttaacagtggccatcagtaggtggtagcttcagagagtatttgctttcttatcgactatggtttcatgtattctctgttttgttttttactataagcatattttgtttttatataagggagaaataaagctcttctcaattgggagaaattactgcctgcctataatgaatgaggccctgctgggcactggctgggggcttgatgagtaggatatggtccctgtttntggagggtcntcaaactaaagaggaaagaagataggggaacaaaacagtgcggttggtgttctaagtatcctctgatcacagaagagaaagctgcccctacccagggacatgatcctgagccacctggattgtgagggagaatcaggcattgatgaggaggggaatgaggaagtagtctgcctacaggggacatagctcggcacagctccacagagctaggggctgcaacttggggcatgagaagagagagcagcaagagaaccatttgagaaggctgtcctttctctgtcatcactcctgatgccctggtgagctccacggtgcaggaacctccatgtgtgtgctgcatccccaagttctggtggcagcaggtgcttagcagcccttgtccagtctcgcctgtgacactgctgctcccttcccctgtcctgacctcctggttggctgtcctgccagagccttgcctggaagatgaaattccagctaccctgtgggagcagtaacgccttcttccttcttctcaatctccagaaatgtcaaatgtctttcctccaggacccaagtttcttcaccatggggatgtggtccattggtgcaggagccctgggggctgctgccttggcattgctgcttgccaacacagacgtgtttctgtccaagccccagaaagcggccctggagtacctggaggatatagacctgaaaacactggagaagggtaagtggtgacccttcaggtctcagtacttttccaaggagctgggatacaggcttactgctttctttctaaactctctcctttttttaattgaaaagataatataacaacattaggaaaaatttaataacaatttttaaactaggaataattctgttaccctaacacagtaattttgattttggcatattcctttccatgtgtacatattacgtagttgtgcttggcttaggtgctgttttacattttagcttttcttatcaaaagcatttctcattctctgttgttgtctctgtaattataatgataaattgctccataatatttagtaataattacaatcttttactaaaccagtgcttccagagtgtattctgaggaattccaggcttgtgggatcgtcaaactaaaaggagttcctgagtgaacaagtatgggagacaccttttatccaattccatgctcctgatgctcagcacagacatatgcttattagaatgaggtgtctggattgctgctgattcaggcatggccagcccctccctgtgaagaagctgtggtgtctgaggaatcacttcaaggtcacccgttagagcagacctgcctatctccctcttctgggggactgctagaatccattgtggacagcttagagccacacacccaaatgtgttagctctgcctccttgctgtgtgctctcagtgttagagctgtagcttggtgggatttcagtcatgccagtggtgtggcaagagagttggagtggtgaaggtctcattgatggcgtggtcaccatgttagccccccaggtggaagtcatcgtcatctgtttagtaagtaaggaagcttgcgaaaggaaggcaggagattgtgcaggtttatagtaggtcaccttagtaagatactaggagagagagagacctgttaagctttgttcaacccagggtttcccaatcttatttgattacagactcttctccccaccctctcacccacctgaccccattttttttttttccacataacatctacgggaacatggatccctctgggaaatactaaaataattaagggctcatatttattgagccctcaccaactctatattaccagacattgtggtgagcacttttatattcatctttcaatatgccctgtggcccaaagtggagctactagatatttgcattttacaaatgaggaagctgaggttcaaagagcaaaaataacttgcccagagttacacagctagattcagattcagttggaccttagagctgggcttgttgaactacagtactgtactaccccaaagcattttattcctaggcatcttctatcctctccttcgttaataatattgcaggtaacatatttaggttaaaaatttgagactttttcagtttgggccatgtttctgttctgaaggattattatacaatatctgatgacatcagcaatagacaaaatggccatttttccagaaatgtcccacttctgaatgttcaggttagaaaaaagattttcatggtgggagggacctaccgggtatataacaggattcttaagcttggttaactttcttcaggaaggtgtgtattctgtctgtctgtgtttcctgtgtgtcttttcccacgtgtgaaatgcctgtccaggtcctctactaggccgggtctctgaccttggctggacttagtgtggttcatgagctgcttagtgattggggctgggctgggaggagatatcgaatttctttttttcctctcttagaaccaaggactttcaaagcaaaggagctatgggaaaaaaatggagctgtgattatggccgtgcggaggccaggctgtttcctctgtcgagaggtgagtgcagatgaggatctattcagagaaanggatcctggcaagtaggggccattgttttccngccagaaccaagggtcggtaagccagctttagccttttacccacatgttctgttctgttatttgctctaggtatttcttttgatttgtgctcttttttttttttttttttaaacaactcaccctctcctactggggttagcaacacatctcagtttcccttagtactcccaggcctttcaccctgtgctgtaccttctgagtcctggaccatattccaatttaatcaggggcagtgaccaggtccaattccatgcttctgatgctcagcacagatatatgatgtgcctggattgcttctgattcgggtgtggtcagtccctccctgtgatgaagctgcagtgtcggaggaaacacttcaaggttacctattagagcagacctgcctgtctctctttccttggggagctcttagagtccatcgtggacagctgagagccacattctcacatgttagctctgcctccttgctgtgtgctctcagcattgaatctgtagctcagtgggatttcagtcatgccagtagtgcatttggcatgagagtttgttgaaagttggagctcactgactgggtggtctccaggttggcccctcgaagggaagacatcatctatttgtaggtgatggagcttatcagtggaaggaaggaactgtgattgttgaaacacaaaatgctagtgtgagaaggaacattgccactacttggatctagccttgtccctttataggtaggcaaactgaggaccagagtggttagtggtctgtttgtggtcacacagccagtcagtggcagaagacccagattctgaaattactgccctgcctgggagaaaactgggaatgacagtattcctgctcttgagacaactttgcatctcaagcagtggctgtggccctgtccaaattgtcatcctcattctcctggttcccctccctgaccctgagacaccacctttcagccttgctgatctctccatgcttgtgtggctgggctggtgaagaatccacttgcactgctggatgcatgtgatgcctgcagtaccctacccccagggcactgtgtgcctgctatctcagtgggtcctcaccatagcccttggaaatacagcttgttttactctcattttattattctcattacagaggaggaaacagttacagaggttgtaacaaagccacccggatcggggagatgtattaattttctgttgctgtaacaaattacctcaaactcaatggctttaaccagcacagatttatcttgtagttctagaggtcagaattccaaagcggaatctggttgcattccttctgaagactataggggagaatccatttcttttgccttttccagctgttagaggccacctatgtatattggtttatggccccttcctctatttttaggtcagcaatggctggcaagtcagcaacagcatggaagcctgttttgacttgatttctcggggccattaaaatccagaaggttccaagagcaacagctctccctaattataacctgtttccctctgtactggtctgtgcccacatagaacatttagtggaaacttacgtttccaaaaagatgggtggatggcaatctgagttattttgagtggcccaactaggaggtatgtgactcagtttccacgtcatggctttgtatagtgccacaccaggagtaaagagccaggaaaagtgagtaagacctttcatctcagccaggtgcagtggctcatgcctataatcccagcactttgggaggctgaggtgagaagatcacttgagcccaggaatttgagaccaccctaggcaacatagcgagaccctgtctctac

SEQ ID NO: 456007 - DNA, 684 bp, Homo sapiens
cgagttatttcccataatgcacccaaaggtggaaacactccctttaaaaaggtcccgccatccaatttggaaaaccaacttttccagcattccgaaaaccttacctggagccaggatgcccctgatcatctctgataactttaaaaggaaggcctcagaagcagccccagaagcaaaagtttctctctgaccttctcctgccctcttgtttctggcttttcattctcccccaaggctacccatagaaactagaatccctcttccccaaggcaggtcatcagaaaccagaaccggttttacccaaagccagccataaaacctaaaaatagtcctctcactccccattcccctttctgtgtaaaaactggttggaaagaaatgatctgacctaccgtgtttgactgtcgtaagatacccattccagagagggtcccaccccgtgcccagaaggaaggaatcctgcacagagaggccaagaagaatctagacagccttgctgggtttcccctctcagtctattactattagatcatacccttcttgtccaatcatatttctacacagtccataatctgttgaacctaaacataaaaatggacaattcccctgtatcttggggtcttcattctgagggctcacatacaattatgatcaaataaatttgtttgctttttctcctgttaa

SEQ ID NO: 456008 - DNA, 512 bp, Homo sapiens
gtcgcccaggctggagtgcagtggcgcgatctcggctcactgcaacctccgaggctgaggcaggagaatcacttgaacctgggaggtggaggttgcggtgagctgagatcacaccactgtattccagcctgggtgactgagactctaactaaaaaaaaaaaaaaaaaaaaattgattgctgtgcctcattacaaatgcatatgatgtttgagtgctgttgtttgaaattatttttcttttcgggtcttcaaaaattcaagaaaagttgatgattgacttgaagattacaaaatttaaggttttttggcatgtgtgttttctattaataattggttatatgatgtcaaagtaatactttcataatagaattgacatgctctgggatagtttgacaaaggtaaattataaagtgaaatctcttgtttcattatcttccattctaacctcagagatctgtttctctagaaaaaatgtccatctctggctttaataaaattatgcatcagaaatca

SEQ ID NO: 456009 - DNA, 461 bp, Homo sapiens
tttttgaggcagagtttcactcttgttgcccagggtggaggttgcggtgagctgagatcacaccactgtattccagcctgggtgactgagactctaactaaaaaaaaaaaaaaaaaaaaattgattgctgtgcctcattacaaatgcatatgatgtttgagtgctgttgtttgaaattatttttcttttcgggtcttcaaaaattcaagaaaagttgatgattgacttgaagattacaaaatttaaggttttttggcatgtgtgttttctattaataattggttatatgatgtcaaagtaatactttcataatagaattgacatgctctgggatagtttgacaaaggtaaattataaagtgaaatctcttgtttcattatcttccattctaacctcagagatctgtttctctagaaaaaatgtccatctctggctttaataaaattatgcatcagaaatca

SEQ ID NO: 456010 - DNA, 602 bp, Homo sapiens
agataactttggggtatcttgtgtcttagtgcattttttttcactgtatgagaagaaagtggcttccagtttcttagaagactaaagaaaaatgagggtctctcttttagatggtcattcagtgccttccaaagtctaacctctgagctccacttccacacctttgggcctttctgtgttagcttcatttttttctcttcacctggtatgttcttttacctgcatctctacttgtagacatcctggttaccctccgtgcctctgtgaggccttccctgattgcccttgaaggctccctggttctctgagataaactggctgaagcttttgactttgggatttagttggtgggtgagattgacatctcggtctggcttcatttcatagaaacgacacatattggctatttcctttgctgcagggaatcccagcttctcgaaagcttccggggtaatcaaggatagaggcagagccagaatttgcctccttcccgtactgcctctggtttgtcgtgtttattccagaattagccaggccagccttcttgatgcctcctctgtctatacataggcatgttccctcaaggaccaactcaagcccac

SEQ ID NO: 456011 - DNA, 5759 bp, Homo sapiens
  misc_feature (4245)..(4245): n is a, c, g, or t
  misc_feature (4354)..(4354): n is a, c, g, or t
  misc_feature (4366)..(4366): n is a, c, g, or t
tggatatacttctttgtcaagagaagcagaggtgtggacgctgtgtatgaaatgtctttcctccaggacccaagtttcttcaccatggggatgtggtccattggtgcaggagccctgggggctgctgccttggcattgctgcttgccaacacagacgtgtttctgtccaagccccagaaagcggccctggagtacctggaggatatagacctgaaaacactggagaaggaaccaaggactttcaaagcaaaggagctatgggaaaaaaatggagctgtgattatggccgtgcggaggccaggctgtttcctctgtcgagaggaagctgcggatctgtcctccctgaaaagcatgttggaccagctgggcgtccccctctatgcagtggtaaaggagcacatcaggactgaagtgaaggatttccagccttatttcaaaggagaaatcttcctggatgaaaagaaaaagttctatggtccacaaaggcggaagatgatgtttatgggatttatccgtctgggagtgtggtacaacttcttccgagcctggaacggaggcttctctggaaacctggaaggagaaggcttcatccttgggggagttttcgtggtgggatcaggaaagcagggcattcttcttgagcaccgagaaaaagaatttggagacaaagtaaacctactttctgttctggaagctgctaagatgatcaaaccacagactttggcctcagagaaaaaatgattgtgtgaaactgcccagctcagggataaccagggacattcacctgtgttcatgggatgtattgtttccactcgtgtccctaaggagtgagaaacccatttatactctactctcagtatggattattaatgtattttaatattctgtttaggcccactaaggcaaaatagccccaaaacaagactgacaaaaatctgaaaaactaatgaggattattaagctaaaacctgggaaataggaggcttaaaattgactgccaggctgggtgcagtggctcacacctgtaatcccagcactttgggaggccaaggtgagcaagtcacttgaggtcgggagttcgagaccagcctgagcaacatggcgaaaccccgtctctactaaaaatacaaaaatcacccgggtgtggtggcaggcacctgtagtcccagctacccgggaggctgaggcaggagaatcacttgaacctgggaggtggaggttgcggtgagctgagatcacaccactgtattccagcctgggtgactgagactctaactaaaaaaaaaaaaaaaaaaaaattgattgctgtgcctcattacaaatgcatatgatgtttgagtgctgttgtttgaaattatttttcttttcgggtcttcaaaaattcaagaaaagttgatgattgacttgaagattacaaaatttaaggttttttggcatgtgtgttttctattaataattggttatatgatgtcaaagtaatactttcataatagaattgacatgctctgggatagtttgacaaaggtaaattataaagtgaaatctcttgtttcattatcttccattctaacctcagagatctgtttctctagaaaaaatgtccatctctggctttaataaaattatgcatcagaaatcacctgtatgtataagattttctgataaaactaataattatatttaccatataattggctgaaagtaaaaaaagtcagcattctccatggctgaggggtaaagtgcctcgggggattcctctggttctagctatctaagtggtttgaaaatgaccaggaaaaattcatcctgtcattcacgttagtaattttgctgtctttcctagaggaatgactttggtgtttaaaattggtagctgtttttctattggtcttttagcctaatttggcaaatcagaagaaaggacatagagatgatgaaatataactttatcttttttgtttgaattttgtcgtgtaagtttgagtgacatcatcaagacctaccagggagctcggccacagggagtctactcaaggcatcaaactggcccaggagtagaaaggtgggggtggaaataggaaatagtgtttacccaggggactggcccagccaggaggagaaaggaatcagtgtttacccaggaaagcaagaatggatactgatgttggaggtaaagctgggaaagtaggagagcatcgggattgagtatgcagagtgagttagggttgagtggttcgggactaagacccactaagaccatgcctgcacctgacttcatgtagcagtggttgcatggggtatgcatgggcccttaaagggctgggcttctgcagcatttgaggccatagcctttggtacttgcacagggttggtacctgtcatccttgggactccagctactgataggataactcagtacctaaacttagaactttaatacctaagacacttgatggtgaaacagttctcttgcaactaaagaagaacctgaggtcaggtgtggtggctcacgcctgtaatcctagcactttgggaagtcgaggtagaaggatcacttgaggtcaggagttcgagaccagcctggccagcatggtgaaaccccatctctactaaaaatacaaaatattagacagacggggtggtacatgcctgtaatcccagctacttgggaggctgaggcaggagaatcgcttgaacccaggaggcagaggttgcagtgagccgagatcgtgccactgcactccagcttgggcaacaagagcgaaactccatatcaaaaaaaaaaacctgagaggacattgcaccaatggagatgcatcaagagaaacatgtttggttttttgtgagctctcaccaacttttttcccctgggtcctcacgtgcagtgtggtcttctctttctgattagcatgtcattttggaaagagcactggattgagtcatgaggcataatcaatttctagtttaccagtgtgatcttaagcaaagatctaactcattggcaaaatgggcgtgattccttcccattcagggctgtttatgataagtcactgagggaatgataaatattatgacactgcttctcagactgtaatgtacatgcacatcacataaggaccttattaaaatggagacttaaaaagctggacgctaaaggcaataatgacagattttactcaataactactgcagaaggagagagtcctcagtatagaactgagcttagctccaatctgtgcagaggtgatggaattttaaagaggggagggaggaggttcaaatagaactagggaagtgcaaaattacaaaaagctggtaaggagattggtcaatgtgattcggctatctgtgtctactaactctcaaatttatttatcaaagttaggatcctagcctcccacagagaccaggagtcggccttatcattcctgataattatatgacaaagggatggctcccagaaaaagtgagaaacacattcctgtgcagcagaagatacatatatcccccaaagggacagaaaggatttacaattgtaaattttataaagtatgtcctctaagaagagggagggactgggtgccatggctcatgcctataatcccagcactttgggtggccaaggtgggtgcatcacctgaggtcaggagttcaagagcagcctggccaacatggtgaaaccctgtctctactaaaaatacaaaagttagcctgttgtggtggcgcgcacctgtaatcccagctactcgggtggctgaggcaggagaatcgcttgaacccaggaggcggagggtgcagtgagccgggatcacgccactgcacttcagcctgggtgacagagtgtgactccatctcaagaaaaacgagggagattagaaacctatgatcaggcattggctgaaacaaatggtaaattcttttggcagccttgagcttccccaggcagggacccaaaggggcctgggttatccctgagacagggccttgagctgctagaaactatgctagtgtttgttcaagtctctccgtgtccggggtgagcaaaattgtttgtgctgaaaatcaatgatttgcagctctcaagattccagtgggcagtctgggtgggcctgagtttctgctttttttttttctttatgtacagggtcttgctctgtcacctaggctagagtgtaattagtggccccagtcatggctcactgcagctgcaaactggctgcaagctgttctggctcagcctaccangttactgggcttacaggtggatgccaccgtacccaacagattttatttttgtagggatgggggtctccctgtattgcccaggctggtctcaaactcctggcctcccaangtgtttagattncaggtgtaagccaccacacgtggccagcctctgcatttctaacaggttccaggtgatcttgatgttctgctggtccatgggtcacactttgagaagcatggttctaaaggactatacagattaaagtcattaatctctgtgggctttggacttgaagtttcagcagcctttgacaagcatttgcaggtttcctttttatttatttgataaactgagaatccacatgcaaagaaatgcaagaaaattcaaagaacgtaagaaaatgtccttgctgtaaagctggtggttctcaatctcggatacacagtagaatcacctggtgcgggggttgggggcggggtgcagtgtaaaaattattaaatcagaatctctggggtaggccccaagcaacttttttttttttttttttagatagaatcttgcttgtcacctaggctaggagtgcagtggtgcaatcatggctcactgccgccttaacttctgggctcaagtgatatcctcccgacctcagcctccctagtagctgggactacaggcgtggactaccacacccaacaaatttttaaattttttgtagaggcaagctcttatactatcttgcacaggctggtctcgaactcctgggctcaagcagtcatcctgcctcagccttccaaagctcagggattacagacatgagccacagcaccaggccaacaatatttcttaaagctcctggagtgattccaatatgcagccaaggttgaaaaccaccctttaaaaggctcggcatccagtgtggaagaccagcacactcacgtcaggagaccttacctggagccaggatgcccctgatcatctctgataactttaaaaggaaggcctcagaagcagccccagaagcaaaagtttctctctgaccttctcctgccctcttgtttctggcttttcattctcccccaaggctacccatagaaactagaatccctcttccccaaggcaggtcatcagaaaccagaaccggttttacccaaagccagccataaaacctaaaaatagtcctctcactccccattcccctttctgtgtaaaaactggttggaaagaaatgatctgacctaccgtgtttgactgtcgtaagatacccattccagagagggtcccaccccgtgcccagaaggaaggaatcctgcacagagaggccaagaagaatctagacagccttgctgggtttcccctctcagtctattactattagatcatacccttcttgtccaatcatatttctacacagtccataatctgttgaacctaaacataaaaatggacaattcccctgtatcttggggtcttcattctgagggctcacatacaattatgatcaaataaatttgtttgctttttctcctgttaa

SEQ ID NO: 456012 - DNA, 4455 bp, Homo sapiens
agcggacatggcggtggcgcggtagcgcgcgatgcagcacaggctagaggctgcgcaagcgcggggcccgcccctgggaccctccgggccgggcggtttggccccttagcgcccgggcgtcggggcggtaaaaggccggcagaagggaggcacttgagaaatgtctttcctccaggacccaagtttcttcaccatggggatgtggtccattggtgcaggagccctgggggctgctgccttggcattgctgcttgccaacacagacgtgtttctgtccaagccccagaaagcggccctggagtacctggaggatatagacctgaaaacactggagaaggaaccaaggactttcaaagcaaaggagctatgggaaaaaaatggagctgtgattatggccgtgcggaggccaggctgtttcctctgtcgagaggaagctgcggatctgtcctccctgaaaagcatgttggaccagctgggcgtccccctctatgcagtggtaaaggagcacatcaggactgaagtgaaggatttccagccttatttcaaaggagaaatcttcctggatgaaaagaaaaagttctatggtccacaaaggcggaagatgatgtttatgggatttatccgtctgggagtgtggtacaacttcttccgagcctggaacggaggcttctctggaaacctggaaggagaaggcttcatccttgggggagttttcgtggtgggatcaggaaagcagggcattcttcttgagcaccgagaaaaagaatttggagacaaagtaaacctactttctgttctggaagctgctaagatgatcaaaccacagactttggcctcagagaaaaaatgattgtgtgaaactgcccagctcagggataaccagggacattcacctgtgttcatgggatgtattgtttccactcgtgtccctaaggagtgagaaacccatttatactctactctcagtatggattattaatgtattttaatattctgtttaggcccactaaggcaaaatagccccaaaacaagactgacaaaaatctgaaaaactaatgaggattattaagctaaaacctgggaaataggaggcttaaaattgactgccaggctgggtgcagtggctcacacctgtaatcccagcactttgggaggccaaggtgagcaagtcacttgaggtcgggagttcgagaccagcctgagcaacatggcgaaaccccgtctctactaaaaatacaaaaatcacccgggtgtggtggcaggcacctgtagtcccagctacccgggaggctgaggcaggagaatcacttgaacctgggaggtggaggttgcggtgagctgagatcacaccactgtattccagcctgggtgactgagactctaactaaaaaaaaaaaaaaaaaaaaattgattgctgtgcctcattacaaatgcatatgatgtttgagtgctgttgtttgaaattatttttcttttcgggtcttcaaaaattcaagaaaagttgatgattgacttgaagattacaaaatttaaggttttttggcatgtgtgttttctattaataattggttatatgatgtcaaagtaatactttcataatagaattgacatgctctgggatagtttgacaaaggtaaattataaagtgaaatctcttgtttcattatcttccattctaacctcagagatctgtttctctagaaaaaatgtccatctctggctttaataaaattatgcatcagaaatcacctgtatgtataagattttctgataaaactaataattatatttaccatataattggctgaaagtaaaaaaagtcagcattctccatggctgaggggtaaagtgcctcgggggattcctctggttctagctatctaagtggtttgaaaatgaccaggaaaaattcatcctgtcattcacgttagtaattttgctgtctttcctagaggaatgactttggtgtttaaaattggtagctgtttttctattggtcttttagcctaatttggcaaatcagaagaaaggacatagagatgatgaaatataactttatcttttttgtttgaattttgtcgtgtaagtttgagtgacatcatcaagacctaccagggagctcggccacagggagtctactcaaggcatcaaactggcccaggagtagaaaggtgggggtggaaataggaaatagtgtttacccaggggactggcccagccaggaggagaaaggaatcagtgtttacccaggaaagcaagaatggatactgatgttggaggtaaagctgggaaagtaggagagcatcgggattgagtatgcagagtgagttagggttgagtggttcgggactaagacccactaagaccatgcctgcacctgacttcatgtagcagtggttgcatggggtatgcatgggcccttaaagggctgggcttctgcagcatttgaggccatagcctttggtacttgcacagggttggtacctgtcatccttgggactccagctactgataggataactcagtacctaaacttagaactttaatacctaagacacttgatggtgaaacagttctcttgcaactaaagaagaacctgaggtcaggtgtggtggctcacgcctgtaatcctagcactttgggaagtcgaggtagaaggatcacttgaggtcaggagttcgagaccagcctggccagcatggtgaaaccccatctctactaaaaatacaaaatattagacagacggggtggtacatgcctgtaatcccagctacttgggaggctgaggcaggagaatcgcttgaacccaggaggcagaggttgcagtgagccgagatcgtgccactgcactccagcttgggcaacaagagcgaaactccatatcaaaaaaaaaaacctgagaggacattgcaccaatggagatgcatcaagagaaacatgtttggttttttgtgagctctcaccaacttttttcccctgggtcctcacgtgcagtgtggtcttctctttctgattagcatgtcattttggaaagagcactggattgagtcatgaggcataatcaatttctagtttaccagtgtgatcttaagcaaagatctaactcattggcaaaatgggcgtgattccttcccattcagggctgtttatgataagtcactgagggaatgataaatattatgacactgcttctcagactgtaatgtacatgcacatcacataaggaccttattaaaatggagacttaaaaagctggacgctaaaggcaataatgacagattttactcaataactactgcagaaggagagagtcctcagtatagaactgagcttagctccaatctgtgcagaggtgatggaattttaaagaggggagggaggaggttcaaatagaactagggaagtgcaaaattacaaaaagctggtaaggagattggtcaatgtgattcggctatctgtgtctactaactctcaaatttatttatcaaagttaggatcctagcctcccacagagaccaggagtcggccttatcattcctgataattatatgacaaagggatggctcccagaaaaagtgagaaacacattcctgtgcagcagaagatacatatatcccccaaagggacagaaaggatttacaattgtaaattttataaagtatgtcctctaagaagagggagggactgggtgccatggctcatgcctataatcccagcactttgggtggccaaggtgggtgcatcacctgaggtcaggagttcaagagcagcctggccaacatggtgaaaccctgtctctactaaaaatacaaaagttagcctgttgtggtggcgcgcacctgtaatcccagctactcgggtggctgaggcaggagaatcgcttgaacccaggaggcggagggtgcagtgagccgggatcacgccactgcacttcagcctgggtgacagagtgtgactccatctcaagaaaaacgagggagattagaaacctatgatcaggcattggctgaaacaaatggtaaattcttttggcagccttgagcttccccaggcagggacccaaaggggcctgggttatccctgagacagggccttgagctgctagaaactatgctagtgtttgttcaagtctctccgtgtccggggtgagcaaaattgtttgtgctgaaaatcaatgatttgcagctctcaagattccagtgggcagtctgggtgggcctgagtttctgctttttttttttctttatgtacagagtgtgactccatctcaagaaaaacgagggagattagaaacctatgatcatacccttcttgtccaatcatatttctacacagtccataatctgttgaacctaaacataaaaatggacaattcccctgtatcttggggtcttcattctgagggctcacatacaattatgatcaaataaatttgtttgctttttctcctgttaa

SEQ ID NO: 456013 - DNA, 5758 bp, Homo sapiens
  misc_feature (4244)..(4244): n is a, c, g, or t
  misc_feature (4353)..(4353): n is a, c, g, or t
  misc_feature (4365)..(4365): n is a, c, g, or t
gctatggatcgaggcgtgggtgaattggccgaggggacgctgtgtatgaaatgtctttcctccaggacccaagtttcttcaccatggggatgtggtccattggtgcaggagccctgggggctgctgccttggcattgctgcttgccaacacagacgtgtttctgtccaagccccagaaagcggccctggagtacctggaggatatagacctgaaaacactggagaaggaaccaaggactttcaaagcaaaggagctatgggaaaaaaatggagctgtgattatggccgtgcggaggccaggctgtttcctctgtcgagaggaagctgcggatctgtcctccctgaaaagcatgttggaccagctgggcgtccccctctatgcagtggtaaaggagcacatcaggactgaagtgaaggatttccagccttatttcaaaggagaaatcttcctggatgaaaagaaaaagttctatggtccacaaaggcggaagatgatgtttatgggatttatccgtctgggagtgtggtacaacttcttccgagcctggaacggaggcttctctggaaacctggaaggagaaggcttcatccttgggggagttttcgtggtgggatcaggaaagcagggcattcttcttgagcaccgagaaaaagaatttggagacaaagtaaacctactttctgttctggaagctgctaagatgatcaaaccacagactttggcctcagagaaaaaatgattgtgtgaaactgcccagctcagggataaccagggacattcacctgtgttcatgggatgtattgtttccactcgtgtccctaaggagtgagaaacccatttatactctactctcagtatggattattaatgtattttaatattctgtttaggcccactaaggcaaaatagccccaaaacaagactgacaaaaatctgaaaaactaatgaggattattaagctaaaacctgggaaataggaggcttaaaattgactgccaggctgggtgcagtggctcacacctgtaatcccagcactttgggaggccaaggtgagcaagtcacttgaggtcgggagttcgagaccagcctgagcaacatggcgaaaccccgtctctactaaaaatacaaaaatcacccgggtgtggtggcaggcacctgtagtcccagctacccgggaggctgaggcaggagaatcacttgaacctgggaggtggaggttgcggtgagctgagatcacaccactgtattccagcctgggtgactgagactctaactaaaaaaaaaaaaaaaaaaaaattgattgctgtgcctcattacaaatgcatatgatgtttgagtgctgttgtttgaaattatttttcttttcgggtcttcaaaaattcaagaaaagttgatgattgacttgaagattacaaaatttaaggttttttggcatgtgtgttttctattaataattggttatatgatgtcaaagtaatactttcataatagaattgacatgctctgggatagtttgacaaaggtaaattataaagtgaaatctcttgtttcattatcttccattctaacctcagagatctgtttctctagaaaaaatgtccatctctggctttaataaaattatgcatcagaaatcacctgtatgtataagattttctgataaaactaataattatatttaccatataattggctgaaagtaaaaaaagtcagcattctccatggctgaggggtaaagtgcctcgggggattcctctggttctagctatctaagtggtttgaaaatgaccaggaaaaattcatcctgtcattcacgttagtaattttgctgtctttcctagaggaatgactttggtgtttaaaattggtagctgtttttctattggtcttttagcctaatttggcaaatcagaagaaaggacatagagatgatgaaatataactttatcttttttgtttgaattttgtcgtgtaagtttgagtgacatcatcaagacctaccagggagctcggccacagggagtctactcaaggcatcaaactggcccaggagtagaaaggtgggggtggaaataggaaatagtgtttacccaggggactggcccagccaggaggagaaaggaatcagtgtttacccaggaaagcaagaatggatactgatgttggaggtaaagctgggaaagtaggagagcatcgggattgagtatgcagagtgagttagggttgagtggttcgggactaagacccactaagaccatgcctgcacctgacttcatgtagcagtggttgcatggggtatgcatgggcccttaaagggctgggcttctgcagcatttgaggccatagcctttggtacttgcacagggttggtacctgtcatccttgggactccagctactgataggataactcagtacctaaacttagaactttaatacctaagacacttgatggtgaaacagttctcttgcaactaaagaagaacctgaggtcaggtgtggtggctcacgcctgtaatcctagcactttgggaagtcgaggtagaaggatcacttgaggtcaggagttcgagaccagcctggccagcatggtgaaaccccatctctactaaaaatacaaaatattagacagacggggtggtacatgcctgtaatcccagctacttgggaggctgaggcaggagaatcgcttgaacccaggaggcagaggttgcagtgagccgagatcgtgccactgcactccagcttgggcaacaagagcgaaactccatatcaaaaaaaaaaacctgagaggacattgcaccaatggagatgcatcaagagaaacatgtttggttttttgtgagctctcaccaacttttttcccctgggtcctcacgtgcagtgtggtcttctctttctgattagcatgtcattttggaaagagcactggattgagtcatgaggcataatcaatttctagtttaccagtgtgatcttaagcaaagatctaactcattggcaaaatgggcgtgattccttcccattcagggctgtttatgataagtcactgagggaatgataaatattatgacactgcttctcagactgtaatgtacatgcacatcacataaggaccttattaaaatggagacttaaaaagctggacgctaaaggcaataatgacagattttactcaataactactgcagaaggagagagtcctcagtatagaactgagcttagctccaatctgtgcagaggtgatggaattttaaagaggggagggaggaggttcaaatagaactagggaagtgcaaaattacaaaaagctggtaaggagattggtcaatgtgattcggctatctgtgtctactaactctcaaatttatttatcaaagttaggatcctagcctcccacagagaccaggagtcggccttatcattcctgataattatatgacaaagggatggctcccagaaaaagtgagaaacacattcctgtgcagcagaagatacatatatcccccaaagggacagaaaggatttacaattgtaaattttataaagtatgtcctctaagaagagggagggactgggtgccatggctcatgcctataatcccagcactttgggtggccaaggtgggtgcatcacctgaggtcaggagttcaagagcagcctggccaacatggtgaaaccctgtctctactaaaaatacaaaagttagcctgttgtggtggcgcgcacctgtaatcccagctactcgggtggctgaggcaggagaatcgcttgaacccaggaggcggagggtgcagtgagccgggatcacgccactgcacttcagcctgggtgacagagtgtgactccatctcaagaaaaacgagggagattagaaacctatgatcaggcattggctgaaacaaatggtaaattcttttggcagccttgagcttccccaggcagggacccaaaggggcctgggttatccctgagacagggccttgagctgctagaaactatgctagtgtttgttcaagtctctccgtgtccggggtgagcaaaattgtttgtgctgaaaatcaatgatttgcagctctcaagattccagtgggcagtctgggtgggcctgagtttctgctttttttttttctttatgtacagggtcttgctctgtcacctaggctagagtgtaattagtggccccagtcatggctcactgcagctgcaaactggctgcaagctgttctggctcagcctaccangttactgggcttacaggtggatgccaccgtacccaacagattttatttttgtagggatgggggtctccctgtattgcccaggctggtctcaaactcctggcctcccaangtgtttagattncaggtgtaagccaccacacgtggccagcctctgcatttctaacaggttccaggtgatcttgatgttctgctggtccatgggtcacactttgagaagcatggttctaaaggactatacagattaaagtcattaatctctgtgggctttggacttgaagtttcagcagcctttgacaagcatttgcaggtttcctttttatttatttgataaactgagaatccacatgcaaagaaatgcaagaaaattcaaagaacgtaagaaaatgtccttgctgtaaagctggtggttctcaatctcggatacacagtagaatcacctggtgcgggggttgggggcggggtgcagtgtaaaaattattaaatcagaatctctggggtaggccccaagcaacttttttttttttttttttagatagaatcttgcttgtcacctaggctaggagtgcagtggtgcaatcatggctcactgccgccttaacttctgggctcaagtgatatcctcccgacctcagcctccctagtagctgggactacaggcgtggactaccacacccaacaaatttttaaattttttgtagaggcaagctcttatactatcttgcacaggctggtctcgaactcctgggctcaagcagtcatcctgcctcagccttccaaagctcagggattacagacatgagccacagcaccaggccaacaatatttcttaaagctcctggagtgattccaatatgcagccaaggttgaaaaccaccctttaaaaggctcggcatccagtgtggaagaccagcacactcacgtcaggagaccttacctggagccaggatgcccctgatcatctctgataactttaaaaggaaggcctcagaagcagccccagaagcaaaagtttctctctgaccttctcctgccctcttgtttctggcttttcattctcccccaaggctacccatagaaactagaatccctcttccccaaggcaggtcatcagaaaccagaaccggttttacccaaagccagccataaaacctaaaaatagtcctctcactccccattcccctttctgtgtaaaaactggttggaaagaaatgatctgacctaccgtgtttgactgtcgtaagatacccattccagagagggtcccaccccgtgcccagaaggaaggaatcctgcacagagaggccaagaagaatctagacagccttgctgggtttcccctctcagtctattactattagatcatacccttcttgtccaatcatatttctacacagtccataatctgttgaacctaaacataaaaatggacaattcccctgtatcttggggtcttcattctgagggctcacatacaattatgatcaaataaatttgtttgctttttctcctgttaa

SEQ ID NO: 456014 - DNA, 7963 bp, Homo sapiens
  misc_feature (174)..(174): n is a, c, g, or t
  misc_feature (1714)..(1714): n is a, c, g, or t
  misc_feature (1724)..(1724): n is a, c, g, or t
  misc_feature (6449)..(6449): n is a, c, g, or t
  misc_feature (6558)..(6558): n is a, c, g, or t
  misc_feature (6570)..(6570): n is a, c, g, or t
tgtccatgtatactattgattagctcccacttgcaaatgagaacacgtggtatttgattttcttttctgggttagttcacttaggatgatggtctccagctccatgttgctgcaaaggacatgatttcgttctttttttatggctgcctcttttgtttcttaaatctgaatttncatgtggcttcaatgctagtctggcctaccctttccttcccaaagtcaccaccaactcactcccacccccacctcatgcagtgcacccctcacagcccccacccttggcagtgacatttggatttccagggcctttcctgatcctttagagacatcctctcccggccaagtcctgcaagggagacttgagtcagaggttcgatgggctggggtgaggtgggccacacaattaccacacccactcccaggcctattcccggtgatctaagcacacagaagcaggctggtacttagggaagaaggcaccagtgtatgccagagcttaggatggcgtgaggaccaaatggaaagatagatattgtaagtggttgttgggagaaggaaggctggaggtgggggtactttgtgggctgcttccaggagctcccacccacaggcacaagtcttcctagctggcagaagaagccaggaacaaggctgaattctgacagaacccgcctggagctccatttcagttgcagagacctttatcttatgcagctgtcttttgcccagcctcctctgcagatgccataggacctcctctttcttttcttttctttctttttttttgagactgagtcttgctctatgaccagactggaatgcagtggcacaatctcagctcactgcaacctccgcctcccgggttcaggcgattctcctccctcagcctcccaaatagctgggattataggcatgcgccaccatgcccagctaatttttgtatttttagtagagacagggtttcactgtgttggccaggatggtctccatctcttgacctcgtgattcacctgcctcggcctcccaaagtgctgggattacaggcatgacccaccgtgccctgccaggacttcctctttctttttttttttttctttttttttttgagacggagtttcactcttgttgcccaggctgaagtgcaatggcacgatctcggctcaccgcaacctccgcctcccaggttcaagcgattctcctgcctcagcacccccgagaagctgggattacaggcacgcaccaccacgcccggctaattttgtatttttagtagagatgaggtttcttcatgttagtcaggctggtctcgaactcccgacctcaggtgatccgcccacctcggcctcccaaagtgctgggattacaggcatgagccaccgcgccctgccaggacctcctctttctgatataacacctgcatttgtttggcagacatctgtgtagttctgttcacaggagaaaaaagtcagattactaaacaccagtgtttaacagtggccatcagtaggtggtagcttcagagagtatttgctttcttatcgactatggtttcatgtattctctgttttgttttttactataagcatattttgtttttatataagggagaaataaagctcttctcaattgggagaaattactgcctgcctataatgaatgaggccctgctgggcactggctgggggcttgatgagtaggatatggtccctgtttntggagggtcntcaaactaaagaggaaagaagataggggaacaaaacagtgcggttggtgttctaagtatcctctgatcacagaagagaaagctgcccctacccagggacatgatcctgagccacctggattgtgagggagaatcaggcattgatgaggaggggaatgaggaagtagtctgcctacaggggacatagctcggcacagctccacagagctaggggctgcaacttggggcatgagaagagagagcagcaagagaaccatttgagaaggctgtcctttctctgtcatcactcctgatgccctggtgagctccacggtgcaggaacctccatgtgtgtgctgcatccccaagttctggtggcagcaggtgcttagcagcccttgtccagtctcgcctgtgacactgctgctcccttcccctgtcctgacctcctggttggctgtcctgccagagccttgcctggaagatgaaattccagctaccctgtgggagcagtaacgccttcttccttcttctcaatctccagaaatgtcaaatgtctttcctccaggacccaagtttcttcaccatggggatgtggtccattggtgcaggagccctgggggctgctgccttggcattgctgcttgccaacacagacgtgtttctgtccaagccccagaaagcggccctggagtacctggaggatatagacctgaaaacactggagaaggaaccaaggactttcaaagcaaaggagctatgggaaaaaaatggagctgtgattatggccgtgcggaggccaggctgtttcctctgtcgagaggaagctgcggatctgtcctccctgaaaagcatgttggaccagctgggcgtccccctctatgcagtggtaaaggagcacatcaggactgaagtgaaggatttccagccttatttcaaaggagaaatcttcctggatgaaaagaaaaagttctatggtccacaaaggcggaagatgatgtttatgggatttatccgtctgggagtgtggtacaacttcttccgagcctggaacggaggcttctctggaaacctggaaggagaaggcttcatccttgggggagttttcgtggtgggatcaggaaagcagggcattcttcttgagcaccgagaaaaagaatttggagacaaagtaaacctactttctgttctggaagctgctaagatgatcaaaccacagactttggcctcagagaaaaaatgattgtgtgaaactgcccagctcagggataaccagggacattcacctgtgttcatgggatgtattgtttccactcgtgtccctaaggagtgagaaacccatttatactctactctcagtatggattattaatgtattttaatattctgtttaggcccactaaggcaaaatagccccaaaacaagactgacaaaaatctgaaaaactaatgaggattattaagctaaaacctgggaaataggaggcttaaaattgactgccaggctgggtgcagtggctcacacctgtaatcccagcactttgggaggccaaggtgagcaagtcacttgaggtcgggagttcgagaccagcctgagcaacatggcgaaaccccgtctctactaaaaatacaaaaatcacccgggtgtggtggcaggcacctgtagtcccagctacccgggaggctgaggcaggagaatcacttgaacctgggaggtggaggttgcggtgagctgagatcacaccactgtattccagcctgggtgactgagactctaactaaaaaaaaaaaaaaaaaaaaattgattgctgtgcctcattacaaatgcatatgatgtttgagtgctgttgtttgaaattatttttcttttcgggtcttcaaaaattcaagaaaagttgatgattgacttgaagattacaaaatttaaggttttttggcatgtgtgttttctattaataattggttatatgatgtcaaagtaatactttcataatagaattgacatgctctgggatagtttgacaaaggtaaattataaagtgaaatctcttgtttcattatcttccattctaacctcagagatctgtttctctagaaaaaatgtccatctctggctttaataaaattatgcatcagaaatcacctgtatgtataagattttctgataaaactaataattatatttaccatataattggctgaaagtaaaaaaagtcagcattctccatggctgaggggtaaagtgcctcgggggattcctctggttctagctatctaagtggtttgaaaatgaccaggaaaaattcatcctgtcattcacgttagtaattttgctgtctttcctagaggaatgactttggtgtttaaaattggtagctgtttttctattggtcttttagcctaatttggcaaatcagaagaaaggacatagagatgatgaaatataactttatcttttttgtttgaattttgtcgtgtaagtttgagtgacatcatcaagacctaccagggagctcggccacagggagtctactcaaggcatcaaactggcccaggagtagaaaggtgggggtggaaataggaaatagtgtttacccaggggactggcccagccaggaggagaaaggaatcagtgtttacccaggaaagcaagaatggatactgatgttggaggtaaagctgggaaagtaggagagcatcgggattgagtatgcagagtgagttagggttgagtggttcgggactaagacccactaagaccatgcctgcacctgacttcatgtagcagtggttgcatggggtatgcatgggcccttaaagggctgggcttctgcagcatttgaggccatagcctttggtacttgcacagggttggtacctgtcatccttgggactccagctactgataggataactcagtacctaaacttagaactttaatacctaagacacttgatggtgaaacagttctcttgcaactaaagaagaacctgaggtcaggtgtggtggctcacgcctgtaatcctagcactttgggaagtcgaggtagaaggatcacttgaggtcaggagttcgagaccagcctggccagcatggtgaaaccccatctctactaaaaatacaaaatattagacagacggggtggtacatgcctgtaatcccagctacttgggaggctgaggcaggagaatcgcttgaacccaggaggcagaggttgcagtgagccgagatcgtgccactgcactccagcttgggcaacaagagcgaaactccatatcaaaaaaaaaaacctgagaggacattgcaccaatggagatgcatcaagagaaacatgtttggttttttgtgagctctcaccaacttttttcccctgggtcctcacgtgcagtgtggtcttctctttctgattagcatgtcattttggaaagagcactggattgagtcatgaggcataatcaatttctagtttaccagtgtgatcttaagcaaagatctaactcattggcaaaatgggcgtgattccttcccattcagggctgtttatgataagtcactgagggaatgataaatattatgacactgcttctcagactgtaatgtacatgcacatcacataaggaccttattaaaatggagacttaaaaagctggacgctaaaggcaataatgacagattttactcaataactactgcagaaggagagagtcctcagtatagaactgagcttagctccaatctgtgcagaggtgatggaattttaaagaggggagggaggaggttcaaatagaactagggaagtgcaaaattacaaaaagctggtaaggagattggtcaatgtgattcggctatctgtgtctactaactctcaaatttatttatcaaagttaggatcctagcctcccacagagaccaggagtcggccttatcattcctgataattatatgacaaagggatggctcccagaaaaagtgagaaacacattcctgtgcagcagaagatacatatatcccccaaagggacagaaaggatttacaattgtaaattttataaagtatgtcctctaagaagagggagggactgggtgccatggctcatgcctataatcccagcactttgggtggccaaggtgggtgcatcacctgaggtcaggagttcaagagcagcctggccaacatggtgaaaccctgtctctactaaaaatacaaaagttagcctgttgtggtggcgcgcacctgtaatcccagctactcgggtggctgaggcaggagaatcgcttgaacccaggaggcggagggtgcagtgagccgggatcacgccactgcacttcagcctgggtgacagagtgtgactccatctcaagaaaaacgagggagattagaaacctatgatcaggcattggctgaaacaaatggtaaattcttttggcagccttgagcttccccaggcagggacccaaaggggcctgggttatccctgagacagggccttgagctgctagaaactatgctagtgtttgttcaagtctctccgtgtccggggtgagcaaaattgtttgtgctgaaaatcaatgatttgcagctctcaagattccagtgggcagtctgggtgggcctgagtttctgctttttttttttctttatgtacagggtcttgctctgtcacctaggctagagtgtaattagtggccccagtcatggctcactgcagctgcaaactggctgcaagctgttctggctcagcctaccangttactgggcttacaggtggatgccaccgtacccaacagattttatttttgtagggatgggggtctccctgtattgcccaggctggtctcaaactcctggcctcccaangtgtttagattncaggtgtaagccaccacacgtggccagcctctgcatttctaacaggttccaggtgatcttgatgttctgctggtccatgggtcacactttgagaagcatggttctaaaggactatacagattaaagtcattaatctctgtgggctttggacttgaagtttcagcagcctttgacaagcatttgcaggtttcctttttatttatttgataaactgagaatccacatgcaaagaaatgcaagaaaattcaaagaacgtaagaaaatgtccttgctgtaaagctggtggttctcaatctcggatacacagtagaatcacctggtgcgggggttgggggcggggtgcagtgtaaaaattattaaatcagaatctctggggtaggccccaagcaacttttttttttttttttttagatagaatcttgcttgtcacctaggctaggagtgcagtggtgcaatcatggctcactgccgccttaacttctgggctcaagtgatatcctcccgacctcagcctccctagtagctgggactacaggcgtggactaccacacccaacaaatttttaaattttttgtagaggcaagctcttatactatcttgcacaggctggtctcgaactcctgggctcaagcagtcatcctgcctcagccttccaaagctcagggattacagacatgagccacagcaccaggccaacaatatttcttaaagctcctggagtgattccaatatgcagccaaggttgaaaaccaccctttaaaaggctcggcatccagtgtggaagaccagcacactcacgtcaggagaccttacctggagccaggatgcccctgatcatctctgataactttaaaaggaaggcctcagaagcagccccagaagcaaaagtttctctctgaccttctcctgccctcttgtttctggcttttcattctcccccaaggctacccatagaaactagaatccctcttccccaaggcaggtcatcagaaaccagaaccggttttacccaaagccagccataaaacctaaaaatagtcctctcactccccattcccctttctgtgtaaaaactggttggaaagaaatgatctgacctaccgtgtttgactgtcgtaagatacccattccagagagggtcccaccccgtgcccagaaggaaggaatcctgcacagagaggccaagaagaatctagacagccttgctgggtttcccctctcagtctattactattagatcatacccttcttgtccaatcatatttctacacagtccataatctgttgaacctaaacataaaaatggacaattcccctgtatcttggggtcttcattctgagggctcacatacaattatgatcaaataaatttgtttgctttttctcctgttaa

SEQ ID NO: 456015 - DNA, 9734 bp, Homo sapiens
  misc_feature (174)..(174): n is a, c, g, or t
  misc_feature (1714)..(1714): n is a, c, g, or t
  misc_feature (1724)..(1724): n is a, c, g, or t
  misc_feature (8220)..(8220): n is a, c, g, or t
  misc_feature (8329)..(8329): n is a, c, g, or t
  misc_feature (8341)..(8341): n is a, c, g, or t
tgtccatgtatactattgattagctcccacttgcaaatgagaacacgtggtatttgattttcttttctgggttagttcacttaggatgatggtctccagctccatgttgctgcaaaggacatgatttcgttctttttttatggctgcctcttttgtttcttaaatctgaatttncatgtggcttcaatgctagtctggcctaccctttccttcccaaagtcaccaccaactcactcccacccccacctcatgcagtgcacccctcacagcccccacccttggcagtgacatttggatttccagggcctttcctgatcctttagagacatcctctcccggccaagtcctgcaagggagacttgagtcagaggttcgatgggctggggtgaggtgggccacacaattaccacacccactcccaggcctattcccggtgatctaagcacacagaagcaggctggtacttagggaagaaggcaccagtgtatgccagagcttaggatggcgtgaggaccaaatggaaagatagatattgtaagtggttgttgggagaaggaaggctggaggtgggggtactttgtgggctgcttccaggagctcccacccacaggcacaagtcttcctagctggcagaagaagccaggaacaaggctgaattctgacagaacccgcctggagctccatttcagttgcagagacctttatcttatgcagctgtcttttgcccagcctcctctgcagatgccataggacctcctctttcttttcttttctttctttttttttgagactgagtcttgctctatgaccagactggaatgcagtggcacaatctcagctcactgcaacctccgcctcccgggttcaggcgattctcctccctcagcctcccaaatagctgggattataggcatgcgccaccatgcccagctaatttttgtatttttagtagagacagggtttcactgtgttggccaggatggtctccatctcttgacctcgtgattcacctgcctcggcctcccaaagtgctgggattacaggcatgacccaccgtgccctgccaggacttcctctttctttttttttttttctttttttttttgagacggagtttcactcttgttgcccaggctgaagtgcaatggcacgatctcggctcaccgcaacctccgcctcccaggttcaagcgattctcctgcctcagcacccccgagaagctgggattacaggcacgcaccaccacgcccggctaattttgtatttttagtagagatgaggtttcttcatgttagtcaggctggtctcgaactcccgacctcaggtgatccgcccacctcggcctcccaaagtgctgggattacaggcatgagccaccgcgccctgccaggacctcctctttctgatataacacctgcatttgtttggcagacatctgtgtagttctgttcacaggagaaaaaagtcagattactaaacaccagtgtttaacagtggccatcagtaggtggtagcttcagagagtatttgctttcttatcgactatggtttcatgtattctctgttttgttttttactataagcatattttgtttttatataagggagaaataaagctcttctcaattgggagaaattactgcctgcctataatgaatgaggccctgctgggcactggctgggggcttgatgagtaggatatggtccctgtttntggagggtcntcaaactaaagaggaaagaagataggggaacaaaacagtgcggttggtgttctaagtatcctctgatcacagaagagaaagctgcccctacccagggacatgatcctgagccacctggattgtgagggagaatcaggcattgatgaggaggggaatgaggaagtagtctgcctacaggggacatagctcggcacagctccacagagctaggggctgcaacttggggcatgagaagagagagcagcaagagaaccatttgagaaggctgtcctttctctgtcatcactcctgatgccctggtgagctccacggtgcaggaacctccatgtgtgtgctgcatccccaagttctggtggcagcaggtgcttagcagcccttgtccagtctcgcctgtgacactgctgctcccttcccctgtcctgacctcctggttggctgtcctgccagagccttgcctggaagatgaaattccagctaccctgtgggagcagtaacgccttcttccttcttctcaatctccagaaatgtcaaatgtctttcctccaggacccaagtttcttcaccatggggatgtggtccattggtgcaggagccctgggggctgctgccttggcattgctgcttgccaacacagacgtgtttctgtccaagccccagaaagcggccctggagtacctggaggatatagacctgaaaacactggagaagggtaagtggtgacccttcaggtctcagtacttttccaaggagctgggatacaggcttactgctttctttctaaactctctcctttttttaattgaaaagataatataacaacattaggaaaaatttaataacaatttttaaactaggaataattctgttaccctaacacagtaattttgattttggcatattcctttccatgtgtacatattacgtagttgtgcttggcttaggtgctgttttacattttagcttttcttatcaaaagcatttctcattctctgttgttgtctctgtaattataatgataaattgctccataatatttagtaataattacaatcttttactaaaccagtgcttccagagtgtattctgaggaattccaggcttgtgggatcgtcaaactaaaaggagttcctgagtgaacaagtatgggagacaccttttatccaattccatgctcctgatgctcagcacagacatatgcttattagaatgaggtgtctggattgctgctgattcaggcatggccagcccctccctgtgaagaagctgtggtgtctgaggaatcacttcaaggtcacccgttagagcagacctgcctatctccctcttctgggggactgctagaatccattgtggacagcttagagccacacacccaaatgtgttagctctgcctccttgctgtgtgctctcagtgttagagctgtagcttggtgggatttcagtcatgccagtggtgtggcaagagagttggagtggtgaaggtctcattgatggcgtggtcaccatgttagccccccaggtggaagtcatcgtcatctgtttagtaagtaaggaagcttgcgaaaggaaggcaggagattgtgcaggtttatagtaggtcaccttagtaagatactaggagagagagagacctgttaagctttgttcaacccagggtttcccaatcttatttgattacagactcttctccccaccctctcacccacctgaccccattttttttttttccacataacatctacgggaacatggatccctctgggaaatactaaaataattaagggctcatatttattgagccctcaccaactctatattaccagacattgtggtgagcacttttatattcatctttcaatatgccctgtggcccaaagtggagctactagatatttgcattttacaaatgaggaagctgaggttcaaagagcaaaaataacttgcccagagttacacagctagattcagattcagttggaccttagagctgggcttgttgaactacagtactgtactaccccaaagcattttattcctaggcatcttctatcctctccttcgttaataatattgcaggtaacatatttaggttaaaaatttgagactttttcagtttgggccatgtttctgttctgaaggattattatacaatatctgatgacatcagcaatagacaaaatggccatttttccagaaatgtcccacttctgaatgttcaggttagaaaaaagattttcatggtgggagggacctaccgggtatataacaggattcttaagcttggttaactttcttcaggaaggtgtgtattctgtctgtctgtgtttcctgtgtgtcttttcccacgtgtgaaatgcctgtccaggtcctctactaggccgggtctctgaccttggctggacttagtgtggttcatgagctgcttagtgattggggctgggctgggaggagatatcgaatttctttttttcctctcttagaaccaaggactttcaaagcaaaggagctatgggaaaaaaatggagctgtgattatggccgtgcggaggccaggctgtttcctctgtcgagaggaagctgcggatctgtcctccctgaaaagcatgttggaccagctgggcgtccccctctatgcagtggtaaaggagcacatcaggactgaagtgaaggatttccagccttatttcaaaggagaaatcttcctggatgaaaagaaaaagttctatggtccacaaaggcggaagatgatgtttatgggatttatccgtctgggagtgtggtacaacttcttccgagcctggaacggaggcttctctggaaacctggaaggagaaggcttcatccttgggggagttttcgtggtgggatcaggaaagcagggcattcttcttgagcaccgagaaaaagaatttggagacaaagtaaacctactttctgttctggaagctgctaagatgatcaaaccacagactttggcctcagagaaaaaatgattgtgtgaaactgcccagctcagggataaccagggacattcacctgtgttcatgggatgtattgtttccactcgtgtccctaaggagtgagaaacccatttatactctactctcagtatggattattaatgtattttaatattctgtttaggcccactaaggcaaaatagccccaaaacaagactgacaaaaatctgaaaaactaatgaggattattaagctaaaacctgggaaataggaggcttaaaattgactgccaggctgggtgcagtggctcacacctgtaatcccagcactttgggaggccaaggtgagcaagtcacttgaggtcgggagttcgagaccagcctgagcaacatggcgaaaccccgtctctactaaaaatacaaaaatcacccgggtgtggtggcaggcacctgtagtcccagctacccgggaggctgaggcaggagaatcacttgaacctgggaggtggaggttgcggtgagctgagatcacaccactgtattccagcctgggtgactgagactctaactaaaaaaaaaaaaaaaaaaaaattgattgctgtgcctcattacaaatgcatatgatgtttgagtgctgttgtttgaaattatttttcttttcgggtcttcaaaaattcaagaaaagttgatgattgacttgaagattacaaaatttaaggttttttggcatgtgtgttttctattaataattggttatatgatgtcaaagtaatactttcataatagaattgacatgctctgggatagtttgacaaaggtaaattataaagtgaaatctcttgtttcattatcttccattctaacctcagagatctgtttctctagaaaaaatgtccatctctggctttaataaaattatgcatcagaaatcacctgtatgtataagattttctgataaaactaataattatatttaccatataattggctgaaagtaaaaaaagtcagcattctccatggctgaggggtaaagtgcctcgggggattcctctggttctagctatctaagtggtttgaaaatgaccaggaaaaattcatcctgtcattcacgttagtaattttgctgtctttcctagaggaatgactttggtgtttaaaattggtagctgtttttctattggtcttttagcctaatttggcaaatcagaagaaaggacatagagatgatgaaatataactttatcttttttgtttgaattttgtcgtgtaagtttgagtgacatcatcaagacctaccagggagctcggccacagggagtctactcaaggcatcaaactggcccaggagtagaaaggtgggggtggaaataggaaatagtgtttacccaggggactggcccagccaggaggagaaaggaatcagtgtttacccaggaaagcaagaatggatactgatgttggaggtaaagctgggaaagtaggagagcatcgggattgagtatgcagagtgagttagggttgagtggttcgggactaagacccactaagaccatgcctgcacctgacttcatgtagcagtggttgcatggggtatgcatgggcccttaaagggctgggcttctgcagcatttgaggccatagcctttggtacttgcacagggttggtacctgtcatccttgggactccagctactgataggataactcagtacctaaacttagaactttaatacctaagacacttgatggtgaaacagttctcttgcaactaaagaagaacctgaggtcaggtgtggtggctcacgcctgtaatcctagcactttgggaagtcgaggtagaaggatcacttgaggtcaggagttcgagaccagcctggccagcatggtgaaaccccatctctactaaaaatacaaaatattagacagacggggtggtacatgcctgtaatcccagctacttgggaggctgaggcaggagaatcgcttgaacccaggaggcagaggttgcagtgagccgagatcgtgccactgcactccagcttgggcaacaagagcgaaactccatatcaaaaaaaaaaacctgagaggacattgcaccaatggagatgcatcaagagaaacatgtttggttttttgtgagctctcaccaacttttttcccctgggtcctcacgtgcagtgtggtcttctctttctgattagcatgtcattttggaaagagcactggattgagtcatgaggcataatcaatttctagtttaccagtgtgatcttaagcaaagatctaactcattggcaaaatgggcgtgattccttcccattcagggctgtttatgataagtcactgagggaatgataaatattatgacactgcttctcagactgtaatgtacatgcacatcacataaggaccttattaaaatggagacttaaaaagctggacgctaaaggcaataatgacagattttactcaataactactgcagaaggagagagtcctcagtatagaactgagcttagctccaatctgtgcagaggtgatggaattttaaagaggggagggaggaggttcaaatagaactagggaagtgcaaaattacaaaaagctggtaaggagattggtcaatgtgattcggctatctgtgtctactaactctcaaatttatttatcaaagttaggatcctagcctcccacagagaccaggagtcggccttatcattcctgataattatatgacaaagggatggctcccagaaaaagtgagaaacacattcctgtgcagcagaagatacatatatcccccaaagggacagaaaggatttacaattgtaaattttataaagtatgtcctctaagaagagggagggactgggtgccatggctcatgcctataatcccagcactttgggtggccaaggtgggtgcatcacctgaggtcaggagttcaagagcagcctggccaacatggtgaaaccctgtctctactaaaaatacaaaagttagcctgttgtggtggcgcgcacctgtaatcccagctactcgggtggctgaggcaggagaatcgcttgaacccaggaggcggagggtgcagtgagccgggatcacgccactgcacttcagcctgggtgacagagtgtgactccatctcaagaaaaacgagggagattagaaacctatgatcaggcattggctgaaacaaatggtaaattcttttggcagccttgagcttccccaggcagggacccaaaggggcctgggttatccctgagacagggccttgagctgctagaaactatgctagtgtttgttcaagtctctccgtgtccggggtgagcaaaattgtttgtgctgaaaatcaatgatttgcagctctcaagattccagtgggcagtctgggtgggcctgagtttctgctttttttttttctttatgtacagggtcttgctctgtcacctaggctagagtgtaattagtggccccagtcatggctcactgcagctgcaaactggctgcaagctgttctggctcagcctaccangttactgggcttacaggtggatgccaccgtacccaacagattttatttttgtagggatgggggtctccctgtattgcccaggctggtctcaaactcctggcctcccaangtgtttagattncaggtgtaagccaccacacgtggccagcctctgcatttctaacaggttccaggtgatcttgatgttctgctggtccatgggtcacactttgagaagcatggttctaaaggactatacagattaaagtcattaatctctgtgggctttggacttgaagtttcagcagcctttgacaagcatttgcaggtttcctttttatttatttgataaactgagaatccacatgcaaagaaatgcaagaaaattcaaagaacgtaagaaaatgtccttgctgtaaagctggtggttctcaatctcggatacacagtagaatcacctggtgcgggggttgggggcggggtgcagtgtaaaaattattaaatcagaatctctggggtaggccccaagcaacttttttttttttttttttagatagaatcttgcttgtcacctaggctaggagtgcagtggtgcaatcatggctcactgccgccttaacttctgggctcaagtgatatcctcccgacctcagcctccctagtagctgggactacaggcgtggactaccacacccaacaaatttttaaattttttgtagaggcaagctcttatactatcttgcacaggctggtctcgaactcctgggctcaagcagtcatcctgcctcagccttccaaagctcagggattacagacatgagccacagcaccaggccaacaatatttcttaaagctcctggagtgattccaatatgcagccaaggttgaaaaccaccctttaaaaggctcggcatccagtgtggaagaccagcacactcacgtcaggagaccttacctggagccaggatgcccctgatcatctctgataactttaaaaggaaggcctcagaagcagccccagaagcaaaagtttctctctgaccttctcctgccctcttgtttctggcttttcattctcccccaaggctacccatagaaactagaatccctcttccccaaggcaggtcatcagaaaccagaaccggttttacccaaagccagccataaaacctaaaaatagtcctctcactccccattcccctttctgtgtaaaaactggttggaaagaaatgatctgacctaccgtgtttgactgtcgtaagatacccattccagagagggtcccaccccgtgcccagaaggaaggaatcctgcacagagaggccaagaagaatctagacagccttgctgggtttcccctctcagtctattactattagatcatacccttcttgtccaatcatatttctacacagtccataatctgttgaacctaaacataaaaatggacaattcccctgtatcttggggtcttcattctgagggctcacatacaattatgatcaaataaatttgtttgctttttctcctgttaa

SEQ ID NO: 456016 - DNA, 1150 bp, Homo sapiens
agcggacatggcggtggcgcggtagcgcgcgatgcagcacaggctagaggctgcgcaagcgcggggcccgcccctgggaccctccgggccgggcggtttggccccttagcgcccgggcgtcggggcggtaaaaggccggcagaagggaggcacttgagaaatgtctttcctccaggacccaagtttcttcaccatggggatgtggtccattggtgcaggagccctgggggctgctgccttggcattgctgcttgccaacacagacgtgtttctgtccaagccccagaaagcggccctggagtacctggaggatatagacctgaaaacactggagaaggaaccaaggactttcaaagcaaaggagctatgggaaaaaaatggagctgtgattatggccgtgcggaggccaggctgtttcctctgtcgagaggaagctgcggatctgtcctccctgaaaagcatgttggaccagctgggcgtccccctctatgcagtggtaaaggagcacatcaggactgaagtgaaggatttccagccttatttcaaaggagaaatcttcctggatgaaaagaaaaagttctatggtccacaaaggcggaagatgatgtttatgggatttatccgtctgggagtgtggtacaacttcttccgagcctggaacggaggcttctctggaaacctggaaggagaaggcttcatccttgggggagttttcgtggtgggatcaggaaagcagggcattcttcttgagcaccgagaaaaagaatttggagacaaagtaaacctactttctgttctggaagctgctaagatgatcaaaccacagactttggcctcagagaaaaaatgattgtgtgaaactgcccagctcagggataaccagggacattcacctgtgttcatgggatgtattgtttccactcgtgtccctaaggagtgagaaacccatttatactctactctcagtatggattattaatgtattttaatattctgtttaggcccactaaggcaaaatagccccaaaacaagactgacaaaaatctgaaaaactaatgaggattattaagctaaaacctgggattacaggcgtgacgaccttgcccagcccacatcatacagtttgaaatgaaactttgccacaaccagc

SEQ ID NO: 456017 - DNA, 1133 bp, Homo sapiens
agcggacatggcggtggcgcggtagcgcgcgatgcagcacaggctagaggctgcgcaagcgcggggcccgcccctgggaccctccgggccgggcggtttggccccttagcgcccgggcgtcggggcggtaaaaggccggcagaagggaggcacttgagaaatgtctttcctccaggacccaagtttcttcaccatggggatgtggtccattggtgcaggagccctgggggctgctgccttggcattgctgcttgccaacacagacgtgtttctgtccaagccccagaaagcggccctggagtacctggaggatatagacctgaaaacactggagaaggaaccaaggactttcaaagcaaaggagctatgggaaaaaaatggagctgtgattatggccgtgcggaggccaggctgtttcctctgtcgagaggaagctgcggatctgtcctccctgaaaagcatgttggaccagctgggcgtccccctctatgcagtggtaaaggagcacatcaggactgaagtgaaggatttccagccttatttcaaaggagaaatcttcctggatgaaaagaaaaagttctatggtccacaaaggcggaagatgatgtttatgggatttatccgtctgggagtgtggtacaacttcttccgagcctggaacggaggcttctctggaaacctggaaggagaaggcttcatccttgggggagttttcgtggtgggatcaggaaagcagggcattcttcttgagcaccgagaaaaagaatttggagacaaagtaaacctactttctgttctggaagctgctaagatgatcaaaccacagactttggcctcagagaaaaaatgattgtgtgaaactgcccagctcagggataaccagggacattcacctgtgttcatgggatgtattgtttccactcgtgtccctaaggagtgagaaacccatttatactctactctcagtatggattattaatgtattttaatattctgtttaggcccactaaggcaaaatagccccaaaacaagactgacaaaaatctgaaaaactaatgaggatatagacctgaaaacactggagaaggaaccaaggactttcaaagcaaaggagctatgggaaaaaaatggag

SEQ ID NO: 456018 - DNA, 5663 bp, Homo sapiens
  misc_feature (4149)..(4149): n is a, c, g, or t
  misc_feature (4258)..(4258): n is a, c, g, or t
  misc_feature (4270)..(4270): n is a, c, g, or t
agataactttggggtatcttgtgtcttagtgcattttttttcactgtatgagaagaaagtggcttccagtttcttagaagactaaagaaaaatgagggtctctcttttagatggtcattcagtgccttccaaagtctaacctctgagctccacttccacacctttgggcctttctgtgttagcttcatttttttctcttcacctggtatgttcttttacctgcatctctacttgtagacatcctggttaccctccgtgcctctgtgaggccttccctgattgcccttgtcatgctttatcacttctgacttcctgcttctagagctgctggtacaggccagatggatgtggccttctccggtctatcttccctcaaagactgaactccttgagggcaggagccaggccatatttggatctgtgtcctttgctattcaagcaaaaggcttgacagacagctggtcctcgatgcctgtctcatgaacgaacgatttaggatgaggactgacattatctcttgtttccttttagggcattcttcttgagcaccgagaaaaagaatttggagacaaagtaaacctactttctgttctggaagctgctaagatgatcaaaccacagactttggcctcagagaaaaaatgattgtgtgaaactgcccagctcagggataaccagggacattcacctgtgttcatgggatgtattgtttccactcgtgtccctaaggagtgagaaacccatttatactctactctcagtatggattattaatgtattttaatattctgtttaggcccactaaggcaaaatagccccaaaacaagactgacaaaaatctgaaaaactaatgaggattattaagctaaaacctgggaaataggaggcttaaaattgactgccaggctgggtgcagtggctcacacctgtaatcccagcactttgggaggccaaggtgagcaagtcacttgaggtcgggagttcgagaccagcctgagcaacatggcgaaaccccgtctctactaaaaatacaaaaatcacccgggtgtggtggcaggcacctgtagtcccagctacccgggaggctgaggcaggagaatcacttgaacctgggaggtggaggttgcggtgagctgagatcacaccactgtattccagcctgggtgactgagactctaactaaaaaaaaaaaaaaaaaaaaattgattgctgtgcctcattacaaatgcatatgatgtttgagtgctgttgtttgaaattatttttcttttcgggtcttcaaaaattcaagaaaagttgatgattgacttgaagattacaaaatttaaggttttttggcatgtgtgttttctattaataattggttatatgatgtcaaagtaatactttcataatagaattgacatgctctgggatagtttgacaaaggtaaattataaagtgaaatctcttgtttcattatcttccattctaacctcagagatctgtttctctagaaaaaatgtccatctctggctttaataaaattatgcatcagaaatcacctgtatgtataagattttctgataaaactaataattatatttaccatataattggctgaaagtaaaaaaagtcagcattctccatggctgaggggtaaagtgcctcgggggattcctctggttctagctatctaagtggtttgaaaatgaccaggaaaaattcatcctgtcattcacgttagtaattttgctgtctttcctagaggaatgactttggtgtttaaaattggtagctgtttttctattggtcttttagcctaatttggcaaatcagaagaaaggacatagagatgatgaaatataactttatcttttttgtttgaattttgtcgtgtaagtttgagtgacatcatcaagacctaccagggagctcggccacagggagtctactcaaggcatcaaactggcccaggagtagaaaggtgggggtggaaataggaaatagtgtttacccaggggactggcccagccaggaggagaaaggaatcagtgtttacccaggaaagcaagaatggatactgatgttggaggtaaagctgggaaagtaggagagcatcgggattgagtatgcagagtgagttagggttgagtggttcgggactaagacccactaagaccatgcctgcacctgacttcatgtagcagtggttgcatggggtatgcatgggcccttaaagggctgggcttctgcagcatttgaggccatagcctttggtacttgcacagggttggtacctgtcatccttgggactccagctactgataggataactcagtacctaaacttagaactttaatacctaagacacttgatggtgaaacagttctcttgcaactaaagaagaacctgaggtcaggtgtggtggctcacgcctgtaatcctagcactttgggaagtcgaggtagaaggatcacttgaggtcaggagttcgagaccagcctggccagcatggtgaaaccccatctctactaaaaatacaaaatattagacagacggggtggtacatgcctgtaatcccagctacttgggaggctgaggcaggagaatcgcttgaacccaggaggcagaggttgcagtgagccgagatcgtgccactgcactccagcttgggcaacaagagcgaaactccatatcaaaaaaaaaaacctgagaggacattgcaccaatggagatgcatcaagagaaacatgtttggttttttgtgagctctcaccaacttttttcccctgggtcctcacgtgcagtgtggtcttctctttctgattagcatgtcattttggaaagagcactggattgagtcatgaggcataatcaatttctagtttaccagtgtgatcttaagcaaagatctaactcattggcaaaatgggcgtgattccttcccattcagggctgtttatgataagtcactgagggaatgataaatattatgacactgcttctcagactgtaatgtacatgcacatcacataaggaccttattaaaatggagacttaaaaagctggacgctaaaggcaataatgacagattttactcaataactactgcagaaggagagagtcctcagtatagaactgagcttagctccaatctgtgcagaggtgatggaattttaaagaggggagggaggaggttcaaatagaactagggaagtgcaaaattacaaaaagctggtaaggagattggtcaatgtgattcggctatctgtgtctactaactctcaaatttatttatcaaagttaggatcctagcctcccacagagaccaggagtcggccttatcattcctgataattatatgacaaagggatggctcccagaaaaagtgagaaacacattcctgtgcagcagaagatacatatatcccccaaagggacagaaaggatttacaattgtaaattttataaagtatgtcctctaagaagagggagggactgggtgccatggctcatgcctataatcccagcactttgggtggccaaggtgggtgcatcacctgaggtcaggagttcaagagcagcctggccaacatggtgaaaccctgtctctactaaaaatacaaaagttagcctgttgtggtggcgcgcacctgtaatcccagctactcgggtggctgaggcaggagaatcgcttgaacccaggaggcggagggtgcagtgagccgggatcacgccactgcacttcagcctgggtgacagagtgtgactccatctcaagaaaaacgagggagattagaaacctatgatcaggcattggctgaaacaaatggtaaattcttttggcagccttgagcttccccaggcagggacccaaaggggcctgggttatccctgagacagggccttgagctgctagaaactatgctagtgtttgttcaagtctctccgtgtccggggtgagcaaaattgtttgtgctgaaaatcaatgatttgcagctctcaagattccagtgggcagtctgggtgggcctgagtttctgctttttttttttctttatgtacagggtcttgctctgtcacctaggctagagtgtaattagtggccccagtcatggctcactgcagctgcaaactggctgcaagctgttctggctcagcctaccangttactgggcttacaggtggatgccaccgtacccaacagattttatttttgtagggatgggggtctccctgtattgcccaggctggtctcaaactcctggcctcccaangtgtttagattncaggtgtaagccaccacacgtggccagcctctgcatttctaacaggttccaggtgatcttgatgttctgctggtccatgggtcacactttgagaagcatggttctaaaggactatacagattaaagtcattaatctctgtgggctttggacttgaagtttcagcagcctttgacaagcatttgcaggtttcctttttatttatttgataaactgagaatccacatgcaaagaaatgcaagaaaattcaaagaacgtaagaaaatgtccttgctgtaaagctggtggttctcaatctcggatacacagtagaatcacctggtgcgggggttgggggcggggtgcagtgtaaaaattattaaatcagaatctctggggtaggccccaagcaacttttttttttttttttttagatagaatcttgcttgtcacctaggctaggagtgcagtggtgcaatcatggctcactgccgccttaacttctgggctcaagtgatatcctcccgacctcagcctccctagtagctgggactacaggcgtggactaccacacccaacaaatttttaaattttttgtagaggcaagctcttatactatcttgcacaggctggtctcgaactcctgggctcaagcagtcatcctgcctcagccttccaaagctcagggattacagacatgagccacagcaccaggccaacaatatttcttaaagctcctggagtgattccaatatgcagccaaggttgaaaaccaccctttaaaaggctcggcatccagtgtggaagaccagcacactcacgtcaggagaccttacctggagccaggatgcccctgatcatctctgataactttaaaaggaaggcctcagaagcagccccagaagcaaaagtttctctctgaccttctcctgccctcttgtttctggcttttcattctcccccaaggctacccatagaaactagaatccctcttccccaaggcaggtcatcagaaaccagaaccggttttacccaaagccagccataaaacctaaaaatagtcctctcactccccattcccctttctgtgtaaaaactggttggaaagaaatgatctgacctaccgtgtttgactgtcgtaagatacccattccagagagggtcccaccccgtgcccagaaggaaggaatcctgcacagagaggccaagaagaatctagacagccttgctgggtttcccctctcagtctattactattagatcatacccttcttgtccaatcatatttctacacagtccataatctgttgaacctaaacataaaaatggacaattcccctgtatcttggggtcttcattctgagggctcacatacaattatgatcaaataaatttgtttgctttttctcctgttaa

SEQ ID NO: 456019 - DNA, 4875 bp, Homo sapiens
  misc_feature (3361)..(3361): n is a, c, g, or t
  misc_feature (3470)..(3470): n is a, c, g, or t
  misc_feature (3482)..(3482): n is a, c, g, or t
actactactactaaattcacggccgcgtcgacaaacaagactgacaaaaatctgaaaaactaatgaggattattaagctaaaacctgggaaataggaggcttaaaattgactgccaggctgggtgcagtggctcacacctgtaatcccagcactttgggaggccaaggtgagcaagtcacttgaggtcgggagttcgagaccagcctgagcaacatggcgaaaccccgtctctactaaaaatacaaaaatcacccgggtgtggtggcaggcacctgtagtcccagctacccgggaggctgaggcaggagaatcacttgaacctgggaggtggaggttgcggtgagctgagatcacaccactgtattccagcctgggtgactgagactctaactaaaaaaaaaaaaaaaaaaaaattgattgctgtgcctcattacaaatgcatatgatgtttgagtgctgttgtttgaaattatttttcttttcgggtcttcaaaaattcaagaaaagttgatgattgacttgaagattacaaaatttaaggttttttggcatgtgtgttttctattaataattggttatatgatgtcaaagtaatactttcataatagaattgacatgctctgggatagtttgacaaaggtaaattataaagtgaaatctcttgtttcattatcttccattctaacctcagagatctgtttctctagaaaaaatgtccatctctggctttaataaaattatgcatcagaaatcacctgtatgtataagattttctgataaaactaataattatatttaccatataattggctgaaagtaaaaaaagtcagcattctccatggctgaggggtaaagtgcctcgggggattcctctggttctagctatctaagtggtttgaaaatgaccaggaaaaattcatcctgtcattcacgttagtaattttgctgtctttcctagaggaatgactttggtgtttaaaattggtagctgtttttctattggtcttttagcctaatttggcaaatcagaagaaaggacatagagatgatgaaatataactttatcttttttgtttgaattttgtcgtgtaagtttgagtgacatcatcaagacctaccagggagctcggccacagggagtctactcaaggcatcaaactggcccaggagtagaaaggtgggggtggaaataggaaatagtgtttacccaggggactggcccagccaggaggagaaaggaatcagtgtttacccaggaaagcaagaatggatactgatgttggaggtaaagctgggaaagtaggagagcatcgggattgagtatgcagagtgagttagggttgagtggttcgggactaagacccactaagaccatgcctgcacctgacttcatgtagcagtggttgcatggggtatgcatgggcccttaaagggctgggcttctgcagcatttgaggccatagcctttggtacttgcacagggttggtacctgtcatccttgggactccagctactgataggataactcagtacctaaacttagaactttaatacctaagacacttgatggtgaaacagttctcttgcaactaaagaagaacctgaggtcaggtgtggtggctcacgcctgtaatcctagcactttgggaagtcgaggtagaaggatcacttgaggtcaggagttcgagaccagcctggccagcatggtgaaaccccatctctactaaaaatacaaaatattagacagacggggtggtacatgcctgtaatcccagctacttgggaggctgaggcaggagaatcgcttgaacccaggaggcagaggttgcagtgagccgagatcgtgccactgcactccagcttgggcaacaagagcgaaactccatatcaaaaaaaaaaacctgagaggacattgcaccaatggagatgcatcaagagaaacatgtttggttttttgtgagctctcaccaacttttttcccctgggtcctcacgtgcagtgtggtcttctctttctgattagcatgtcattttggaaagagcactggattgagtcatgaggcataatcaatttctagtttaccagtgtgatcttaagcaaagatctaactcattggcaaaatgggcgtgattccttcccattcagggctgtttatgataagtcactgagggaatgataaatattatgacactgcttctcagactgtaatgtacatgcacatcacataaggaccttattaaaatggagacttaaaaagctggacgctaaaggcaataatgacagattttactcaataactactgcagaaggagagagtcctcagtatagaactgagcttagctccaatctgtgcagaggtgatggaattttaaagaggggagggaggaggttcaaatagaactagggaagtgcaaaattacaaaaagctggtaaggagattggtcaatgtgattcggctatctgtgtctactaactctcaaatttatttatcaaagttaggatcctagcctcccacagagaccaggagtcggccttatcattcctgataattatatgacaaagggatggctcccagaaaaagtgagaaacacattcctgtgcagcagaagatacatatatcccccaaagggacagaaaggatttacaattgtaaattttataaagtatgtcctctaagaagagggagggactgggtgccatggctcatgcctataatcccagcactttgggtggccaaggtgggtgcatcacctgaggtcaggagttcaagagcagcctggccaacatggtgaaaccctgtctctactaaaaatacaaaagttagcctgttgtggtggcgcgcacctgtaatcccagctactcgggtggctgaggcaggagaatcgcttgaacccaggaggcggagggtgcagtgagccgggatcacgccactgcacttcagcctgggtgacagagtgtgactccatctcaagaaaaacgagggagattagaaacctatgatcaggcattggctgaaacaaatggtaaattcttttggcagccttgagcttccccaggcagggacccaaaggggcctgggttatccctgagacagggccttgagctgctagaaactatgctagtgtttgttcaagtctctccgtgtccggggtgagcaaaattgtttgtgctgaaaatcaatgatttgcagctctcaagattccagtgggcagtctgggtgggcctgagtttctgctttttttttttctttatgtacagggtcttgctctgtcacctaggctagagtgtaattagtggccccagtcatggctcactgcagctgcaaactggctgcaagctgttctggctcagcctaccangttactgggcttacaggtggatgccaccgtacccaacagattttatttttgtagggatgggggtctccctgtattgcccaggctggtctcaaactcctggcctcccaangtgtttagattncaggtgtaagccaccacacgtggccagcctctgcatttctaacaggttccaggtgatcttgatgttctgctggtccatgggtcacactttgagaagcatggttctaaaggactatacagattaaagtcattaatctctgtgggctttggacttgaagtttcagcagcctttgacaagcatttgcaggtttcctttttatttatttgataaactgagaatccacatgcaaagaaatgcaagaaaattcaaagaacgtaagaaaatgtccttgctgtaaagctggtggttctcaatctcggatacacagtagaatcacctggtgcgggggttgggggcggggtgcagtgtaaaaattattaaatcagaatctctggggtaggccccaagcaacttttttttttttttttttagatagaatcttgcttgtcacctaggctaggagtgcagtggtgcaatcatggctcactgccgccttaacttctgggctcaagtgatatcctcccgacctcagcctccctagtagctgggactacaggcgtggactaccacacccaacaaatttttaaattttttgtagaggcaagctcttatactatcttgcacaggctggtctcgaactcctgggctcaagcagtcatcctgcctcagccttccaaagctcagggattacagacatgagccacagcaccaggccaacaatatttcttaaagctcctggagtgattccaatatgcagccaaggttgaaaaccaccctttaaaaggctcggcatccagtgtggaagaccagcacactcacgtcaggagaccttacctggagccaggatgcccctgatcatctctgataactttaaaaggaaggcctcagaagcagccccagaagcaaaagtttctctctgaccttctcctgccctcttgtttctggcttttcattctcccccaaggctacccatagaaactagaatccctcttccccaaggcaggtcatcagaaaccagaaccggttttacccaaagccagccataaaacctaaaaatagtcctctcactccccattcccctttctgtgtaaaaactggttggaaagaaatgatctgacctaccgtgtttgactgtcgtaagatacccattccagagagggtcccaccccgtgcccagaaggaaggaatcctgcacagagaggccaagaagaatctagacagccttgctgggtttcccctctcagtctattactattagatcatacccttcttgtccaatcatatttctacacagtccataatctgttgaacctaaacataaaaatggacaattcccctgtatcttggggtcttcattctgagggctcacatacaattatgatcaaataaatttgtttgctttttctcctgttaa

SEQ ID NO: 456020 - DNA, 4682 bp, Homo sapiens
  misc_feature (3168)..(3168): n is a, c, g, or t
  misc_feature (3277)..(3277): n is a, c, g, or t
  misc_feature (3289)..(3289): n is a, c, g, or t
agacagcatcacgctctgtcgtccaggctagagtacagtggtgtgatctcaggtcattgcaacctccgtctcttgggctcaagcaatcctcccacctcaggaggctgaggcaggagaatcacttgaacctgggaggtggaggttgcggtgagctgagatcacaccactgtattccagcctgggtgactgagactctaactaaaaaaaaaaaaaaaaaaaaattgattgctgtgcctcattacaaatgcatatgatgtttgagtgctgttgtttgaaattatttttcttttcgggtcttcaaaaattcaagaaaagttgatgattgacttgaagattacaaaatttaaggttttttggcatgtgtgttttctattaataattggttatatgatgtcaaagtaatactttcataatagaattgacatgctctgggatagtttgacaaaggtaaattataaagtgaaatctcttgtttcattatcttccattctaacctcagagatctgtttctctagaaaaaatgtccatctctggctttaataaaattatgcatcagaaatcacctgtatgtataagattttctgataaaactaataattatatttaccatataattggctgaaagtaaaaaaagtcagcattctccatggctgaggggtaaagtgcctcgggggattcctctggttctagctatctaagtggtttgaaaatgaccaggaaaaattcatcctgtcattcacgttagtaattttgctgtctttcctagaggaatgactttggtgtttaaaattggtagctgtttttctattggtcttttagcctaatttggcaaatcagaagaaaggacatagagatgatgaaatataactttatcttttttgtttgaattttgtcgtgtaagtttgagtgacatcatcaagacctaccagggagctcggccacagggagtctactcaaggcatcaaactggcccaggagtagaaaggtgggggtggaaataggaaatagtgtttacccaggggactggcccagccaggaggagaaaggaatcagtgtttacccaggaaagcaagaatggatactgatgttggaggtaaagctgggaaagtaggagagcatcgggattgagtatgcagagtgagttagggttgagtggttcgggactaagacccactaagaccatgcctgcacctgacttcatgtagcagtggttgcatggggtatgcatgggcccttaaagggctgggcttctgcagcatttgaggccatagcctttggtacttgcacagggttggtacctgtcatccttgggactccagctactgataggataactcagtacctaaacttagaactttaatacctaagacacttgatggtgaaacagttctcttgcaactaaagaagaacctgaggtcaggtgtggtggctcacgcctgtaatcctagcactttgggaagtcgaggtagaaggatcacttgaggtcaggagttcgagaccagcctggccagcatggtgaaaccccatctctactaaaaatacaaaatattagacagacggggtggtacatgcctgtaatcccagctacttgggaggctgaggcaggagaatcgcttgaacccaggaggcagaggttgcagtgagccgagatcgtgccactgcactccagcttgggcaacaagagcgaaactccatatcaaaaaaaaaaacctgagaggacattgcaccaatggagatgcatcaagagaaacatgtttggttttttgtgagctctcaccaacttttttcccctgggtcctcacgtgcagtgtggtcttctctttctgattagcatgtcattttggaaagagcactggattgagtcatgaggcataatcaatttctagtttaccagtgtgatcttaagcaaagatctaactcattggcaaaatgggcgtgattccttcccattcagggctgtttatgataagtcactgagggaatgataaatattatgacactgcttctcagactgtaatgtacatgcacatcacataaggaccttattaaaatggagacttaaaaagctggacgctaaaggcaataatgacagattttactcaataactactgcagaaggagagagtcctcagtatagaactgagcttagctccaatctgtgcagaggtgatggaattttaaagaggggagggaggaggttcaaatagaactagggaagtgcaaaattacaaaaagctggtaaggagattggtcaatgtgattcggctatctgtgtctactaactctcaaatttatttatcaaagttaggatcctagcctcccacagagaccaggagtcggccttatcattcctgataattatatgacaaagggatggctcccagaaaaagtgagaaacacattcctgtgcagcagaagatacatatatcccccaaagggacagaaaggatttacaattgtaaattttataaagtatgtcctctaagaagagggagggactgggtgccatggctcatgcctataatcccagcactttgggtggccaaggtgggtgcatcacctgaggtcaggagttcaagagcagcctggccaacatggtgaaaccctgtctctactaaaaatacaaaagttagcctgttgtggtggcgcgcacctgtaatcccagctactcgggtggctgaggcaggagaatcgcttgaacccaggaggcggagggtgcagtgagccgggatcacgccactgcacttcagcctgggtgacagagtgtgactccatctcaagaaaaacgagggagattagaaacctatgatcaggcattggctgaaacaaatggtaaattcttttggcagccttgagcttccccaggcagggacccaaaggggcctgggttatccctgagacagggccttgagctgctagaaactatgctagtgtttgttcaagtctctccgtgtccggggtgagcaaaattgtttgtgctgaaaatcaatgatttgcagctctcaagattccagtgggcagtctgggtgggcctgagtttctgctttttttttttctttatgtacagggtcttgctctgtcacctaggctagagtgtaattagtggccccagtcatggctcactgcagctgcaaactggctgcaagctgttctggctcagcctaccangttactgggcttacaggtggatgccaccgtacccaacagattttatttttgtagggatgggggtctccctgtattgcccaggctggtctcaaactcctggcctcccaangtgtttagattncaggtgtaagccaccacacgtggccagcctctgcatttctaacaggttccaggtgatcttgatgttctgctggtccatgggtcacactttgagaagcatggttctaaaggactatacagattaaagtcattaatctctgtgggctttggacttgaagtttcagcagcctttgacaagcatttgcaggtttcctttttatttatttgataaactgagaatccacatgcaaagaaatgcaagaaaattcaaagaacgtaagaaaatgtccttgctgtaaagctggtggttctcaatctcggatacacagtagaatcacctggtgcgggggttgggggcggggtgcagtgtaaaaattattaaatcagaatctctggggtaggccccaagcaacttttttttttttttttttagatagaatcttgcttgtcacctaggctaggagtgcagtggtgcaatcatggctcactgccgccttaacttctgggctcaagtgatatcctcccgacctcagcctccctagtagctgggactacaggcgtggactaccacacccaacaaatttttaaattttttgtagaggcaagctcttatactatcttgcacaggctggtctcgaactcctgggctcaagcagtcatcctgcctcagccttccaaagctcagggattacagacatgagccacagcaccaggccaacaatatttcttaaagctcctggagtgattccaatatgcagccaaggttgaaaaccaccctttaaaaggctcggcatccagtgtggaagaccagcacactcacgtcaggagaccttacctggagccaggatgcccctgatcatctctgataactttaaaaggaaggcctcagaagcagccccagaagcaaaagtttctctctgaccttctcctgccctcttgtttctggcttttcattctcccccaaggctacccatagaaactagaatccctcttccccaaggcaggtcatcagaaaccagaaccggttttacccaaagccagccataaaacctaaaaatagtcctctcactccccattcccctttctgtgtaaaaactggttggaaagaaatgatctgacctaccgtgtttgactgtcgtaagatacccattccagagagggtcccaccccgtgcccagaaggaaggaatcctgcacagagaggccaagaagaatctagacagccttgctgggtttcccctctcagtctattactattagatcatacccttcttgtccaatcatatttctacacagtccataatctgttgaacctaaacataaaaatggacaattcccctgtatcttggggtcttcattctgagggctcacatacaattatgatcaaataaatttgtttgctttttctcctgttaa

SEQ ID NO: 456021 - DNA, 4577 bp, Homo sapiens
  misc_feature (3063)..(3063): n is a, c, g, or t
  misc_feature (3172)..(3172): n is a, c, g, or t
  misc_feature (3184)..(3184): n is a, c, g, or t
gaggtgctggctgcgtgctactttctttttatttttttgagacagagtctcgctcacaccactgtattccagcctgggtgactgagactctaactaaaaaaaaaaaaaaaaaaaaattgattgctgtgcctcattacaaatgcatatgatgtttgagtgctgttgtttgaaattatttttcttttcgggtcttcaaaaattcaagaaaagttgatgattgacttgaagattacaaaatttaaggttttttggcatgtgtgttttctattaataattggttatatgatgtcaaagtaatactttcataatagaattgacatgctctgggatagtttgacaaaggtaaattataaagtgaaatctcttgtttcattatcttccattctaacctcagagatctgtttctctagaaaaaatgtccatctctggctttaataaaattatgcatcagaaatcacctgtatgtataagattttctgataaaactaataattatatttaccatataattggctgaaagtaaaaaaagtcagcattctccatggctgaggggtaaagtgcctcgggggattcctctggttctagctatctaagtggtttgaaaatgaccaggaaaaattcatcctgtcattcacgttagtaattttgctgtctttcctagaggaatgactttggtgtttaaaattggtagctgtttttctattggtcttttagcctaatttggcaaatcagaagaaaggacatagagatgatgaaatataactttatcttttttgtttgaattttgtcgtgtaagtttgagtgacatcatcaagacctaccagggagctcggccacagggagtctactcaaggcatcaaactggcccaggagtagaaaggtgggggtggaaataggaaatagtgtttacccaggggactggcccagccaggaggagaaaggaatcagtgtttacccaggaaagcaagaatggatactgatgttggaggtaaagctgggaaagtaggagagcatcgggattgagtatgcagagtgagttagggttgagtggttcgggactaagacccactaagaccatgcctgcacctgacttcatgtagcagtggttgcatggggtatgcatgggcccttaaagggctgggcttctgcagcatttgaggccatagcctttggtacttgcacagggttggtacctgtcatccttgggactccagctactgataggataactcagtacctaaacttagaactttaatacctaagacacttgatggtgaaacagttctcttgcaactaaagaagaacctgaggtcaggtgtggtggctcacgcctgtaatcctagcactttgggaagtcgaggtagaaggatcacttgaggtcaggagttcgagaccagcctggccagcatggtgaaaccccatctctactaaaaatacaaaatattagacagacggggtggtacatgcctgtaatcccagctacttgggaggctgaggcaggagaatcgcttgaacccaggaggcagaggttgcagtgagccgagatcgtgccactgcactccagcttgggcaacaagagcgaaactccatatcaaaaaaaaaaacctgagaggacattgcaccaatggagatgcatcaagagaaacatgtttggttttttgtgagctctcaccaacttttttcccctgggtcctcacgtgcagtgtggtcttctctttctgattagcatgtcattttggaaagagcactggattgagtcatgaggcataatcaatttctagtttaccagtgtgatcttaagcaaagatctaactcattggcaaaatgggcgtgattccttcccattcagggctgtttatgataagtcactgagggaatgataaatattatgacactgcttctcagactgtaatgtacatgcacatcacataaggaccttattaaaatggagacttaaaaagctggacgctaaaggcaataatgacagattttactcaataactactgcagaaggagagagtcctcagtatagaactgagcttagctccaatctgtgcagaggtgatggaattttaaagaggggagggaggaggttcaaatagaactagggaagtgcaaaattacaaaaagctggtaaggagattggtcaatgtgattcggctatctgtgtctactaactctcaaatttatttatcaaagttaggatcctagcctcccacagagaccaggagtcggccttatcattcctgataattatatgacaaagggatggctcccagaaaaagtgagaaacacattcctgtgcagcagaagatacatatatcccccaaagggacagaaaggatttacaattgtaaattttataaagtatgtcctctaagaagagggagggactgggtgccatggctcatgcctataatcccagcactttgggtggccaaggtgggtgcatcacctgaggtcaggagttcaagagcagcctggccaacatggtgaaaccctgtctctactaaaaatacaaaagttagcctgttgtggtggcgcgcacctgtaatcccagctactcgggtggctgaggcaggagaatcgcttgaacccaggaggcggagggtgcagtgagccgggatcacgccactgcacttcagcctgggtgacagagtgtgactccatctcaagaaaaacgagggagattagaaacctatgatcaggcattggctgaaacaaatggtaaattcttttggcagccttgagcttccccaggcagggacccaaaggggcctgggttatccctgagacagggccttgagctgctagaaactatgctagtgtttgttcaagtctctccgtgtccggggtgagcaaaattgtttgtgctgaaaatcaatgatttgcagctctcaagattccagtgggcagtctgggtgggcctgagtttctgctttttttttttctttatgtacagggtcttgctctgtcacctaggctagagtgtaattagtggccccagtcatggctcactgcagctgcaaactggctgcaagctgttctggctcagcctaccangttactgggcttacaggtggatgccaccgtacccaacagattttatttttgtagggatgggggtctccctgtattgcccaggctggtctcaaactcctggcctcccaangtgtttagattncaggtgtaagccaccacacgtggccagcctctgcatttctaacaggttccaggtgatcttgatgttctgctggtccatgggtcacactttgagaagcatggttctaaaggactatacagattaaagtcattaatctctgtgggctttggacttgaagtttcagcagcctttgacaagcatttgcaggtttcctttttatttatttgataaactgagaatccacatgcaaagaaatgcaagaaaattcaaagaacgtaagaaaatgtccttgctgtaaagctggtggttctcaatctcggatacacagtagaatcacctggtgcgggggttgggggcggggtgcagtgtaaaaattattaaatcagaatctctggggtaggccccaagcaacttttttttttttttttttagatagaatcttgcttgtcacctaggctaggagtgcagtggtgcaatcatggctcactgccgccttaacttctgggctcaagtgatatcctcccgacctcagcctccctagtagctgggactacaggcgtggactaccacacccaacaaatttttaaattttttgtagaggcaagctcttatactatcttgcacaggctggtctcgaactcctgggctcaagcagtcatcctgcctcagccttccaaagctcagggattacagacatgagccacagcaccaggccaacaatatttcttaaagctcctggagtgattccaatatgcagccaaggttgaaaaccaccctttaaaaggctcggcatccagtgtggaagaccagcacactcacgtcaggagaccttacctggagccaggatgcccctgatcatctctgataactttaaaaggaaggcctcagaagcagccccagaagcaaaagtttctctctgaccttctcctgccctcttgtttctggcttttcattctcccccaaggctacccatagaaactagaatccctcttccccaaggcaggtcatcagaaaccagaaccggttttacccaaagccagccataaaacctaaaaatagtcctctcactccccattcccctttctgtgtaaaaactggttggaaagaaatgatctgacctaccgtgtttgactgtcgtaagatacccattccagagagggtcccaccccgtgcccagaaggaaggaatcctgcacagagaggccaagaagaatctagacagccttgctgggtttcccctctcagtctattactattagatcatacccttcttgtccaatcatatttctacacagtccataatctgttgaacctaaacataaaaatggacaattcccctgtatcttggggtcttcattctgagggctcacatacaattatgatcaaataaatttgtttgctttttctcctgttaa

SEQ ID NO: 456022 - DNA, 5868 bp, Homo sapiens
  misc_feature (4354)..(4354): n is a, c, g, or t
  misc_feature (4463)..(4463): n is a, c, g, or t
  misc_feature (4475)..(4475): n is a, c, g, or t
agcggacatggcggtggcgcggtagcgcgcgatgcagcacaggctagaggctgcgcaagcgcggggcccgcccctgggaccctccgggccgggcggtttggccccttagcgcccgggcgtcggggcggtaaaaggccggcagaagggaggcacttgagaaatgtctttcctccaggacccaagtttcttcaccatggggatgtggtccattggtgcaggagccctgggggctgctgccttggcattgctgcttgccaacacagacgtgtttctgtccaagccccagaaagcggccctggagtacctggaggatatagacctgaaaacactggagaaggaaccaaggactttcaaagcaaaggagctatgggaaaaaaatggagctgtgattatggccgtgcggaggccaggctgtttcctctgtcgagaggaagctgcggatctgtcctccctgaaaagcatgttggaccagctgggcgtccccctctatgcagtggtaaaggagcacatcaggactgaagtgaaggatttccagccttatttcaaaggagaaatcttcctggatgaaaagaaaaagttctatggtccacaaaggcggaagatgatgtttatgggatttatccgtctgggagtgtggtacaacttcttccgagcctggaacggaggcttctctggaaacctggaaggagaaggcttcatccttgggggagttttcgtggtgggatcaggaaagcagggcattcttcttgagcaccgagaaaaagaatttggagacaaagtaaacctactttctgttctggaagctgctaagatgatcaaaccacagactttggcctcagagaaaaaatgattgtgtgaaactgcccagctcagggataaccagggacattcacctgtgttcatgggatgtattgtttccactcgtgtccctaaggagtgagaaacccatttatactctactctcagtatggattattaatgtattttaatattctgtttaggcccactaaggcaaaatagccccaaaacaagactgacaaaaatctgaaaaactaatgaggattattaagctaaaacctgggaaataggaggcttaaaattgactgccaggctgggtgcagtggctcacacctgtaatcccagcactttgggaggccaaggtgagcaagtcacttgaggtcgggagttcgagaccagcctgagcaacatggcgaaaccccgtctctactaaaaatacaaaaatcacccgggtgtggtggcaggcacctgtagtcccagctacccgggaggctgaggcaggagaatcacttgaacctgggaggtggaggttgcggtgagctgagatcacaccactgtattccagcctgggtgactgagactctaactaaaaaaaaaaaaaaaaaaaaattgattgctgtgcctcattacaaatgcatatgatgtttgagtgctgttgtttgaaattatttttcttttcgggtcttcaaaaattcaagaaaagttgatgattgacttgaagattacaaaatttaaggttttttggcatgtgtgttttctattaataattggttatatgatgtcaaagtaatactttcataatagaattgacatgctctgggatagtttgacaaaggtaaattataaagtgaaatctcttgtttcattatcttccattctaacctcagagatctgtttctctagaaaaaatgtccatctctggctttaataaaattatgcatcagaaatcacctgtatgtataagattttctgataaaactaataattatatttaccatataattggctgaaagtaaaaaaagtcagcattctccatggctgaggggtaaagtgcctcgggggattcctctggttctagctatctaagtggtttgaaaatgaccaggaaaaattcatcctgtcattcacgttagtaattttgctgtctttcctagaggaatgactttggtgtttaaaattggtagctgtttttctattggtcttttagcctaatttggcaaatcagaagaaaggacatagagatgatgaaatataactttatcttttttgtttgaattttgtcgtgtaagtttgagtgacatcatcaagacctaccagggagctcggccacagggagtctactcaaggcatcaaactggcccaggagtagaaaggtgggggtggaaataggaaatagtgtttacccaggggactggcccagccaggaggagaaaggaatcagtgtttacccaggaaagcaagaatggatactgatgttggaggtaaagctgggaaagtaggagagcatcgggattgagtatgcagagtgagttagggttgagtggttcgggactaagacccactaagaccatgcctgcacctgacttcatgtagcagtggttgcatggggtatgcatgggcccttaaagggctgggcttctgcagcatttgaggccatagcctttggtacttgcacagggttggtacctgtcatccttgggactccagctactgataggataactcagtacctaaacttagaactttaatacctaagacacttgatggtgaaacagttctcttgcaactaaagaagaacctgaggtcaggtgtggtggctcacgcctgtaatcctagcactttgggaagtcgaggtagaaggatcacttgaggtcaggagttcgagaccagcctggccagcatggtgaaaccccatctctactaaaaatacaaaatattagacagacggggtggtacatgcctgtaatcccagctacttgggaggctgaggcaggagaatcgcttgaacccaggaggcagaggttgcagtgagccgagatcgtgccactgcactccagcttgggcaacaagagcgaaactccatatcaaaaaaaaaaacctgagaggacattgcaccaatggagatgcatcaagagaaacatgtttggttttttgtgagctctcaccaacttttttcccctgggtcctcacgtgcagtgtggtcttctctttctgattagcatgtcattttggaaagagcactggattgagtcatgaggcataatcaatttctagtttaccagtgtgatcttaagcaaagatctaactcattggcaaaatgggcgtgattccttcccattcagggctgtttatgataagtcactgagggaatgataaatattatgacactgcttctcagactgtaatgtacatgcacatcacataaggaccttattaaaatggagacttaaaaagctggacgctaaaggcaataatgacagattttactcaataactactgcagaaggagagagtcctcagtatagaactgagcttagctccaatctgtgcagaggtgatggaattttaaagaggggagggaggaggttcaaatagaactagggaagtgcaaaattacaaaaagctggtaaggagattggtcaatgtgattcggctatctgtgtctactaactctcaaatttatttatcaaagttaggatcctagcctcccacagagaccaggagtcggccttatcattcctgataattatatgacaaagggatggctcccagaaaaagtgagaaacacattcctgtgcagcagaagatacatatatcccccaaagggacagaaaggatttacaattgtaaattttataaagtatgtcctctaagaagagggagggactgggtgccatggctcatgcctataatcccagcactttgggtggccaaggtgggtgcatcacctgaggtcaggagttcaagagcagcctggccaacatggtgaaaccctgtctctactaaaaatacaaaagttagcctgttgtggtggcgcgcacctgtaatcccagctactcgggtggctgaggcaggagaatcgcttgaacccaggaggcggagggtgcagtgagccgggatcacgccactgcacttcagcctgggtgacagagtgtgactccatctcaagaaaaacgagggagattagaaacctatgatcaggcattggctgaaacaaatggtaaattcttttggcagccttgagcttccccaggcagggacccaaaggggcctgggttatccctgagacagggccttgagctgctagaaactatgctagtgtttgttcaagtctctccgtgtccggggtgagcaaaattgtttgtgctgaaaatcaatgatttgcagctctcaagattccagtgggcagtctgggtgggcctgagtttctgctttttttttttctttatgtacagggtcttgctctgtcacctaggctagagtgtaattagtggccccagtcatggctcactgcagctgcaaactggctgcaagctgttctggctcagcctaccangttactgggcttacaggtggatgccaccgtacccaacagattttatttttgtagggatgggggtctccctgtattgcccaggctggtctcaaactcctggcctcccaangtgtttagattncaggtgtaagccaccacacgtggccagcctctgcatttctaacaggttccaggtgatcttgatgttctgctggtccatgggtcacactttgagaagcatggttctaaaggactatacagattaaagtcattaatctctgtgggctttggacttgaagtttcagcagcctttgacaagcatttgcaggtttcctttttatttatttgataaactgagaatccacatgcaaagaaatgcaagaaaattcaaagaacgtaagaaaatgtccttgctgtaaagctggtggttctcaatctcggatacacagtagaatcacctggtgcgggggttgggggcggggtgcagtgtaaaaattattaaatcagaatctctggggtaggccccaagcaacttttttttttttttttttagatagaatcttgcttgtcacctaggctaggagtgcagtggtgcaatcatggctcactgccgccttaacttctgggctcaagtgatatcctcccgacctcagcctccctagtagctgggactacaggcgtggactaccacacccaacaaatttttaaattttttgtagaggcaagctcttatactatcttgcacaggctggtctcgaactcctgggctcaagcagtcatcctgcctcagccttccaaagctcagggattacagacatgagccacagcaccaggccaacaatatttcttaaagctcctggagtgattccaatatgcagccaaggttgaaaaccaccctttaaaaggctcggcatccagtgtggaagaccagcacactcacgtcaggagaccttacctggagccaggatgcccctgatcatctctgataactttaaaaggaaggcctcagaagcagccccagaagcaaaagtttctctctgaccttctcctgccctcttgtttctggcttttcattctcccccaaggctacccatagaaactagaatccctcttccccaaggcaggtcatcagaaaccagaaccggttttacccaaagccagccataaaacctaaaaatagtcctctcactccccattcccctttctgtgtaaaaactggttggaaagaaatgatctgacctaccgtgtttgactgtcgtaagatacccattccagagagggtcccaccccgtgcccagaaggaaggaatcctgcacagagaggccaagaagaatctagacagccttgctgggtttcccctctcagtctattactattagatcatacccttcttgtccaatcatatttctacacagtccataatctgttgaacctaaacataaaaatggacaattcccctgtatcttggggtcttcattctgagggctcacatacaattatgatcaaataaatttgtttgctttttctcctgttaa

SEQ ID NO: 456023 - DNA, 1748 bp, Homo sapiens
agcggacatggcggtggcgcggtagcgcgcgatgcagcacaggctagaggctgcgcaagcgcggggcccgcccctgggaccctccgggccgggcggtttggccccttagcgcccgggcgtcggggcggtaaaaggccggcagaagggaggcacttgagaaatgtctttcctccaggacccaagtttcttcaccatggggatgtggtccattggtgcaggagccctgggggctgctgccttggcattgctgcttgccaacacagacgtgtttctgtccaagccccagaaagcggccctggagtacctggaggatatagacctgaaaacactggagaaggaaccaaggactttcaaagcaaaggagctatgggaaaaaaatggagctgtgattatggccgtgcggaggccaggctgtttcctctgtcgagaggaagctgcggatctgtcctccctgaaaagcatgttggaccagctgggcgtccccctctatgcagtggtaaaggagcacatcaggactgaagtgaaggatttccagccttatttcaaaggagaaatcttcctggatgaaaagaaaaagttctatggtccacaaaggcggaagatgatgtttatgggatttatccgtctgggagtgtggtacaacttcttccgagcctggaacggaggcttctctggaaacctggaaggagaaggcttcatccttgggggagttttcgtggtgggatcaggaaagcagggcattcttcttgagcaccgagaaaaagaatttggagacaaagtaaacctactttctgttctggaagctgctaagatgatcaaaccacagactttggcctcagagaaaaaatgattgtgtgaaactgcccagctcagggataaccagggacattcacctgtgttcatgggatgtattgtttccactcgtgtccctaaggagtgagaaacccatttatactctactctcagtatggattattaatgtattttaatattctgtttaggcccactaaggcaaaatagccccaaaacaagactgacaaaaatctgaaaaactaatgaggattattaagctaaaacctgggaaataggaggcttaaaattgactgccaggctgggtgcagtggctcacacctgtaatcccagcactttgggaggccaaggtgagcaagtcacttgaggtcgggagttcgagaccagcctgagcaacatggcgaaaccccgtctctactaaaaatacaaaaatcacccgggtgtggtggcaggcacctgtagtcccagctacccgggaggctgaggcaggagaatcacttgaacctgggaggtggaggttgcggtgagctgagatcacaccactgtattccagcctgggtgactgagactctaactaaaaaaaaaaaaaaaaaaaaattgattgctgtgcctcattacaaatgcatatgatgtttgagtgctgttgtttgaaattatttttcttttcgggtcttcaaaaattcaagaaaagttgatgattgacttgaagattacaaaatttaaggttttttggcatgtgtgttttctattaataattggttatatgatgtcaaagtaatactttcataatagaattgacatgctctgggatagtttgacaaaggtaaattataaagtgaaatctcttgtttcattatcttccattctaacctcagagatctgtttctctagaaaaaatgtccatctctggctttaataaaattatgcatcagaaatca

SEQ ID NO: 456024 - DNA, 5992 bp, Homo sapiens
  misc_feature (4478)..(4478): n is a, c, g, or t
  misc_feature (4587)..(4587): n is a, c, g, or t
  misc_feature (4599)..(4599): n is a, c, g, or t
gtagctgggactacgggtgcgcgccaccacacccggctaatttttgtatttttagtagagacgaggttttgccatgttggtcaggctggtctcgaactcctgccctcaagtgatctgcccgccttggcttcccaaagtgttgggattacaggcatgagacaactggtcttgaactcctgggctcaagcgatcctcccaaagccctgagattacaggcgtgagccagcgcgccggacacaacctcctactttcatgaaagagtgggcacttccaacaggaggaaaatgtctttcctccaggacccaagtttcttcaccatggggatgtggtccattggtgcaggagccctgggggctgctgccttggcattgctgcttgccaacacagacgtgtttctgtccaagccccagaaagcggccctggagtacctggaggatatagacctgaaaacactggagaaggaaccaaggactttcaaagcaaaggagctatgggaaaaaaatggagctgtgattatggccgtgcggaggccaggctgtttcctctgtcgagaggaagctgcggatctgtcctccctgaaaagcatgttggaccagctgggcgtccccctctatgcagtggtaaaggagcacatcaggactgaagtgaaggatttccagccttatttcaaaggagaaatcttcctggatgaaaagaaaaagttctatggtccacaaaggcggaagatgatgtttatgggatttatccgtctgggagtgtggtacaacttcttccgagcctggaacggaggcttctctggaaacctggaaggagaaggcttcatccttgggggagttttcgtggtgggatcaggaaagcagggcattcttcttgagcaccgagaaaaagaatttggagacaaagtaaacctactttctgttctggaagctgctaagatgatcaaaccacagactttggcctcagagaaaaaatgattgtgtgaaactgcccagctcagggataaccagggacattcacctgtgttcatgggatgtattgtttccactcgtgtccctaaggagtgagaaacccatttatactctactctcagtatggattattaatgtattttaatattctgtttaggcccactaaggcaaaatagccccaaaacaagactgacaaaaatctgaaaaactaatgaggattattaagctaaaacctgggaaataggaggcttaaaattgactgccaggctgggtgcagtggctcacacctgtaatcccagcactttgggaggccaaggtgagcaagtcacttgaggtcgggagttcgagaccagcctgagcaacatggcgaaaccccgtctctactaaaaatacaaaaatcacccgggtgtggtggcaggcacctgtagtcccagctacccgggaggctgaggcaggagaatcacttgaacctgggaggtggaggttgcggtgagctgagatcacaccactgtattccagcctgggtgactgagactctaactaaaaaaaaaaaaaaaaaaaaattgattgctgtgcctcattacaaatgcatatgatgtttgagtgctgttgtttgaaattatttttcttttcgggtcttcaaaaattcaagaaaagttgatgattgacttgaagattacaaaatttaaggttttttggcatgtgtgttttctattaataattggttatatgatgtcaaagtaatactttcataatagaattgacatgctctgggatagtttgacaaaggtaaattataaagtgaaatctcttgtttcattatcttccattctaacctcagagatctgtttctctagaaaaaatgtccatctctggctttaataaaattatgcatcagaaatcacctgtatgtataagattttctgataaaactaataattatatttaccatataattggctgaaagtaaaaaaagtcagcattctccatggctgaggggtaaagtgcctcgggggattcctctggttctagctatctaagtggtttgaaaatgaccaggaaaaattcatcctgtcattcacgttagtaattttgctgtctttcctagaggaatgactttggtgtttaaaattggtagctgtttttctattggtcttttagcctaatttggcaaatcagaagaaaggacatagagatgatgaaatataactttatcttttttgtttgaattttgtcgtgtaagtttgagtgacatcatcaagacctaccagggagctcggccacagggagtctactcaaggcatcaaactggcccaggagtagaaaggtgggggtggaaataggaaatagtgtttacccaggggactggcccagccaggaggagaaaggaatcagtgtttacccaggaaagcaagaatggatactgatgttggaggtaaagctgggaaagtaggagagcatcgggattgagtatgcagagtgagttagggttgagtggttcgggactaagacccactaagaccatgcctgcacctgacttcatgtagcagtggttgcatggggtatgcatgggcccttaaagggctgggcttctgcagcatttgaggccatagcctttggtacttgcacagggttggtacctgtcatccttgggactccagctactgataggataactcagtacctaaacttagaactttaatacctaagacacttgatggtgaaacagttctcttgcaactaaagaagaacctgaggtcaggtgtggtggctcacgcctgtaatcctagcactttgggaagtcgaggtagaaggatcacttgaggtcaggagttcgagaccagcctggccagcatggtgaaaccccatctctactaaaaatacaaaatattagacagacggggtggtacatgcctgtaatcccagctacttgggaggctgaggcaggagaatcgcttgaacccaggaggcagaggttgcagtgagccgagatcgtgccactgcactccagcttgggcaacaagagcgaaactccatatcaaaaaaaaaaacctgagaggacattgcaccaatggagatgcatcaagagaaacatgtttggttttttgtgagctctcaccaacttttttcccctgggtcctcacgtgcagtgtggtcttctctttctgattagcatgtcattttggaaagagcactggattgagtcatgaggcataatcaatttctagtttaccagtgtgatcttaagcaaagatctaactcattggcaaaatgggcgtgattccttcccattcagggctgtttatgataagtcactgagggaatgataaatattatgacactgcttctcagactgtaatgtacatgcacatcacataaggaccttattaaaatggagacttaaaaagctggacgctaaaggcaataatgacagattttactcaataactactgcagaaggagagagtcctcagtatagaactgagcttagctccaatctgtgcagaggtgatggaattttaaagaggggagggaggaggttcaaatagaactagggaagtgcaaaattacaaaaagctggtaaggagattggtcaatgtgattcggctatctgtgtctactaactctcaaatttatttatcaaagttaggatcctagcctcccacagagaccaggagtcggccttatcattcctgataattatatgacaaagggatggctcccagaaaaagtgagaaacacattcctgtgcagcagaagatacatatatcccccaaagggacagaaaggatttacaattgtaaattttataaagtatgtcctctaagaagagggagggactgggtgccatggctcatgcctataatcccagcactttgggtggccaaggtgggtgcatcacctgaggtcaggagttcaagagcagcctggccaacatggtgaaaccctgtctctactaaaaatacaaaagttagcctgttgtggtggcgcgcacctgtaatcccagctactcgggtggctgaggcaggagaatcgcttgaacccaggaggcggagggtgcagtgagccgggatcacgccactgcacttcagcctgggtgacagagtgtgactccatctcaagaaaaacgagggagattagaaacctatgatcaggcattggctgaaacaaatggtaaattcttttggcagccttgagcttccccaggcagggacccaaaggggcctgggttatccctgagacagggccttgagctgctagaaactatgctagtgtttgttcaagtctctccgtgtccggggtgagcaaaattgtttgtgctgaaaatcaatgatttgcagctctcaagattccagtgggcagtctgggtgggcctgagtttctgctttttttttttctttatgtacagggtcttgctctgtcacctaggctagagtgtaattagtggccccagtcatggctcactgcagctgcaaactggctgcaagctgttctggctcagcctaccangttactgggcttacaggtggatgccaccgtacccaacagattttatttttgtagggatgggggtctccctgtattgcccaggctggtctcaaactcctggcctcccaangtgtttagattncaggtgtaagccaccacacgtggccagcctctgcatttctaacaggttccaggtgatcttgatgttctgctggtccatgggtcacactttgagaagcatggttctaaaggactatacagattaaagtcattaatctctgtgggctttggacttgaagtttcagcagcctttgacaagcatttgcaggtttcctttttatttatttgataaactgagaatccacatgcaaagaaatgcaagaaaattcaaagaacgtaagaaaatgtccttgctgtaaagctggtggttctcaatctcggatacacagtagaatcacctggtgcgggggttgggggcggggtgcagtgtaaaaattattaaatcagaatctctggggtaggccccaagcaacttttttttttttttttttagatagaatcttgcttgtcacctaggctaggagtgcagtggtgcaatcatggctcactgccgccttaacttctgggctcaagtgatatcctcccgacctcagcctccctagtagctgggactacaggcgtggactaccacacccaacaaatttttaaattttttgtagaggcaagctcttatactatcttgcacaggctggtctcgaactcctgggctcaagcagtcatcctgcctcagccttccaaagctcagggattacagacatgagccacagcaccaggccaacaatatttcttaaagctcctggagtgattccaatatgcagccaaggttgaaaaccaccctttaaaaggctcggcatccagtgtggaagaccagcacactcacgtcaggagaccttacctggagccaggatgcccctgatcatctctgataactttaaaaggaaggcctcagaagcagccccagaagcaaaagtttctctctgaccttctcctgccctcttgtttctggcttttcattctcccccaaggctacccatagaaactagaatccctcttccccaaggcaggtcatcagaaaccagaaccggttttacccaaagccagccataaaacctaaaaatagtcctctcactccccattcccctttctgtgtaaaaactggttggaaagaaatgatctgacctaccgtgtttgactgtcgtaagatacccattccagagagggtcccaccccgtgcccagaaggaaggaatcctgcacagagaggccaagaagaatctagacagccttgctgggtttcccctctcagtctattactattagatcatacccttcttgtccaatcatatttctacacagtccataatctgttgaacctaaacataaaaatggacaattcccctgtatcttggggtcttcattctgagggctcacatacaattatgatcaaataaatttgtttgctttttctcctgttaa

SEQ ID NO: 456025 - DNA, 1401 bp, Homo sapiens
  misc_feature (1348)..(1348): n is a, c, g, or t
  misc_feature (1356)..(1356): n is a, c, g, or t
agcggacatggcggtggcgcggtagcgcgcgatgcagcacaggctagaggctgcgcaagcgcggggcccgcccctgggaccctccgggccgggcggtttggccccttagcgcccgggcgtcggggcggtaaaaggccggcagaagggaggcacttgagaaatgtctttcctccaggacccaagtttcttcaccatggggatgtggtccattggtgcaggagccctgggggctgctgccttggcattgctgcttgccaacacagacgtgtttctgtccaagccccagaaagcggccctggagtacctggaggatatagacctgaaaacactggagaaggaaccaaggactttcaaagcaaaggagctatgggaaaaaaatggagctgtgattatggccgtgcggaggccaggctgtttcctctgtcgagaggaagctgcggatctgtcctccctgaaaagcatgttggaccagctgggcgtccccctctatgcagtggtaaaggagcacatcaggactgaagtgaaggatttccagccttatttcaaaggagaaatcttcctggatgaaaagaaaaagttctatggtccacaaaggcggaagatgatgtttatgggatttatccgtctgggagtgtggtacaacttcttccgagcctggaacggaggcttctctggaaacctggaaggagaaggcttcatccttgggggagttttcgtggtgggatcaggaaagcagggcattcttcttgagcaccgagaaaaagaatttggagacaaagtaaacctactttctgttctggaagctgctaagatgatcaaaccacagactttggcctcagagaaaaaatgattgtgtgaaactgcccagctcagggataaccagggacattcacctgtgttcatgggatgtattgtttccactcgtgtccctaaggagtgagaaacccatttatactctactctcagtatggattattaatgtattttaatattctgtttaggcccactaaggcaaaatagccccaaaacaagactgacaaaaatctgaaaaactaatgaggattattaagctaaaacctgggaaataggaggcttaaaattgactgccaggctgggtgcagtggctcacacctgtaatcccagcactttgggaggccaaggtgagcaagtcacttgaggtcgggagttcgagaccagcctgagcaacatggcgaaaccccgtctctactaaaaatacaaaaatcacccgggtgtggtggcaggcacctgtagtcccagctacccgggaggctgaggcaggagaatcacttgaacctgggaggtggaggttgcggtgagctgagatctngaggagantcaacttaacaaacgtggagggccaagcctgcgttctgagtttcc

SEQ ID NO: 456026 - DNA, 5670 bp, Homo sapiens
  misc_feature (4156)..(4156): n is a, c, g, or t
  misc_feature (4265)..(4265): n is a, c, g, or t
  misc_feature (4277)..(4277): n is a, c, g, or t
attccctgctctgaggaacagtgtgaaaaaaagtcttttaggagatttacaatatctgttcttttgctcatcttagaccacagactgactttgaaattatgttaagtgaaatatcaatgaaaataaagtttactataaataaccaaggactttcaaagcaaaggagctatgggaaaaaaatggagctgtgattatggccgtgcggaggccaggctgtttcctctgtcgagaggaagctgcggatctgtcctccctgaaaagcatgttggaccagctgggcgtccccctctatgcagtggtaaaggagcacatcaggactgaagtgaaggatttccagccttatttcaaaggagaaatcttcctggatgaaaagaaaaagttctatggtccacaaaggcggaagatgatgtttatgggatttatccgtctgggagtgtggtacaacttcttccgagcctggaacggaggcttctctggaaacctggaaggagaaggcttcatccttgggggagttttcgtggtgggatcaggaaagcagggcattcttcttgagcaccgagaaaaagaatttggagacaaagtaaacctactttctgttctggaagctgctaagatgatcaaaccacagactttggcctcagagaaaaaatgattgtgtgaaactgcccagctcagggataaccagggacattcacctgtgttcatgggatgtattgtttccactcgtgtccctaaggagtgagaaacccatttatactctactctcagtatggattattaatgtattttaatattctgtttaggcccactaaggcaaaatagccccaaaacaagactgacaaaaatctgaaaaactaatgaggattattaagctaaaacctgggaaataggaggcttaaaattgactgccaggctgggtgcagtggctcacacctgtaatcccagcactttgggaggccaaggtgagcaagtcacttgaggtcgggagttcgagaccagcctgagcaacatggcgaaaccccgtctctactaaaaatacaaaaatcacccgggtgtggtggcaggcacctgtagtcccagctacccgggaggctgaggcaggagaatcacttgaacctgggaggtggaggttgcggtgagctgagatcacaccactgtattccagcctgggtgactgagactctaactaaaaaaaaaaaaaaaaaaaaattgattgctgtgcctcattacaaatgcatatgatgtttgagtgctgttgtttgaaattatttttcttttcgggtcttcaaaaattcaagaaaagttgatgattgacttgaagattacaaaatttaaggttttttggcatgtgtgttttctattaataattggttatatgatgtcaaagtaatactttcataatagaattgacatgctctgggatagtttgacaaaggtaaattataaagtgaaatctcttgtttcattatcttccattctaacctcagagatctgtttctctagaaaaaatgtccatctctggctttaataaaattatgcatcagaaatcacctgtatgtataagattttctgataaaactaataattatatttaccatataattggctgaaagtaaaaaaagtcagcattctccatggctgaggggtaaagtgcctcgggggattcctctggttctagctatctaagtggtttgaaaatgaccaggaaaaattcatcctgtcattcacgttagtaattttgctgtctttcctagaggaatgactttggtgtttaaaattggtagctgtttttctattggtcttttagcctaatttggcaaatcagaagaaaggacatagagatgatgaaatataactttatcttttttgtttgaattttgtcgtgtaagtttgagtgacatcatcaagacctaccagggagctcggccacagggagtctactcaaggcatcaaactggcccaggagtagaaaggtgggggtggaaataggaaatagtgtttacccaggggactggcccagccaggaggagaaaggaatcagtgtttacccaggaaagcaagaatggatactgatgttggaggtaaagctgggaaagtaggagagcatcgggattgagtatgcagagtgagttagggttgagtggttcgggactaagacccactaagaccatgcctgcacctgacttcatgtagcagtggttgcatggggtatgcatgggcccttaaagggctgggcttctgcagcatttgaggccatagcctttggtacttgcacagggttggtacctgtcatccttgggactccagctactgataggataactcagtacctaaacttagaactttaatacctaagacacttgatggtgaaacagttctcttgcaactaaagaagaacctgaggtcaggtgtggtggctcacgcctgtaatcctagcactttgggaagtcgaggtagaaggatcacttgaggtcaggagttcgagaccagcctggccagcatggtgaaaccccatctctactaaaaatacaaaatattagacagacggggtggtacatgcctgtaatcccagctacttgggaggctgaggcaggagaatcgcttgaacccaggaggcagaggttgcagtgagccgagatcgtgccactgcactccagcttgggcaacaagagcgaaactccatatcaaaaaaaaaaacctgagaggacattgcaccaatggagatgcatcaagagaaacatgtttggttttttgtgagctctcaccaacttttttcccctgggtcctcacgtgcagtgtggtcttctctttctgattagcatgtcattttggaaagagcactggattgagtcatgaggcataatcaatttctagtttaccagtgtgatcttaagcaaagatctaactcattggcaaaatgggcgtgattccttcccattcagggctgtttatgataagtcactgagggaatgataaatattatgacactgcttctcagactgtaatgtacatgcacatcacataaggaccttattaaaatggagacttaaaaagctggacgctaaaggcaataatgacagattttactcaataactactgcagaaggagagagtcctcagtatagaactgagcttagctccaatctgtgcagaggtgatggaattttaaagaggggagggaggaggttcaaatagaactagggaagtgcaaaattacaaaaagctggtaaggagattggtcaatgtgattcggctatctgtgtctactaactctcaaatttatttatcaaagttaggatcctagcctcccacagagaccaggagtcggccttatcattcctgataattatatgacaaagggatggctcccagaaaaagtgagaaacacattcctgtgcagcagaagatacatatatcccccaaagggacagaaaggatttacaattgtaaattttataaagtatgtcctctaagaagagggagggactgggtgccatggctcatgcctataatcccagcactttgggtggccaaggtgggtgcatcacctgaggtcaggagttcaagagcagcctggccaacatggtgaaaccctgtctctactaaaaatacaaaagttagcctgttgtggtggcgcgcacctgtaatcccagctactcgggtggctgaggcaggagaatcgcttgaacccaggaggcggagggtgcagtgagccgggatcacgccactgcacttcagcctgggtgacagagtgtgactccatctcaagaaaaacgagggagattagaaacctatgatcaggcattggctgaaacaaatggtaaattcttttggcagccttgagcttccccaggcagggacccaaaggggcctgggttatccctgagacagggccttgagctgctagaaactatgctagtgtttgttcaagtctctccgtgtccggggtgagcaaaattgtttgtgctgaaaatcaatgatttgcagctctcaagattccagtgggcagtctgggtgggcctgagtttctgctttttttttttctttatgtacagggtcttgctctgtcacctaggctagagtgtaattagtggccccagtcatggctcactgcagctgcaaactggctgcaagctgttctggctcagcctaccangttactgggcttacaggtggatgccaccgtacccaacagattttatttttgtagggatgggggtctccctgtattgcccaggctggtctcaaactcctggcctcccaangtgtttagattncaggtgtaagccaccacacgtggccagcctctgcatttctaacaggttccaggtgatcttgatgttctgctggtccatgggtcacactttgagaagcatggttctaaaggactatacagattaaagtcattaatctctgtgggctttggacttgaagtttcagcagcctttgacaagcatttgcaggtttcctttttatttatttgataaactgagaatccacatgcaaagaaatgcaagaaaattcaaagaacgtaagaaaatgtccttgctgtaaagctggtggttctcaatctcggatacacagtagaatcacctggtgcgggggttgggggcggggtgcagtgtaaaaattattaaatcagaatctctggggtaggccccaagcaacttttttttttttttttttagatagaatcttgcttgtcacctaggctaggagtgcagtggtgcaatcatggctcactgccgccttaacttctgggctcaagtgatatcctcccgacctcagcctccctagtagctgggactacaggcgtggactaccacacccaacaaatttttaaattttttgtagaggcaagctcttatactatcttgcacaggctggtctcgaactcctgggctcaagcagtcatcctgcctcagccttccaaagctcagggattacagacatgagccacagcaccaggccaacaatatttcttaaagctcctggagtgattccaatatgcagccaaggttgaaaaccaccctttaaaaggctcggcatccagtgtggaagaccagcacactcacgtcaggagaccttacctggagccaggatgcccctgatcatctctgataactttaaaaggaaggcctcagaagcagccccagaagcaaaagtttctctctgaccttctcctgccctcttgtttctggcttttcattctcccccaaggctacccatagaaactagaatccctcttccccaaggcaggtcatcagaaaccagaaccggttttacccaaagccagccataaaacctaaaaatagtcctctcactccccattcccctttctgtgtaaaaactggttggaaagaaatgatctgacctaccgtgtttgactgtcgtaagatacccattccagagagggtcccaccccgtgcccagaaggaaggaatcctgcacagagaggccaagaagaatctagacagccttgctgggtttcccctctcagtctattactattagatcatacccttcttgtccaatcatatttctacacagtccataatctgttgaacctaaacataaaaatggacaattcccctgtatcttggggtcttcattctgagggctcacatacaattatgatcaaataaatttgtttgctttttctcctgttaa

SEQ ID NO: 456027 - DNA, 5556 bp, Homo sapiens
  misc_feature (4042)..(4042): n is a, c, g, or t
  misc_feature (4151)..(4151): n is a, c, g, or t
  misc_feature (4163)..(4163): n is a, c, g, or t
gcctctgctttccactggagaagacaaggagcctgggctgcagagggaacctgacaccctatgtggaggcccacagccagctgggacagatgtccctgaacccttgtgtcttctacaggaagctgcggatctgtcctccctgaaaagcatgttggaccagctgggcgtccccctctatgcagtggtaaaggagcacatcaggactgaagtgaaggatttccagccttatttcaaaggagaaatcttcctggatgaaaagaaaaagttctatggtccacaaaggcggaagatgatgtttatgggatttatccgtctgggagtgtggtacaacttcttccgagcctggaacggaggcttctctggaaacctggaaggagaaggcttcatccttgggggagttttcgtggtgggatcaggaaagcagggcattcttcttgagcaccgagaaaaagaatttggagacaaagtaaacctactttctgttctggaagctgctaagatgatcaaaccacagactttggcctcagagaaaaaatgattgtgtgaaactgcccagctcagggataaccagggacattcacctgtgttcatgggatgtattgtttccactcgtgtccctaaggagtgagaaacccatttatactctactctcagtatggattattaatgtattttaatattctgtttaggcccactaaggcaaaatagccccaaaacaagactgacaaaaatctgaaaaactaatgaggattattaagctaaaacctgggaaataggaggcttaaaattgactgccaggctgggtgcagtggctcacacctgtaatcccagcactttgggaggccaaggtgagcaagtcacttgaggtcgggagttcgagaccagcctgagcaacatggcgaaaccccgtctctactaaaaatacaaaaatcacccgggtgtggtggcaggcacctgtagtcccagctacccgggaggctgaggcaggagaatcacttgaacctgggaggtggaggttgcggtgagctgagatcacaccactgtattccagcctgggtgactgagactctaactaaaaaaaaaaaaaaaaaaaaattgattgctgtgcctcattacaaatgcatatgatgtttgagtgctgttgtttgaaattatttttcttttcgggtcttcaaaaattcaagaaaagttgatgattgacttgaagattacaaaatttaaggttttttggcatgtgtgttttctattaataattggttatatgatgtcaaagtaatactttcataatagaattgacatgctctgggatagtttgacaaaggtaaattataaagtgaaatctcttgtttcattatcttccattctaacctcagagatctgtttctctagaaaaaatgtccatctctggctttaataaaattatgcatcagaaatcacctgtatgtataagattttctgataaaactaataattatatttaccatataattggctgaaagtaaaaaaagtcagcattctccatggctgaggggtaaagtgcctcgggggattcctctggttctagctatctaagtggtttgaaaatgaccaggaaaaattcatcctgtcattcacgttagtaattttgctgtctttcctagaggaatgactttggtgtttaaaattggtagctgtttttctattggtcttttagcctaatttggcaaatcagaagaaaggacatagagatgatgaaatataactttatcttttttgtttgaattttgtcgtgtaagtttgagtgacatcatcaagacctaccagggagctcggccacagggagtctactcaaggcatcaaactggcccaggagtagaaaggtgggggtggaaataggaaatagtgtttacccaggggactggcccagccaggaggagaaaggaatcagtgtttacccaggaaagcaagaatggatactgatgttggaggtaaagctgggaaagtaggagagcatcgggattgagtatgcagagtgagttagggttgagtggttcgggactaagacccactaagaccatgcctgcacctgacttcatgtagcagtggttgcatggggtatgcatgggcccttaaagggctgggcttctgcagcatttgaggccatagcctttggtacttgcacagggttggtacctgtcatccttgggactccagctactgataggataactcagtacctaaacttagaactttaatacctaagacacttgatggtgaaacagttctcttgcaactaaagaagaacctgaggtcaggtgtggtggctcacgcctgtaatcctagcactttgggaagtcgaggtagaaggatcacttgaggtcaggagttcgagaccagcctggccagcatggtgaaaccccatctctactaaaaatacaaaatattagacagacggggtggtacatgcctgtaatcccagctacttgggaggctgaggcaggagaatcgcttgaacccaggaggcagaggttgcagtgagccgagatcgtgccactgcactccagcttgggcaacaagagcgaaactccatatcaaaaaaaaaaacctgagaggacattgcaccaatggagatgcatcaagagaaacatgtttggttttttgtgagctctcaccaacttttttcccctgggtcctcacgtgcagtgtggtcttctctttctgattagcatgtcattttggaaagagcactggattgagtcatgaggcataatcaatttctagtttaccagtgtgatcttaagcaaagatctaactcattggcaaaatgggcgtgattccttcccattcagggctgtttatgataagtcactgagggaatgataaatattatgacactgcttctcagactgtaatgtacatgcacatcacataaggaccttattaaaatggagacttaaaaagctggacgctaaaggcaataatgacagattttactcaataactactgcagaaggagagagtcctcagtatagaactgagcttagctccaatctgtgcagaggtgatggaattttaaagaggggagggaggaggttcaaatagaactagggaagtgcaaaattacaaaaagctggtaaggagattggtcaatgtgattcggctatctgtgtctactaactctcaaatttatttatcaaagttaggatcctagcctcccacagagaccaggagtcggccttatcattcctgataattatatgacaaagggatggctcccagaaaaagtgagaaacacattcctgtgcagcagaagatacatatatcccccaaagggacagaaaggatttacaattgtaaattttataaagtatgtcctctaagaagagggagggactgggtgccatggctcatgcctataatcccagcactttgggtggccaaggtgggtgcatcacctgaggtcaggagttcaagagcagcctggccaacatggtgaaaccctgtctctactaaaaatacaaaagttagcctgttgtggtggcgcgcacctgtaatcccagctactcgggtggctgaggcaggagaatcgcttgaacccaggaggcggagggtgcagtgagccgggatcacgccactgcacttcagcctgggtgacagagtgtgactccatctcaagaaaaacgagggagattagaaacctatgatcaggcattggctgaaacaaatggtaaattcttttggcagccttgagcttccccaggcagggacccaaaggggcctgggttatccctgagacagggccttgagctgctagaaactatgctagtgtttgttcaagtctctccgtgtccggggtgagcaaaattgtttgtgctgaaaatcaatgatttgcagctctcaagattccagtgggcagtctgggtgggcctgagtttctgctttttttttttctttatgtacagggtcttgctctgtcacctaggctagagtgtaattagtggccccagtcatggctcactgcagctgcaaactggctgcaagctgttctggctcagcctaccangttactgggcttacaggtggatgccaccgtacccaacagattttatttttgtagggatgggggtctccctgtattgcccaggctggtctcaaactcctggcctcccaangtgtttagattncaggtgtaagccaccacacgtggccagcctctgcatttctaacaggttccaggtgatcttgatgttctgctggtccatgggtcacactttgagaagcatggttctaaaggactatacagattaaagtcattaatctctgtgggctttggacttgaagtttcagcagcctttgacaagcatttgcaggtttcctttttatttatttgataaactgagaatccacatgcaaagaaatgcaagaaaattcaaagaacgtaagaaaatgtccttgctgtaaagctggtggttctcaatctcggatacacagtagaatcacctggtgcgggggttgggggcggggtgcagtgtaaaaattattaaatcagaatctctggggtaggccccaagcaacttttttttttttttttttagatagaatcttgcttgtcacctaggctaggagtgcagtggtgcaatcatggctcactgccgccttaacttctgggctcaagtgatatcctcccgacctcagcctccctagtagctgggactacaggcgtggactaccacacccaacaaatttttaaattttttgtagaggcaagctcttatactatcttgcacaggctggtctcgaactcctgggctcaagcagtcatcctgcctcagccttccaaagctcagggattacagacatgagccacagcaccaggccaacaatatttcttaaagctcctggagtgattccaatatgcagccaaggttgaaaaccaccctttaaaaggctcggcatccagtgtggaagaccagcacactcacgtcaggagaccttacctggagccaggatgcccctgatcatctctgataactttaaaaggaaggcctcagaagcagccccagaagcaaaagtttctctctgaccttctcctgccctcttgtttctggcttttcattctcccccaaggctacccatagaaactagaatccctcttccccaaggcaggtcatcagaaaccagaaccggttttacccaaagccagccataaaacctaaaaatagtcctctcactccccattcccctttctgtgtaaaaactggttggaaagaaatgatctgacctaccgtgtttgactgtcgtaagatacccattccagagagggtcccaccccgtgcccagaaggaaggaatcctgcacagagaggccaagaagaatctagacagccttgctgggtttcccctctcagtctattactattagatcatacccttcttgtccaatcatatttctacacagtccataatctgttgaacctaaacataaaaatggacaattcccctgtatcttggggtcttcattctgagggctcacatacaattatgatcaaataaatttgtttgctttttctcctgttaa

SEQ ID NO: 456028 - DNA, 1784 bp, Homo sapiens
ggagtgtgcaaagccaaagggcagactcggacataagaggaggcagcttccctgcctcagtttaccccctgcgtgcatccaggcacctccctccccggctgccctggggcccgggtccccagaggcccggggtccctacagtggctgggggagcggaaggcgaagccctgaggggtggcggaccgagtcctgccagcgccggctgggggcggggccgggaggccccgcgctgctaggtccccgcccgctggtttcctccggggtcagccaggctccttatcaggcgcggccaggcagcctggcccttatctgcactgggccagcatcctccggccgctgcgccgccaggggtgagagggaggaaaccgggccgccgggggcggggagaaggcgggccggcccgggagccgctcactttccctgggggggacctacgcggagacctcggctatcctggccttccgaggcccacgaggaggcgcggcccaacgccggggcctggagcattgaggccggaccctcgcgagacagcagagcctggcctgacgctggaaaccacaccctggcccagactgccagccctgacgggacagagccagggcactcaccaggctgcaagaacagtgctggggtgagtacccccacgtcggggtccatgtgcccgcctcaggcacaggcagaggtgggccccaccatgactgagaaggcagagatggtgtgtgccccgagcccgtcgcctgccgcacgccctaaggctgcctcgcctgggcccccgcaggtggaggaggtgggccaccgaggaggctcctcgccccccaggctgccacctggtgtaccagtgatcagcctgggccacagcaggcccccaggggtagccatgcccaccacagagctgggcactctgcggcccccgctgctgcaactctccaccctgggaactgccccgcccactttggccctgcactaccaccctcaccccttcctcaacagtgtctacattgggccagcaggaccttttagcatcttccctagcagccggttgaagcggagaccaagccactgtgagctggacctggctgaggggcaccagccccagaaggtggcccggcgcgtgttcaccaacagccgggagcgctggcggcagcagaacgttaacggcgccttcgccgagctgaggaagctgctgccgacgcacccgcccgaccggaagctgagcaagaacgaggtgctccgcctagccatgaagtacatcggcttcctggtgcggctgctgcgcgaccaagccgcagctctggccgcaggccccacccctcccgggcctcgcaaacggccggtgcaccgggtcccagacgacggcgcccgccggggatccggacgcagggccgaggcggcagcgcgctcgcagcccgcgcccccggccgaccccgacggcagccccggtggagcggcccggcccatcaagatggagcaaaccgctttgagcccagaggtgcggtgaccgcacgcggcagcacctctgagccggagggcaccagggactcggcccagggccgtcaaggaaagggcagtggacgtgctgcgcatgttcgggagcgaactcccccgaagaaggaccagtgaagacgtcaggggcaaggtctcgggggtccggaagggtgatcatcgacccccaagggacccgcagacccttaaaaaaatcacccacaaccctctggaagtggccttgcccggtccccttcccaggggcgaggtcggcaaagcaacatggcagagcagtcatagga

SEQ ID NO: 456029 - DNA, 498 bp, Homo sapiens
ttcaataaccgggtatttggattgttctcttgataatatttgagcgtgattctggcccggccagaatcacactcaaatctgcagaattatttgtaattagtaatacaaaatctggccaaaaggagacttgtaaatagcgtaaagtggtgtcttatgctaaacggtggaatgtataggcagagaagctctttgaagttgtcagatgagctgggctcacaagcctgattcaaacaggctgtcggtctcctctcaccccttaatactgtgcagcccaaactcctaggactcttgaacatctgagcagttttgtgctttgagccactttttgacaaaaatggctccatttttccacagcgtggttttcttaaaatagtttaatgttttatagtctcatagtagtagtgttgctttctaagctataacagtcgactttattcttctactctgaaaaatcttgacttgtttgagtgtgattctgccgggatcctcggaacaccc

SEQ ID NO: 456030 - DNA, 1418 bp, Homo sapiens
agcgagagccgccctgcgccggactggcttgcgggccgggccgccgcccccggagccgccctcgcgccgcctcgggccgccgccgagcagtcgggccgctgggcgccgccgcgggcgccgggagcgagctgggagggagccgcgcgcctttgtgcgcgcgccgagtggcgctgccgaagacagtccccacctggagagacatttgacccattaaggactcatattctacatttaccaaaggaaagcattcaatggggccgagcccagaacttacattagaaagattggaccaaattcaatggaaaccttcaattaagagccctcaggaaaacttgattcacatcgctgtaaaaaaaccctccccgtgaaaccattcaaagatccttcaacagaggaaacttcgttattgaaatcaaaaaaaaagggggggtctttgcgtccttcaagaagcgaagaccacgaaatttgcaccgagagggttggaatgggcaaacacaaacgaaaaaccgaagacccaaggtaaataaaaagcaaggacaggaagcaaagaagcacacggaaggaacgaaggtctgaccttgggacaatagagcttattaaagacgggcgaagcagaagtttgggcagcagcttgaacttggagagaagcaaggacactagccaaaggaaggagcaaagaaaatagcccccgagatagtagaaaggtgaacacaggacaactctcaggagagaacacaggccaagaaacttcagaccaagcacccagaggaggtcctagggcatgaaggtattgaagcaaaggaaccttcgtagttggtcaccccaacagaggctggtctgtgggtagcctttcttcaatcgtcaagggcaaaaagcacccctgggagaatatttcccaaacccagggaagagagattatagaacttcgcaagaaaggacattaagggcgaaaggagcaaacacaaaacaaacacaaagaaaaggaaaagaccgaatgccacgtggtgaacacgagtggcagggaaccagaaaaaacgccgagacattgaaagagagcaagagcgccccgacaaggcaacagtatggaaaataaaaggaacaccgaagaagacagaaacaatagcaacaggacaccacagcacgagaaagaaaaagagaagagcaacagaaacaagacacaacagagagcaaagacaaacaaagaacagaagaaatagtgcgaaaacagacaaaaacagacccaagaacatggaacccaagacaaaagaatacaacaggaaaaacaagagatcaaccgcaagggaacgagaaaaaaaaaaaacagcaaagaagaaaagaaacagagaaagaaagagacagaaaaagaaagtagaaaaagaacacgaagaaacaaagaaaagataccaacagccacagag

SEQ ID NO: 456031 - DNA, 3781 bp, Homo sapiens
  misc_feature (11)..(11): n is a, c, g, or t
  misc_feature (17)..(18): n is a, c, g, or t
tcgagctcggncctctnntcatgctcagggcagacagccgtcttctcattgtgtcctcacatggcattgaggctggagagtacagggagagagattgagaaagaaggagctctggtctcttttcctcttcttataaggacactgatcccatcatgtgggctgcagcctcatgacctcatctaaacctaattacctttcaaaggtcccacctccaaatactgtcactttgggggttagggcttcaacataggaattttggggggactcagcattcagtcggtgtgtgtgcgtgtgtgtgtgcgtgtgtgtgcgtgtgcatgtgtacttgtagaggagggttgattgtccacctgacagccgttgccatcccctcttccctgctggatgccaatttgcatttttctggcacgttttgcggctagagtggtcatgtgacactgttctggccaatgaggcgatggaggaaggcccccgggggcttctgggagtgcctgccttcgcagctggagagagccctcctcaggggctgtctctgccttcccttcttcccatgtgtatctggggcagctgaggcagggctaggagaagagcccgggttcctcctgccacctccaagcgatgaagcagccctgggccaactccagcattctcgtgtgaactgcagaggagccctgcgcttccagctacttgcagccagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatattccagccagcagagaattttgacttgcagtaggatttggtttgattttcctacgatctgggtggatgccttgcctgtgacagttgcagttcctattcgccaaatgaagggcagtgccccgcacgtaagttggaatgatggacctgtgttcagagacttaacagaaccaacaagcaaaacaagtgagaacaggaaaaaggaagaggacactggaatcaattcttgagagttgcactacttggtttttcttccattccaagtttcgtgggacccagagccttttttcttttaaaagctaaaaaacaagtgtttaattcctctttttgttatctgttagataattgagatcacctagaaatgcgtttaatctgttcactcactgtaaattttgaggacccagaattgtcttgtttaatttatactttcacccctgttgcagttaacaccagagaaggaacgtgaatgtcgagcacagccactacccttgttggcacttaatttagaaatagggtgagaagtttaaaagcccatcttgattttattttcattccttttggttctctgtgtaataatagcaggctacatagtgacattccagttccaagaaggtacatcctgtccattcattaattgctttgattactaggagggtttctgttcagttttgtttttaaatgtcttgctgatctagttctttcagatggaataaccttccagtcccttagagagtggaactagtccatataacccagcttcagtagcaaaagtagaagccgccacatcttttcatttctccaagaggagagtggggaaggttcccatgaccagctgggcagtcaggatttctctaggcattctaatgtgaaataagtgtagactgctgtcaaggaggcttcatcagaagatgtatagcatttgaatgtctaatgataatgcatatcattagaatccaagctttgaaaatttctgattaatgctcatgtatttctttatctttgtttttccttgtgaagaaagactttcaccactgtctgagtgatgatgctgttgataaggatgatgtcgatgactactatattgcatctctcaggaacagctgatgggaagggaggggctgctgagttcccttgttctagctagcagcacgctcctcagagagggggccgagttacagacagcagccgcattctcatgcaaaattagttttaaactgctagtgtgggcatcggtaccttttgcctgggtgataccgaagaattgttgaggatttagtatgctccgtagagacagttcagccagtcatttctgcattggagagacttctcatactttctttgaagactcatagaaagctggatctagagcttttgaatccttaattagcacagtagaaattagctttctatgggaatgctttagtgttagcagttgacaattaggcccatattcaatctgaatgggaacaaaagtaaatgcaatgataatatactgctagttagagaaacatgttagttgattatacctgaaatggattatttatctcatcagcaagtattatttgaataaaatgagaaatgcttaagaaaaattgttgctctatagtaatttggtttcgaagaatggaatggtaactattttttcccatcgttcttttgagagaaggaagtgtgatgactgatgatcttgaaaagcccatttctgattgcacgttgactggaattctttctttgtgtctgtggactagcgatgctgtttgtaaaatgaagattcgggactggctcatatctttttatctaactagatgtcagatcttgaaatctgtattctcgaagcaattctgccacttgatcgtattcacaggggccctggtaggctcctttagaaggaccatttctgttcctagagcttaactagaattcattcttcactgaaaaaaaaaaaagttacttaagaaagcatttctttcctaatctcactcaaatctgcagaattatttgtaattagtaatacaaaatctggccaaaaggagacttgtaaatagcgtaaagtggtgtcttatgctaaacggtggaatgtataggcagagaagctctttgaagttgtcagatgagctgggctcacaagcctgattcaaacaggctgtcggtctcctctcaccccttaatactgtgcagcccaaactcctaggactcttgaacatctgagcagttttgtgctttgagccactttttgacaaaaatggctccatttttccacagcgtggttttcttaaaatagtttaatgttttatagtctcatagtagtagtgttgctttctaagctataacagtcgactttattcttctactctgaaaaatcttgacttgtttgagtgtatataatatatataaagggagccttaatggattggttttcataatttaatattttttgtatttgctcttgtataattgtttttaacggaaagtattaaagaattgagggtggaattcttagaaccaaagttattcttaataaaaatcaccacatgcttggaccatgca

SEQ ID NO: 456032 - DNA, 3249 bp, Homo sapiens
agcgagagccgccctgcgccggactggcttgcgggccgggccgccgcccccggagccgccctcgcgccgcctcgggccgccgccgagcagtcgggccgctgggcgccgccgcgggcgccgggagcgagctgggagggagccgcgcgcctttgtgcgcgcgccgagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatattccagccagcagagaattttgacttgcagtaggatttggtttgattttcctacgatctgggtggatgccttgcctgtgacagttgcagttcctattcgccaaatgaagggcagtgccccgcacgtaagttggaatgatggacctgtgttcagagacttaacagaaccaacaagcaaaacaagtgagaacaggaaaaaggaagaggacactggaatcaattcttgagagttgcactacttggtttttcttccattccaagtttcgtgggacccagagccttttttcttttaaaagctaaaaaacaagtgtttaattcctctttttgttatctgttagataattgagatcacctagaaatgcgtttaatctgttcactcactgtaaattttgaggacccagaattgtcttgtttaatttatactttcacccctgttgcagttaacaccagagaaggaacgtgaatgtcgagcacagccactacccttgttggcacttaatttagaaatagggtgagaagtttaaaagcccatcttgattttattttcattccttttggttctctgtgtaataatagcaggctacatagtgacattccagttccaagaaggtacatcctgtccattcattaattgctttgattactaggagggtttctgttcagttttgtttttaaatgtcttgctgatctagttctttcagatggaataaccttccagtcccttagagagtggaactagtccatataacccagcttcagtagcaaaagtagaagccgccacatcttttcatttctccaagaggagagtggggaaggttcccatgaccagctgggcagtcaggatttctctaggcattctaatgtgaaataagtgtagactgctgtcaaggaggcttcatcagaagatgtatagcatttgaatgtctaatgataatgcatatcattagaatccaagctttgaaaatttctgattaatgctcatgtatttctttatctttgtttttccttgtgaagaaagactttcaccactgtctgagtgatgatgctgttgataaggatgatgtcgatgactactatattgcatctctcaggaacagctgatgggaagggaggggctgctgagttcccttgttctagctagcagcacgctcctcagagagggggccgagttacagacagcagccgcattctcatgcaaaattagttttaaactgctagtgtgggcatcggtaccttttgcctgggtgataccgaagaattgttgaggatttagtatgctccgtagagacagttcagccagtcatttctgcattggagagacttctcatactttctttgaagactcatagaaagctggatctagagcttttgaatccttaattagcacagtagaaattagctttctatgggaatgctttagtgttagcagttgacaattaggcccatattcaatctgaatgggaacaaaagtaaatgcaatgataatatactgctagttagagaaacatgttagttgattatacctgaaatggattatttatctcatcagcaagtattatttgaataaaatgagaaatgcttaagaaaaattgttgctctatagtaatttggtttcgaagaatggaatggtaactattttttcccatcgttcttttgagagaaggaagtgtgatgactgatgatcttgaaaagcccatttctgattgcacgttgactggaattctttctttgtgtctgtggactagcgatgctgtttgtaaaatgaagattcgggactggctcatatctttttatctaactagatgtcagatcttgaaatctgtattctcgaagcaattctgccacttgatcgtattcacaggggccctggtaggctcctttagaaggaccatttctgttcctagagcttaactagaattcattcttcactgaaaaaaaaaaaagttacttaagaaagcatttctttcctaatctcactcaaatctgcagaattatttgtaattagtaatacaaaatctggccaaaaggagacttgtaaatagcgtaaagtggtgtcttatgctaaacggtggaatgtataggcagagaagctctttgaagttgtcagatgagctgggctcacaagcctgattcaaacaggctgtcggtctcctctcaccccttaatactgtgcagcccaaactcctaggactcttgaacatctgagcagttttgtgctttgagccactttttgacaaaaatggctccatttttccacagcgtggttttcttaaaatagtttaatgttttatagtctcatagtagtagtgttgctttctaagctataacagtcgactttattcttctactctgaaaaatcttgacttgtttgagtgtatataatatatataaagggagccttaatggattggttttcataatttaatattttttgtatttgctcttgtataattgtttttaacggaaagtattaaagaattgagggtggaattcttagaaccaaagttattcttaataaaaatcaccacatgcttggaccatgca

SEQ ID NO: 456033 - DNA, 3368 bp, Homo sapiens
actgcgatctttttatttgctaccttgggcttaaggagcctgcctatatctactgaggtgaggttaggtcagtctctgtaaccgttcgtcacttaggccttgatgggtgacatggatggggatgacttcctgggctaactcttctcttgctaaaggatgatttttcaccaccttgaatgcccatgattaaaacataaacaagaaaatagatatctgaggagaatgcagttgaaactaattttgtggatagagaaactgttggaactgctttacaaagtattttaacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatattccagccagcagagaattttgacttgcagtaggatttggtttgattttcctacgatctgggtggatgccttgcctgtgacagttgcagttcctattcgccaaatgaagggcagtgccccgcacgtaagttggaatgatggacctgtgttcagagacttaacagaaccaacaagcaaaacaagtgagaacaggaaaaaggaagaggacactggaatcaattcttgagagttgcactacttggtttttcttccattccaagtttcgtgggacccagagccttttttcttttaaaagctaaaaaacaagtgtttaattcctctttttgttatctgttagataattgagatcacctagaaatgcgtttaatctgttcactcactgtaaattttgaggacccagaattgtcttgtttaatttatactttcacccctgttgcagttaacaccagagaaggaacgtgaatgtcgagcacagccactacccttgttggcacttaatttagaaatagggtgagaagtttaaaagcccatcttgattttattttcattccttttggttctctgtgtaataatagcaggctacatagtgacattccagttccaagaaggtacatcctgtccattcattaattgctttgattactaggagggtttctgttcagttttgtttttaaatgtcttgctgatctagttctttcagatggaataaccttccagtcccttagagagtggaactagtccatataacccagcttcagtagcaaaagtagaagccgccacatcttttcatttctccaagaggagagtggggaaggttcccatgaccagctgggcagtcaggatttctctaggcattctaatgtgaaataagtgtagactgctgtcaaggaggcttcatcagaagatgtatagcatttgaatgtctaatgataatgcatatcattagaatccaagctttgaaaatttctgattaatgctcatgtatttctttatctttgtttttccttgtgaagaaagactttcaccactgtctgagtgatgatgctgttgataaggatgatgtcgatgactactatattgcatctctcaggaacagctgatgggaagggaggggctgctgagttcccttgttctagctagcagcacgctcctcagagagggggccgagttacagacagcagccgcattctcatgcaaaattagttttaaactgctagtgtgggcatcggtaccttttgcctgggtgataccgaagaattgttgaggatttagtatgctccgtagagacagttcagccagtcatttctgcattggagagacttctcatactttctttgaagactcatagaaagctggatctagagcttttgaatccttaattagcacagtagaaattagctttctatgggaatgctttagtgttagcagttgacaattaggcccatattcaatctgaatgggaacaaaagtaaatgcaatgataatatactgctagttagagaaacatgttagttgattatacctgaaatggattatttatctcatcagcaagtattatttgaataaaatgagaaatgcttaagaaaaattgttgctctatagtaatttggtttcgaagaatggaatggtaactattttttcccatcgttcttttgagagaaggaagtgtgatgactgatgatcttgaaaagcccatttctgattgcacgttgactggaattctttctttgtgtctgtggactagcgatgctgtttgtaaaatgaagattcgggactggctcatatctttttatctaactagatgtcagatcttgaaatctgtattctcgaagcaattctgccacttgatcgtattcacaggggccctggtaggctcctttagaaggaccatttctgttcctagagcttaactagaattcattcttcactgaaaaaaaaaaaagttacttaagaaagcatttctttcctaatctcactcaaatctgcagaattatttgtaattagtaatacaaaatctggccaaaaggagacttgtaaatagcgtaaagtggtgtcttatgctaaacggtggaatgtataggcagagaagctctttgaagttgtcagatgagctgggctcacaagcctgattcaaacaggctgtcggtctcctctcaccccttaatactgtgcagcccaaactcctaggactcttgaacatctgagcagttttgtgctttgagccactttttgacaaaaatggctccatttttccacagcgtggttttcttaaaatagtttaatgttttatagtctcatagtagtagtgttgctttctaagctataacagtcgactttattcttctactctgaaaaatcttgacttgtttgagtgtatataatatatataaagggagccttaatggattggttttcataatttaatattttttgtatttgctcttgtataattgtttttaacggaaagtattaaagaattgagggtggaattcttagaaccaaagttattcttaataaaaatcaccacatgcttggaccatgca

SEQ ID NO: 456034 - DNA, 2957 bp, Homo sapiens
ccggtcccctcaggattactcgagatcttcacagaggaacttcttgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatattccagccagcagagaattttgacttgcagtaggatttggtttgattttcctacgatctgggtggatgccttgcctgtgacagttgcagttcctattcgccaaatgaagggcagtgccccgcacgtaagttggaatgatggacctgtgttcagagacttaacagaaccaacaagcaaaacaagtgagaacaggaaaaaggaagaggacactggaatcaattcttgagagttgcactacttggtttttcttccattccaagtttcgtgggacccagagccttttttcttttaaaagctaaaaaacaagtgtttaattcctctttttgttatctgttagataattgagatcacctagaaatgcgtttaatctgttcactcactgtaaattttgaggacccagaattgtcttgtttaatttatactttcacccctgttgcagttaacaccagagaaggaacgtgaatgtcgagcacagccactacccttgttggcacttaatttagaaatagggtgagaagtttaaaagcccatcttgattttattttcattccttttggttctctgtgtaataatagcaggctacatagtgacattccagttccaagaaggtacatcctgtccattcattaattgctttgattactaggagggtttctgttcagttttgtttttaaatgtcttgctgatctagttctttcagatggaataaccttccagtcccttagagagtggaactagtccatataacccagcttcagtagcaaaagtagaagccgccacatcttttcatttctccaagaggagagtggggaaggttcccatgaccagctgggcagtcaggatttctctaggcattctaatgtgaaataagtgtagactgctgtcaaggaggcttcatcagaagatgtatagcatttgaatgtctaatgataatgcatatcattagaatccaagctttgaaaatttctgattaatgctcatgtatttctttatctttgtttttccttgtgaagaaagactttcaccactgtctgagtgatgatgctgttgataaggatgatgtcgatgactactatattgcatctctcaggaacagctgatgggaagggaggggctgctgagttcccttgttctagctagcagcacgctcctcagagagggggccgagttacagacagcagccgcattctcatgcaaaattagttttaaactgctagtgtgggcatcggtaccttttgcctgggtgataccgaagaattgttgaggatttagtatgctccgtagagacagttcagccagtcatttctgcattggagagacttctcatactttctttgaagactcatagaaagctggatctagagcttttgaatccttaattagcacagtagaaattagctttctatgggaatgctttagtgttagcagttgacaattaggcccatattcaatctgaatgggaacaaaagtaaatgcaatgataatatactgctagttagagaaacatgttagttgattatacctgaaatggattatttatctcatcagcaagtattatttgaataaaatgagaaatgcttaagaaaaattgttgctctatagtaatttggtttcgaagaatggaatggtaactattttttcccatcgttcttttgagagaaggaagtgtgatgactgatgatcttgaaaagcccatttctgattgcacgttgactggaattctttctttgtgtctgtggactagcgatgctgtttgtaaaatgaagattcgggactggctcatatctttttatctaactagatgtcagatcttgaaatctgtattctcgaagcaattctgccacttgatcgtattcacaggggccctggtaggctcctttagaaggaccatttctgttcctagagcttaactagaattcattcttcactgaaaaaaaaaaaagttacttaagaaagcatttctttcctaatctcactcaaatctgcagaattatttgtaattagtaatacaaaatctggccaaaaggagacttgtaaatagcgtaaagtggtgtcttatgctaaacggtggaatgtataggcagagaagctctttgaagttgtcagatgagctgggctcacaagcctgattcaaacaggctgtcggtctcctctcaccccttaatactgtgcagcccaaactcctaggactcttgaacatctgagcagttttgtgctttgagccactttttgacaaaaatggctccatttttccacagcgtggttttcttaaaatagtttaatgttttatagtctcatagtagtagtgttgctttctaagctataacagtcgactttattcttctactctgaaaaatcttgacttgtttgagtgtatataatatatataaagggagccttaatggattggttttcataatttaatattttttgtatttgctcttgtataattgtttttaacggaaagtattaaagaattgagggtggaattcttagaaccaaagttattcttaataaaaatcaccacatgcttggaccatgca

SEQ ID NO: 456035 - DNA, 997 bp, Homo sapiens
  misc_feature (19)..(19): n is a, c, g, or t
atatcagctcgcaccacantatgtaatactatgcaagaaaaattgttgctctatagtaatttggtttcgaagaatggaatggtaactattttttcccatcgttcttttgagagaaggaagtgtgatgactgatgatcttgaaaagcccatttctgattgcacgttgactggaattctttctttgtgtctgtggactagcgatgctgtttgtaaaatgaagattcgggactggctcatatctttttatctaactagatgtcagatcttgaaatctgtattctcgaagcaattctgccacttgatcgtattcacaggggccctggtaggctcctttagaaggaccatttctgttcctagagcttaactagaattcattcttcactgaaaaaaaaaaaagttacttaagaaagcatttctttcctaatctcactcaaatctgcagaattatttgtaattagtaatacaaaatctggccaaaaggagacttgtaaatagcgtaaagtggtgtcttatgctaaacggtggaatgtataggcagagaagctctttgaagttgtcagatgagctgggctcacaagcctgattcaaacaggctgtcggtctcctctcaccccttaatactgtgcagcccaaactcctaggactcttgaacatctgagcagttttgtgctttgagccactttttgacaaaaatggctccatttttccacagcgtggttttcttaaaatagtttaatgttttatagtctcatagtagtagtgttgctttctaagctataacagtcgactttattcttctactctgaaaaatcttgacttgtttgagtgtatataatatatataaagggagccttaatggattggttttcataatttaatattttttgtatttgctcttgtataattgtttttaacggaaagtattaaagaattgagggtggaattcttagaaccaaagttattcttaataaaaatcaccacatgcttggaccatgca

SEQ ID NO: 456036 - DNA, 2289 bp, Homo sapiens
agcgagagccgccctgcgccggactggcttgcgggccgggccgccgcccccggagccgccctcgcgccgcctcgggccgccgccgagcagtcgggccgctgggcgccgccgcgggcgccgggagcgagctgggagggagccgcgcgcctttgtgcgcgcgccgagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatattccagccagcagagaattttgacttgcagtaggatttggtttgattttcctacgatctgggtggatgccttgcctgtgacagttgcagttcctattcgccaaatgaagggcagtgccccgcacgtaagttggaatgatggacctgtgttcagagacttaacagaaccaacaagcaaaacaagtgagaacaggaaaaaggaagaggacactggaatcaattcttgagagttgcactacttggtttttcttccattccaagtttcgtgggacccagagccttttttcttttaaaagctaaaaaacaagtgtttaattcctctttttgttatctgttagataattgagatcacctagaaatgcgtttaatctgttcactcactgtaaattttgaggacccagaattgtcttgtttaatttatactttcacccctgttgcagttaacaccagagaaggaacgtgaatgtcgagcacagccactacccttgttggcacttaatttagaaatagggtgagaagtttaaaagcccatcttgattttattttcattccttttggttctctgtgtaataatagcaggctacatagtgacattccagttccaagaaggtacatcctgtccattcattaattgctttgattactaggagggtttctgttcagttttgtttttaaatgtcttgctgatctagttctttcagatggaataaccttccagtcccttagagagtggaactagtccatataacccagcttcagtagcaaaagtagaagccgccacatcttttcatttctccaagaggagagtggggaaggttcccatgaccagctgggcagtcaggatttctctaggcattctaatgtgaaataagtgtagactgctgtcaaggaggcttcatcagaagatgtatagcatttgaatgtctaatgataatgcatatcattagaatccaagctttgaaaatttctgattaatgctcatgtatttctttatctttgtttttccttgtgaagaaagactttcaccactgtctgagtgatgatgctgttgataaggatgatgtcgatgactactatattgcatctctcaggaacagctgatgggaagggaggggctgctgagttcccttgttctagctagcagcacgctcctcagagagggggccgagttacagacagcagccgcattctcatgcaaaattagttttaaactgctagtgtgggcatcggtaccttttgcctgggtgataccgaagaattgttgaggatttagtatgctccgtagagacagttcagccagtcatttctgcattggagagacttctcatactttctttgaagactcatagaaagctggatctagagcttttgaatccttaattagcacagtagaaattagctttctatgggaatgctttagtgttagcagttgacaattaggcccatattcaatctgaatgggaacaaaagtaaatgcaatgataatatactgctagttagagaaacatgttagttgattatacctgaaatggattatttatctcatcagcaagtattatttgaataaaatgagaaatgcttaag

SEQ ID NO: 456037 - DNA, 350 bp, Homo sapiens
cctagttttagaagtgtccatagcacgaaaaggagaatcctatagataatcagtccgtacatgagccaccggttcaaattcagatctgtctgattcctaagctaaatttattctgctattgaaacttctataacagtcgactttattcttctactctgaaaaatcttgacttgtttgagtgtatataatatatataaagggagccttaatggattggttttcataatttaatattttttgtatttgctcttgtataattgtttttaacggaaagtattaaagaattgagggtggaattcttagaaccaaagttattcttaataaaaatcaccacatgcttggaccatgca

SEQ ID NO: 456038 - DNA, 942 bp, Homo sapiens
agcgagagccgccctgcgccggactggcttgcgggccgggccgccgcccccggagccgccctcgcgccgcctcgggccgccgccgagcagtcgggccgctgggcgccgccgcgggcgccgggagcgagctgggagggagccgcgcgcctttgtgcgcgcgccgagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaagaaccgggttacccctccgtgaggcagatcccctgcaggtggccatcactgtggtggccagcagtgcttccagactcctgcagtcacgggttcccttctgaaatggatgtgtatttccaaattcggatggaagaggctggattaaagatagaagagaatgtcctaagtagaagagaaatatgttcttaaatttaaaatctctgaattttctccttacactggggaaggtgtaggaatcatgtaattgccgcctactccggcatttgtcagtagtggggagaagtctctagaaccatattagacttaatagataggacactcatgtttagtagtttgggggtagcattttaaaagattattatcatagtctttattattaattatttcggaggacaggaaagcatttaccttctatctactttgcaaactccatctgtgccataaatcattatggatgttgggttgctatactctgctttttaaataatttggggcaggacaggagactaggagaactgaggatgaaaggctatttttttcaatttaagaactaggaagcttcatttaggattattttcagatctcgtaggacta

SEQ ID NO: 456039 - DNA, 3315 bp, Homo sapiens
agcgagagccgccctgcgccggactggcttgcgggccgggccgccgcccccggagccgccctcgcgccgcctcgggccgccgccgagcagtcgggccgctgggcgccgccgcgggcgccgggagcgagctgggagggagccgcgcgcctttgtgcgcgcgccgaggagaatgcagttgaaactaattttgtggatagagaaactgttggaactgctttacaaagtattttaacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatattccagccagcagagaattttgacttgcagtaggatttggtttgattttcctacgatctgggtggatgccttgcctgtgacagttgcagttcctattcgccaaatgaagggcagtgccccgcacgtaagttggaatgatggacctgtgttcagagacttaacagaaccaacaagcaaaacaagtgagaacaggaaaaaggaagaggacactggaatcaattcttgagagttgcactacttggtttttcttccattccaagtttcgtgggacccagagccttttttcttttaaaagctaaaaaacaagtgtttaattcctctttttgttatctgttagataattgagatcacctagaaatgcgtttaatctgttcactcactgtaaattttgaggacccagaattgtcttgtttaatttatactttcacccctgttgcagttaacaccagagaaggaacgtgaatgtcgagcacagccactacccttgttggcacttaatttagaaatagggtgagaagtttaaaagcccatcttgattttattttcattccttttggttctctgtgtaataatagcaggctacatagtgacattccagttccaagaaggtacatcctgtccattcattaattgctttgattactaggagggtttctgttcagttttgtttttaaatgtcttgctgatctagttctttcagatggaataaccttccagtcccttagagagtggaactagtccatataacccagcttcagtagcaaaagtagaagccgccacatcttttcatttctccaagaggagagtggggaaggttcccatgaccagctgggcagtcaggatttctctaggcattctaatgtgaaataagtgtagactgctgtcaaggaggcttcatcagaagatgtatagcatttgaatgtctaatgataatgcatatcattagaatccaagctttgaaaatttctgattaatgctcatgtatttctttatctttgtttttccttgtgaagaaagactttcaccactgtctgagtgatgatgctgttgataaggatgatgtcgatgactactatattgcatctctcaggaacagctgatgggaagggaggggctgctgagttcccttgttctagctagcagcacgctcctcagagagggggccgagttacagacagcagccgcattctcatgcaaaattagttttaaactgctagtgtgggcatcggtaccttttgcctgggtgataccgaagaattgttgaggatttagtatgctccgtagagacagttcagccagtcatttctgcattggagagacttctcatactttctttgaagactcatagaaagctggatctagagcttttgaatccttaattagcacagtagaaattagctttctatgggaatgctttagtgttagcagttgacaattaggcccatattcaatctgaatgggaacaaaagtaaatgcaatgataatatactgctagttagagaaacatgttagttgattatacctgaaatggattatttatctcatcagcaagtattatttgaataaaatgagaaatgcttaagaaaaattgttgctctatagtaatttggtttcgaagaatggaatggtaactattttttcccatcgttcttttgagagaaggaagtgtgatgactgatgatcttgaaaagcccatttctgattgcacgttgactggaattctttctttgtgtctgtggactagcgatgctgtttgtaaaatgaagattcgggactggctcatatctttttatctaactagatgtcagatcttgaaatctgtattctcgaagcaattctgccacttgatcgtattcacaggggccctggtaggctcctttagaaggaccatttctgttcctagagcttaactagaattcattcttcactgaaaaaaaaaaaagttacttaagaaagcatttctttcctaatctcactcaaatctgcagaattatttgtaattagtaatacaaaatctggccaaaaggagacttgtaaatagcgtaaagtggtgtcttatgctaaacggtggaatgtataggcagagaagctctttgaagttgtcagatgagctgggctcacaagcctgattcaaacaggctgtcggtctcctctcaccccttaatactgtgcagcccaaactcctaggactcttgaacatctgagcagttttgtgctttgagccactttttgacaaaaatggctccatttttccacagcgtggttttcttaaaatagtttaatgttttatagtctcatagtagtagtgttgctttctaagctataacagtcgactttattcttctactctgaaaaatcttgacttgtttgagtgtatataatatatataaagggagccttaatggattggttttcataatttaatattttttgtatttgctcttgtataattgtttttaacggaaagtattaaagaattgagggtggaattcttagaaccaaagttattcttaataaaaatcaccacatgcttggaccatgca

SEQ ID NO: 456040 - DNA, 3213 bp, Homo sapiens
tagagtgtttctctttgaacttgaactgtggctcttttgatatccagaaagagagttctttgtggggatggttaattcttgttttgggtgcttttcttcaccgctctaaggaactaccacagtcagaagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatattccagccagcagagaattttgacttgcagtaggatttggtttgattttcctacgatctgggtggatgccttgcctgtgacagttgcagttcctattcgccaaatgaagggcagtgccccgcacgtaagttggaatgatggacctgtgttcagagacttaacagaaccaacaagcaaaacaagtgagaacaggaaaaaggaagaggacactggaatcaattcttgagagttgcactacttggtttttcttccattccaagtttcgtgggacccagagccttttttcttttaaaagctaaaaaacaagtgtttaattcctctttttgttatctgttagataattgagatcacctagaaatgcgtttaatctgttcactcactgtaaattttgaggacccagaattgtcttgtttaatttatactttcacccctgttgcagttaacaccagagaaggaacgtgaatgtcgagcacagccactacccttgttggcacttaatttagaaatagggtgagaagtttaaaagcccatcttgattttattttcattccttttggttctctgtgtaataatagcaggctacatagtgacattccagttccaagaaggtacatcctgtccattcattaattgctttgattactaggagggtttctgttcagttttgtttttaaatgtcttgctgatctagttctttcagatggaataaccttccagtcccttagagagtggaactagtccatataacccagcttcagtagcaaaagtagaagccgccacatcttttcatttctccaagaggagagtggggaaggttcccatgaccagctgggcagtcaggatttctctaggcattctaatgtgaaataagtgtagactgctgtcaaggaggcttcatcagaagatgtatagcatttgaatgtctaatgataatgcatatcattagaatccaagctttgaaaatttctgattaatgctcatgtatttctttatctttgtttttccttgtgaagaaagactttcaccactgtctgagtgatgatgctgttgataaggatgatgtcgatgactactatattgcatctctcaggaacagctgatgggaagggaggggctgctgagttcccttgttctagctagcagcacgctcctcagagagggggccgagttacagacagcagccgcattctcatgcaaaattagttttaaactgctagtgtgggcatcggtaccttttgcctgggtgataccgaagaattgttgaggatttagtatgctccgtagagacagttcagccagtcatttctgcattggagagacttctcatactttctttgaagactcatagaaagctggatctagagcttttgaatccttaattagcacagtagaaattagctttctatgggaatgctttagtgttagcagttgacaattaggcccatattcaatctgaatgggaacaaaagtaaatgcaatgataatatactgctagttagagaaacatgttagttgattatacctgaaatggattatttatctcatcagcaagtattatttgaataaaatgagaaatgcttaagaaaaattgttgctctatagtaatttggtttcgaagaatggaatggtaactattttttcccatcgttcttttgagagaaggaagtgtgatgactgatgatcttgaaaagcccatttctgattgcacgttgactggaattctttctttgtgtctgtggactagcgatgctgtttgtaaaatgaagattcgggactggctcatatctttttatctaactagatgtcagatcttgaaatctgtattctcgaagcaattctgccacttgatcgtattcacaggggccctggtaggctcctttagaaggaccatttctgttcctagagcttaactagaattcattcttcactgaaaaaaaaaaaagttacttaagaaagcatttctttcctaatctcactcaaatctgcagaattatttgtaattagtaatacaaaatctggccaaaaggagacttgtaaatagcgtaaagtggtgtcttatgctaaacggtggaatgtataggcagagaagctctttgaagttgtcagatgagctgggctcacaagcctgattcaaacaggctgtcggtctcctctcaccccttaatactgtgcagcccaaactcctaggactcttgaacatctgagcagttttgtgctttgagccactttttgacaaaaatggctccatttttccacagcgtggttttcttaaaatagtttaatgttttatagtctcatagtagtagtgttgctttctaagctataacagtcgactttattcttctactctgaaaaatcttgacttgtttgagtgtatataatatatataaagggagccttaatggattggttttcataatttaatattttttgtatttgctcttgtataattgtttttaacggaaagtattaaagaattgagggtggaattcttagaaccaaagttattcttaataaaaatcaccacatgcttggaccatgca

SEQ ID NO: 456041 - DNA, 3108 bp, Homo sapiens
agcgagagccgccctgcgccggactggcttgcgggccgggccgccgcccccggagccgccctcgcgccgcctcgggccgccgccgagcagtcgggccgctgggcgccgccgcgggcgccgggagcgagctgggagggagccgcgcgcctttgtgcgcgcgccgagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatattccagccagcagagaattttgacttgcagtaggatttggtttgattttcctacgatctgggtggatgccttgcctgtgacagttgcagttcctattcgccaaatgaagggcagtgccccgcacgtaagttggaatgatggacctgtgttcagagacttaacagaaccaacaagcaaaacaagtgagaacaggaaaaaggaagaggacactggaatcaattcttgagagttgcactacttggtttttcttccattccaagtttcgtgggacccagagccttttttcttttaaaagctaaaaaacaagtgtttaattcctctttttgttatctgttagataattgagatcacctagaaatgcgtttaatctgttcactcactgtaaattttgaggacccagaattgtcttgtttaatttatactttcacccctgttgcagttaacaccagagaaggaacgtgaatgtcgagcacagccactacccttgttggcacttaatttagaaatagggtgagaagtttaaaagcccatcttgattttattttcattccttttggttctctgtgtaataatagcaggctacatagtgacattccagttccaagaaggtacatcctgtccattcattaattgctttgattactaggagggtttctgttcagttttgtttttaaatgtcttgctgatctagttctttcagatggaataaccttccagtcccttagagagtggaactagtccatataacccagcttcagtagcaaaagtagaagccgccacatcttttcatttctccaagaggagagtggggaaggttcccatgaccagctgggcagtcaggatttctctaggcattctaatgtgaaataagtgtagactgctgtcaaggaggcttcatcagaagatgtatagcatttgaatgtctaatgataatgcatatcattagaatccaagctttgaaaatttctgattaatgctcatgtatttctttatctttgtttttccttgtgaagaaagactttcaccactgtctgagtgatgatgctgttgataaggatgatgtcgatgactactatattgcatctctcaggaacagctgatgggaagggaggggctgctgagttcccttgttctagctagcagcacgctcctcagagagggggccgagttacagacagcagccgcattctcatgcaaaattagttttaaactgctagtgtgggcatcggtaccttttgcctgggtgataccgaagaattgttgaggatttagtatgctccgtagagacagttcagccagtcatttctgcattggagagacttctcatactttctttgaagactcatagaaagctggatctagagcttttgaatccttaattagcacagtagaaattagctttctatgggaatgctttagtgttagcagttgacaattaggcccatattcaatctgaatgggaacaaaagtaaatgcaatgataatatactgctagttagagaaacatgttagttgattatacctgaaatggattatttatctcatcagcaagtattatttgaataaaatgagaaatgcttaagaaaaattgttgctctatagtaatttggtttcgaagaatggaatggtaactattttttcccatcgttcttttgagagaaggaagtgtgatgactgatgatcttgaaaagcccatttctgattgcacgttgactggaattctttctttgtgtctgtggactagcgatgctgtttgtaaaatgaagattcgggactggctcatatctttttatctaactagatgtcagatcttgaaatctgtattctcgaagcaattctgccacttgatcgtattcacaggggccctggtaggctcctttagaaggaccatttctgttcctagagcttaactagaattcattcttcactgaaaaaaaaaaaagttacttaagaaagcatttctttcctaatctcactcaaatctgcagaattatttgtaattagtaatacaaaatctggccaaaaggagacttgtaaatagcgtaaagtggtgtcttatgctaaacggtggaatgtataggcagagaagctctttgaagttgtcagatgagctgggctcacaagcctgattcaaacaggctgtcggtctcctctcaccccttaatactgtgcagcccaaactcctaggactcttgaacatctgagcagttttgtgctttgagccactttttgacaaaaatggctccatttttccacagcgtggttttcttaaaatagtttaatgttttatagtctcatagtagtagtgttgctttctaagctataacagtcgactttattcttctactctgaaaaatcttgacttgtttgagtgtgattctgccgggatcctcggaacaccc

SEQ ID NO: 456042 - DNA, 488 bp, Homo sapiens
  misc_feature (21)..(22): n is a, c, g, or t
ggtagttttaattcttctttnntatcctcaccatgaagttgctgatggtcctcatgctggcggccctctcccagcactgctacgcaggctctggctgccccttattggagaatgtgatttccaagacaatcaatccacaagtgtctaagactgaatacaaagaacttcttcaagagttcatagacgacaatgccactacaaatgccatagatgaattgaaggaatgttttcttaaccaaacggatgaaactctgagcaatgttgaggtgtttatgcaattaatatatgacagcagtctttgtgatttattttaactttctgcaagacctttggctcacagaactgcagggtatggtgagaaaccaactacggattgctgcaaaccacaccttctctttcttatgtctttttactacaaactacaagacaattgttgaaacctgctatacatgtttattttaataaattgatggcaaacgttggcctca

SEQ ID NO: 456043 - DNA, 263 bp, Homo sapiens
tagtgttcaattataatgaaatatttacgaaagaagaacgggagagctcacaattaatatatgacagcagtctttgtgatttattttaactttctgcaagacctttggctcacagaactgcagggtatggtgagaaaccaactacggattgctgcaaaccacaccttctctttcttatgtctttttactacaaactacaagacaattgttgaaacctgctatacatgtttattttaataaattgatggcaaacgttggcctca

SEQ ID NO: 456044 - DNA, 1129 bp, Homo sapiens
gtaaaaaaaaaaaaaaaaaaaaagttagaaatataccaaacccctccattaggatgaaagtgaacatcacctcaggaaaccctgacgctttctacaacatggatgaaccttgaggatattatagcgagtgaagagtgaagcaaagagtcacaaaaacacaaatgctgcatgacccatgcatatgggaatctggggagccagactcagagacagtgaaaaaaaaaaaaacagtggttgtcagggcttgggtgcagagaagaagggggagtcatatttaatgggtctggagtttcagttgtgcaaaacagtaatattctggagttaggttgcacaaccacacgaatatacagaacactccgaactgtccccttaaaatggcaaattttatgagatgtacattttaccactattaataatttgttaaaaactaattatcaactgcagggaagggtgatggatttgtttctttaaaagcttcctcagacagatcatagtctgcagctccaataattagtagagcacaatggtggtggcagagggcgtcggactgctgggatgctgggaatatttccacaatggagggttagacgagagctcaaagtttcacttttttttttttttttttttttgcatttgagctaagattttaacaatcctgtgaaaataggtaatatagtcacgtatttgttgaatacattatttcaaagaaccacaaacacacagaaaaaatatttaaaaagtccatggtgggggaaatgatccagaaacaacagctcttctacttccagccctaaccgtctgggatgctagatggttgtgggcaaaccgtggaaaaagataagcttctgtttttcaagattttattttgttagagagtgcagaaaatctaagtgatgtctctgtttttgctttctagcaattaatatatgacagcagtctttgtgatttattttaactttctgcaagacctttggctcacagaactgcagggtatggtgagaaaccaactacggattgctgcaaaccacaccttctctttcttatgtctttttactacaaactacaagacaattgttgaaacctgctatacatgtttattttaataaattgatggcaaacgttggcctca

SEQ ID NO: 456045 - DNA, 618 bp, Homo sapiens
cttgtgctgagtgtgtttgtgtgtgtctctgtgtttctgtgtttgtgtgtttctgtctgtgtgtttgtgtttgtgtctggatgattgtgtgctggtgtgattgtgtctggtgtctgtgtctgtgtctttgcctgtctgtcctatgtttgtgtatgttctgaatgtgtgtgtatttgttgaatacattatttcaaagaaccacaaacacacagaaaaaatatttaaaaagtccatggtgggggaaatgatccagaaacaacagctcttctacttccagccctaaccgtctgggatgctagatggttgtgggcaaaccgtggaaaaagataagcttctgtttttcaagattttattttgttagagagtgcagaaaatctaagtgatgtctctgtttttgctttctagcaattaatatatgacagcagtctttgtgatttattttaactttctgcaagacctttggctcacagaactgcagggtatggtgagaaaccaactacggattgctgcaaaccacaccttctctttcttatgtctttttactacaaactacaagacaattgttgaaacctgctatacatgtttattttaataaattgatggcaaacgttggcctca

SEQ ID NO: 456046 - DNA, 248 bp, Homo sapiens
gagcgggggaacaggatcttggagaggtgtttatgcaattaatatatgacagcagtctttgtgatttattttaactttctgcaagacctttggctcacagaactgcagggtatggtgagaaaccaactacggattgctgcaaaccacaccttctctttcttatgtctttttactacaaactacaagacaattgttgaaacctgctatacatgtttattttaataaattgatggcaaacgttggcctca

SEQ ID NO: 456047 - DNA, 518 bp, Homo sapiens
tccacagcggcttccttgatccttgccacccgcgactgaacaccgacagcagcagcctcaccatgaagttgctgatggtcctcatgctggcggccctctcccagcactgctacgcaggctctggctgccccttattggagaatgtgatttccaagacaatcaatccacaagtgtctaagactgaatacaaagaacttcttcaagagttcatagacgacaatgccactacaaatgccatagatgaattgaaggaatgttttcttaaccaaacggatgaaactctgagcaatgttgaggtgtttatgcaattaatatatgacagcagtctttgtgatttattttaactttctgcaagacctttggctcacagaactgcagggtatggtgagaaaccaactacggattgctgcaaaccacaccttctctttcttatgtctttttactacaaactacaagacaattgttgaaacctgctatacatgtttattttaataaattgatggcaaacgttggcctca

SEQ ID NO: 456048 - DNA, 3456 bp, Homo sapiens
  misc_feature (2)..(3): n is a, c, g, or t
  misc_feature (5)..(5): n is a, c, g, or t
  misc_feature (64)..(64): n is a, c, g, or t
tnncnaggtttagaatctgacctatctaccttaatagtgtggctcagtaaaaacagatcaatanaacacctggcgttaggcaaaaattttaataatatgaatcaaaatctgacacctgtatggacacttagtacagatgatcaagatgaagaatcacctctgcagtccttgtccctggctgactcgaaactcaagactgaggtcaccatcatcatcaatgccctgggaagcaacacctccctgaccaaagtggacattagcggcaacggaatgggggacatgggagcgaagatgctggccaaagcactgcagatcaacactaagctcaggactgtaatatgggacaagaacaacatcactgcacaaggctttcaggatatagctgttgctatggaaaagaactacacattaagatttatgccaattcctatgtatgatgcttctcaagccctaaaaacaaaccctgaaaaaacagaagacgctctgcaaaagatagaaaactacctgctacgaaatcacgagactagaaaataccttcaagagcaggcctaccgcctgcagcagggtattgtcaccagcaccacccagcagatgattgacagaatatgtgtgaaagtacaagatcatctcaactccttacgaaattgtgggggagacgctatccaggaagatttaaaatcagcagagcggctcatgcgtgatgctaagaactctaaaacgttgttaccaaatttataccatgttggtggtgcatcttgggcgggagcagtggcttactatccagtccaattcaggagaccctggaatcaatggctggagaagttacaagagtagtagatgaacaactaaaggcgttgcttgagtccatggttgatgctgctgagaatctttgtcccaatgtgatgaaaaaagcccacattcgacaagacttgattcatgccagcaccgaaaagatttctattccacgtacctttgttaaaaatgtcctgttggagcagtctggaattgatatccttaacaaaattagtgaagtaaaattgacagtggcctcgttcctgtctgatagaattgtggatgaaatcctggatgcactctcacattgccatcataaactggctgaccatttcagcagacgtggcaagacccttcctcaacaagaatccttagagatcgagctggctgaggagaagccagttaaacgttccatcatcacagtggaggagctaacagagatagagcgtttggaagatctggatacctgtatgatgacccctaaatccaaaaggaagagtatccatagccgaatgctgcggcctgtttctagggcttttgaaatggagtttgatctagataaagcgctggaagaggtaccaattcacatcgaagacccgcccttcccatccctcagacaggagaagcggagctcgggatttatctctgagttgccctctgaagaggggaagaagctggaacactttaccaagttaaggccaaaaaggaataagaagcagcaacccacccaagcagcggtctgtgctgccaacatagtctcacaagatggtgaacagaatggtctcatggggagagtggatgaaggtgtagatgaattttttaccaagaaggtgaccaaaatggattccaagaaatggtcaacaagaggctcagagtcccatgagcttaatgaaggaggagatgaaaagaaaaagcgagattctcggaaaagtagtggctttctcaatttaatcaaatcccggtccaaatccgagcgaccaccaacgatcttgatgacagaagaaccctcctcaccaaaaggggcagtcagaagtccacctgtggactgtcccaggaaggacacaaaggccgccgagcacaatggcaattctgaacggatagaggagataaaaacacctgactcctttgaagagagtcaaggggaagaaatagggaaggtggaacggagtgacagcaagagcagcccacaggcagggcggaggtatggggtccaggtgatgggcagtggtctgctggcagagatgaaagccaagcaagtccagagaaccgctttggtttgggaacaccagaaaagaataccaaagcagaacccaaagcggaagcaggctccaggtctcggagctcatccagcacacctacgagcccgaagcccctcctgcagtcccccaaacccagtctggcagcacggcccgtcatcccgcagaaaccaagaaccgcctcacggcctgatgacattccagactctccatctagcccgaaagttgcccttcttccacctgtcctgaaaaaagttccttcagacaaagagagagatggccagagtagcccccagcccagccccaggacattttcacaggaagtttcaaggagaagctggggccagcaggcccaggagtatcaagaacaaaagcaacggtcctccagtaaagatggccatcaaggcagcaaatctaatgactccggggaagaagcagaaaaagagtttatttttgtgtaaaggtcacccacgcagaagtcttcctgtgcagggtgctttggtagccatcagagaggaaccaagggcaacatcttttcttcccaggcgttcttctctgggtgctttattctcttctttttctttatttcgcccccacccccatcccctgccttttttttttttttttttttgtatagaaacagatccatttcttggtaatcaaagcacatttgtttggtcttcctccaaccctttgcatttgatttctaaacattccttcatatgcctttaatgaaagccagcaattatcccatgggccctacttgaatttatctgaggcagctacagattgccctgcaagatgagtttttggagataaatgaaataactggacacacactcacacaagtaacaccacagcagacctcggagtactgctaagtgtacctgtgtcaaatccgcacaggactcaatatagcaatttattcttgatgtatgcaattgcacattgtaattatattaacagagcacactaataatttgtatagattatatatattagatcttgggtatggtttttaccttctcccatggggaacttcttccttcctgatgtggaattgtacatttaaagcttggtcggtgacctttgcataccatcaacgagcacagctaagaacagagtgagagaggcccatggctgattttaccatgtgcccagattaatgtatatagttgattggaatgaggttttatgaatattcatgtttttgaaggcctttaatttctgtctgcatattagcttttaatgtgtgattttaagagagaatactttgacacctgtaaaaatcaaaatactactctttataagacatttcacaaatattcacttacattacaggctggaagtattttattcatatgtatatttataccaataaaatgattttacaagtggaaaaaaaaac

SEQ ID NO: 456049 - DNA, 3430 bp, Homo sapiens
  misc_feature (2)..(3): n is a, c, g, or t
  misc_feature (5)..(5): n is a, c, g, or t
  misc_feature (64)..(64): n is a, c, g, or t
tnncnaggtttagaatctgacctatctaccttaatagtgtggctcagtaaaaacagatcaatanaacacctggcgttaggcaaaaattttaataatatgaatcaaaatctgacacctgtatggacacttagtacagatgatcaagatgaagaatcacctctgcagtccttgtccctggctgactcgaaactcaagactgaggtcaccatcatcatcaatgccctgggaagcaacacctccctgaccaaagtggacattagcggcaacggaatgggggacatgggagcgaagatgctggccaaagcactgcagatcaacactaagctcaggactgtaatatgggacaagaacaacatcactgcacaaggctttcaggatatagctgttgctatggaaaagaactacacattaagatttatgccaattcctatgtatgatgcttctcaagccctaaaaacaaaccctgaaaaaacagaagacgctctgcaaaagatagaaaactacctgctacgaaatcacgagactagaaaataccttcaagagcaggcctaccgcctgcagcagggtattgtcaccagcaccacccagcagatgattgacagaatatgtgtgaaagtacaagatcatctcaactccttacgaaattgtgggggagacgctatccaggaagatttaaaatcagcagagcggctcatgcgtgatgctaagaactctaaaacgttgttaccaaatttataccatgttggtggtgcatcttgggcgggagcagtggcttactatccagtccaattcaggagaccctggaatcaatggctggagaagttacaagagtagtagatgaacaactaaaggcgttgcttgagtccatggttgatgctgctgagaatctttgtcccaatgtgatgaaaaaagcccacattcgacaagacttgattcatgccagcaccgaaaagatttctattccacgtacctttgttaaaaatgtcctgttggagcagtctggaattgatatccttaacaaaattagtgaagtaaaattgacagtggcctcgttcctgtctgatagaattgtggatgaaatcctggatgcactctcacattgccatcataaactggctgaccatttcagcagacgtggcaagacccttcctcaacaaggagaagccagttaaacgttccatcatcacagtggaggagctaacagagatagagcgtttggaagatctggatacctgtatgatgacccctaaatccaaaaggaagagtatccatagccgaatgctgcggcctgtttctagggcttttgaaatggagtttgatctagataaagcgctggaagaggtaccaattcacatcgaagacccgcccttcccatccctcagacaggagaagcggagctcgggatttatctctgagttgccctctgaagaggggaagaagctggaacactttaccaagttaaggccaaaaaggaataagaagcagcaacccacccaagcagcggtctgtgctgccaacatagtctcacaagatggtgaacagaatggtctcatggggagagtggatgaaggtgtagatgaattttttaccaagaaggtgaccaaaatggattccaagaaatggtcaacaagaggctcagagtcccatgagcttaatgaaggaggagatgaaaagaaaaagcgagattctcggaaaagtagtggctttctcaatttaatcaaatcccggtccaaatccgagcgaccaccaacgatcttgatgacagaagaaccctcctcaccaaaaggggcagtcagaagtccacctgtggactgtcccaggaaggacacaaaggccgccgagcacaatggcaattctgaacggatagaggagataaaaacacctgactcctttgaagagagtcaaggggaagaaatagggaaggtggaacggagtgacagcaagagcagcccacaggcagggcggaggtatggggtccaggtgatgggcagtggtctgctggcagagatgaaagccaagcaagtccagagaaccgctttggtttgggaacaccagaaaagaataccaaagcagaacccaaagcggaagcaggctccaggtctcggagctcatccagcacacctacgagcccgaagcccctcctgcagtcccccaaacccagtctggcagcacggcccgtcatcccgcagaaaccaagaaccgcctcacggcctgatgacattccagactctccatctagcccgaaagttgcccttcttccacctgtcctgaaaaaagttccttcagacaaagagagagatggccagagtagcccccagcccagccccaggacattttcacaggaagtttcaaggagaagctggggccagcaggcccaggagtatcaagaacaaaagcaacggtcctccagtaaagatggccatcaaggcagcaaatctaatgactccggggaagaagcagaaaaagagtttatttttgtgtaaaggtcacccacgcagaagtcttcctgtgcagggtgctttggtagccatcagagaggaaccaagggcaacatcttttcttcccaggcgttcttctctgggtgctttattctcttctttttctttatttcgcccccacccccatcccctgccttttttttttttttttttttgtatagaaacagatccatttcttggtaatcaaagcacatttgtttggtcttcctccaaccctttgcatttgatttctaaacattccttcatatgcctttaatgaaagccagcaattatcccatgggccctacttgaatttatctgaggcagctacagattgccctgcaagatgagtttttggagataaatgaaataactggacacacactcacacaagtaacaccacagcagacctcggagtactgctaagtgtacctgtgtcaaatccgcacaggactcaatatagcaatttattcttgatgtatgcaattgcacattgtaattatattaacagagcacactaataatttgtatagattatatatattagatcttgggtatggtttttaccttctcccatggggaacttcttccttcctgatgtggaattgtacatttaaagcttggtcggtgacctttgcataccatcaacgagcacagctaagaacagagtgagagaggcccatggctgattttaccatgtgcccagattaatgtatatagttgattggaatgaggttttatgaatattcatgtttttgaaggcctttaatttctgtctgcatattagcttttaatgtgtgattttaagagagaatactttgacacctgtaaaaatcaaaatactactctttataagacatttcacaaatattcacttacattacaggctggaagtattttattcatatgtatatttataccaataaaatgattttacaagtggaaaaaaaaac

SEQ ID NO: 456050 - DNA, 2743 bp, Homo sapiens
ttgccgatttcatgactaaccagtgtaagtggcagtttagcgcatgggataatgtacccgtcctcattttttcaggttgccttgcccattctggacattttggctgtaagaatattggaaacaaagggggaaagctggtttattccatgtaggttgcgttgagaatttcctaggaaaagtaagttgtgcttaggaagtaggaaagcagccaggcccccgcttcccacatacagtcaaaaagcaagcatgagagtctgctatagtgagatggaaatggctagcttgcctttttcttgtctatttcatagccaaggaggaaggaaaaactggacctcattatggatttacttttgggatacactcattattccagaggagggtaaaaggctgagaagcttaaggtatttcagtctgttttatgttactcatttgcgaaaagcaggctcatcgaatacaggtgagtttcaacgtgtcttgaatatggcagcatttaaaagtcttcagaccaggcatggtggctcatgcctgtcatcccagcactttgggaggccgaggcaggcagatcatgaggtcaggagatcgagaccatcccggctaacagtggaaccctgtctctactgaaaatacaaaaaaaatcagcctcctgagtagctgggacttcagatgcatgccatcatgcctgactaatttttctattttttgcagagatggggggtctcactatgttgcctaggctggtctcaagctcgtgacctcaaacaattctcccatctcagtttcccaaagtgctgagatagattacaggcatgagccactgcacccagccaaaactagatttttggaaaccaaacctagagcagattctgtacatttctagcatgcaagggccctcatcacataaagcatcaggggctgcagagcctgcatagatgttcaacaagaaaaacagtaaaggtcaccaagcccactgactttccctggccccatgcacctctcacctgtgaggagccttccgaggaaccaaaccggccacactttggaccccagagtcctgaccgtaaacacagaatagaatgtgtttctcacagttttgtcccagccagagagcctatggagacaggtcaggcacagtcaccataacagcagctgagttaaagagcccttctttgctgtcatttattatctgcattgttttttcacttttgcattaaataaatgtgcactttttggggggatggtgcttgaattttttagaagcttgggaatgatgccgtatcccaggattcttccagcccagctttgagcagcgtagaacggtcggatggaggtggggcagtccagagaaccgctttggtttgggaacaccagaaaagaataccaaagcagaacccaaagcggaagcaggctccaggtctcggagctcatccagcacacctacgagcccgaagcccctcctgcagtcccccaaacccagtctggcagcacggcccgtcatcccgcagaaaccaagaaccgcctcacggcctgatgacattccagactctccatctagcccgaaagttgcccttcttccacctgtcctgaaaaaagttccttcagacaaagagagagatggccagagtagcccccagcccagccccaggacattttcacaggaagtttcaaggagaagctggggccagcaggcccaggagtatcaagaacaaaagcaacggtcctccagtaaagatggccatcaaggcagcaaatctaatgactccggggaagaagcagaaaaagagtttatttttgtgtaaaggtcacccacgcagaagtcttcctgtgcagggtgctttggtagccatcagagaggaaccaagggcaacatcttttcttcccaggcgttcttctctgggtgctttattctcttctttttctttatttcgcccccacccccatcccctgccttttttttttttttttttttgtatagaaacagatccatttcttggtaatcaaagcacatttgtttggtcttcctccaaccctttgcatttgatttctaaacattccttcatatgcctttaatgaaagccagcaattatcccatgggccctacttgaatttatctgaggcagctacagattgccctgcaagatgagtttttggagataaatgaaataactggacacacactcacacaagtaacaccacagcagacctcggagtactgctaagtgtacctgtgtcaaatccgcacaggactcaatatagcaatttattcttgatgtatgcaattgcacattgtaattatattaacagagcacactaataatttgtatagattatatatattagatcttgggtatggtttttaccttctcccatggggaacttcttccttcctgatgtggaattgtacatttaaagcttggtcggtgacctttgcataccatcaacgagcacagctaagaacagagtgagagaggcccatggctgattttaccatgtgcccagattaatgtatatagttgattggaatgaggttttatgaatattcatgtttttgaaggcctttaatttctgtctgcatattagcttttaatgtgtgattttaagagagaatactttgacacctgtaaaaatcaaaatactactctttataagacatttcacaaatattcacttacattacaggctggaagtattttattcatatgtatatttataccaataaaatgattttacaagtggaaaaaaaaac

SEQ ID NO: 456051 - DNA, 286 bp, Homo sapiens
cattctcagtgactccagttagaagggtttgaggttttcatccttgtgcattctgtggtttgctgaagtttttttcatactccttcgttctgtgtttccttctatctgaatatcggctgggctgacttggatgcttgcctttttctggtttggagcagatgattgacagaatatgtgtgaaagtacaagatcatctcaactccttacgaaattgtgggggagacgctatccaggaagatttaaaatcagcagagcggctcatgcgtgatgctaagaactctaaaac

SEQ ID NO: 456052 - DNA, 385 bp, Homo sapiens
ggatgttacttcactgagcaaaaacacaaaactaatttttggccagaaaaattctatgatgctttatttttttaaatgacttatttttatatatagatttaccaggctttatgttcttggaatccagtttgtggaacagtttgattcacgtgtttgtgtctccttagatgacattccagactctccatctagcccgaaagttgcccttcttccacctgtcctgaaaaaagttccttcagacaaagagagagatggccagagtagcccccagcccagccccaggacattttcacaggaaggtaaggattgtaaggatttcttttctctgggttagctctccccaaggagggacatttcaaaataaaggaactcatcctggacttta

SEQ ID NO: 456053 - DNA, 3175 bp, Homo sapiens
cctagttttagaagtttcaatagcactgcagatcaacactaagctcaggactgtaatatgggacaagaacaacatcactgcacaaggctttcaggatatagctgttgctatggaaaagaactacacattaagatttatgccaattcctatgtatgatgcttctcaagccctaaaaacaaaccctgaaaaaacagaagacgctctgcaaaagatagaaaactacctgctacgaaatcacgagactagaaaataccttcaagagcaggcctaccgcctgcagcagggtattgtcaccagcaccacccagcagatgattgacagaatatgtgtgaaagtacaagatcatctcaactccttacgaaattgtgggggagacgctatccaggaagatttaaaatcagcagagcggctcatgcgtgatgctaagaactctaaaacgttgttaccaaatttataccatgttggtggtgcatcttgggcgggagcagtggcttactatccagtccaattcaggagaccctggaatcaatggctggagaagttacaagagtagtagatgaacaactaaaggcgttgcttgagtccatggttgatgctgctgagaatctttgtcccaatgtgatgaaaaaagcccacattcgacaagacttgattcatgccagcaccgaaaagatttctattccacgtacctttgttaaaaatgtcctgttggagcagtctggaattgatatccttaacaaaattagtgaagtaaaattgacagtggcctcgttcctgtctgatagaattgtggatgaaatcctggatgcactctcacattgccatcataaactggctgaccatttcagcagacgtggcaagacccttcctcaacaagaatccttagagatcgagctggctgaggagaagccagttaaacgttccatcatcacagtggaggagctaacagagatagagcgtttggaagatctggatacctgtatgatgacccctaaatccaaaaggaagagtatccatagccgaatgctgcggcctgtttctagggcttttgaaatggagtttgatctagataaagcgctggaagaggtaccaattcacatcgaagacccgcccttcccatccctcagacaggagaagcggagctcgggatttatctctgagttgccctctgaagaggggaagaagctggaacactttaccaagttaaggccaaaaaggaataagaagcagcaacccacccaagcagcggtctgtgctgccaacatagtctcacaagatggtgaacagaatggtctcatggggagagtggatgaaggtgtagatgaattttttaccaagaaggtgaccaaaatggattccaagaaatggtcaacaagaggctcagagtcccatgagcttaatgaaggaggagatgaaaagaaaaagcgagattctcggaaaagtagtggctttctcaatttaatcaaatcccggtccaaatccgagcgaccaccaacgatcttgatgacagaagaaccctcctcaccaaaaggggcagtcagaagtccacctgtggactgtcccaggaaggacacaaaggccgccgagcacaatggcaattctgaacggatagaggagataaaaacacctgactcctttgaagagagtcaaggggaagaaatagggaaggtggaacggagtgacagcaagagcagcccacaggcagggcggaggtatggggtccaggtgatgggcagtggtctgctggcagagatgaaagccaagcaagtccagagaaccgctttggtttgggaacaccagaaaagaataccaaagcagaacccaaagcggaagcaggctccaggtctcggagctcatccagcacacctacgagcccgaagcccctcctgcagtcccccaaacccagtctggcagcacggcccgtcatcccgcagaaaccaagaaccgcctcacggcctgatgacattccagactctccatctagcccgaaagttgcccttcttccacctgtcctgaaaaaagttccttcagacaaagagagagatggccagagtagcccccagcccagccccaggacattttcacaggaagtttcaaggagaagctggggccagcaggcccaggagtatcaagaacaaaagcaacggtcctccagtaaagatggccatcaaggcagcaaatctaatgactccggggaagaagcagaaaaagagtttatttttgtgtaaaggtcacccacgcagaagtcttcctgtgcagggtgctttggtagccatcagagaggaaccaagggcaacatcttttcttcccaggcgttcttctctgggtgctttattctcttctttttctttatttcgcccccacccccatcccctgccttttttttttttttttttttgtatagaaacagatccatttcttggtaatcaaagcacatttgtttggtcttcctccaaccctttgcatttgatttctaaacattccttcatatgcctttaatgaaagccagcaattatcccatgggccctacttgaatttatctgaggcagctacagattgccctgcaagatgagtttttggagataaatgaaataactggacacacactcacacaagtaacaccacagcagacctcggagtactgctaagtgtacctgtgtcaaatccgcacaggactcaatatagcaatttattcttgatgtatgcaattgcacattgtaattatattaacagagcacactaataatttgtatagattatatatattagatcttgggtatggtttttaccttctcccatggggaacttcttccttcctgatgtggaattgtacatttaaagcttggtcggtgacctttgcataccatcaacgagcacagctaagaacagagtgagagaggcccatggctgattttaccatgtgcccagattaatgtatatagttgattggaatgaggttttatgaatattcatgtttttgaaggcctttaatttctgtctgcatattagcttttaatgtgtgattttaagagagaatactttgacacctgtaaaaatcaaaatactactctttataagacatttcacaaatattcacttacattacaggctggaagtattttattcatatgtatatttataccaataaaatgattttacaagtggaaaaaaaaac

SEQ ID NO: 456054 - DNA, 3271 bp, Homo sapiens
  misc_feature (2)..(3): n is a, c, g, or t
  misc_feature (5)..(5): n is a, c, g, or t
  misc_feature (64)..(64): n is a, c, g, or t
tnncnaggtttagaatctgacctatctaccttaatagtgtggctcagtaaaaacagatcaatanaacacctggcgttaggcaaaaattttaataatatgaatcaaaatctgacacctgtatggacacttagtacagatgatcaagatgaagaatcacctctgcagtccttgtccctggctgactcgaaactcaagactgaggtcaccatcatcatcaatgccctgggaagcaacacctccctgaccaaagtggacattagcggcaacggaatgggggacatgggagcgaagatgctggccaaagcactgcagatcaacactaagctcaggactgtaatatgggacaagaacaacatcactgcacaaggctttcaggatatagctgttgctatggaaaagaactacacattaagatttatgccaattcctatgtatgatgcttctcaagccctaaaaacaaaccctgaaaaaacagaagacgctctgcaaaagatagaaaactacctgctacgaaatcacgagactagaaaataccttcaagagcaggcctaccgcctgcagcagggtattgtcaccagcaccacccagcagatgattgacagaatatgtgtgaaagtacaagatcatctcaactccttacgaaattgtgggggagacgctatccaggaagatttaaaatcagcagagcggctcatgcgtgatgctaagaactctaaaacgttgttaccaaatttataccatgttggtggtgcatcttgggcgggagcagtggcttactatccagtccaattcaggagaccctggaatcaatggctggagaagttacaagagtagtagatgaacaactaaaggcgttgcttgagtccatggttgatgctgctgagaatctttgtcccaatgtgatgaaaaaagcccacattcgacaagacttgattcatgccagcaccgaaaagatttctattccacgtacctttgttaaaaatgtcctgttggagcagtctggaattgatatccttaacaaaattagtgaagtaaaattgacagtggcctcgttcctgtctgatagaattgtggatgaaatcctggatgcactctcacattgccatcataaactggctgaccatttcagcagacgtggcaagacccttcctcaacaagaatccttagagatcgagctggctgaggagaagccagttaaacgttccatcatcacagtggaggagctaacagagatagagcgtttggaagatctggatacctgtatgatgacccctaaatccaaaaggaagagtatccatagccgaatgctgcggcctgtttctagggcttttgaaatggagtttgatctagataaagcgctggaagaggtaccaattcacatcgaagacccgcccttcccatccctcagacaggagaagcggagctcgggatttatctctgagttgccctctgaagaggggaagaagctggaacactttaccaagttaaggccaaaaaggaataagaagcagcaacccacccaagcagcggtctgtgctgccaacatagtctcacaagatggtgaacagaatggtctcatggggagagtggatgaaggtgtagatgaattttttaccaagaaggtgaccaaaatggattccaagaaatggtcaacaagaggctcagagtcccatgagcttaatgaaggaggagatgaaaagaaaaagcgagattctcggaaaagtagtggctttctcaatttaatcaaatcccggtccaaatccgagcgaccaccaacgatcttgatgacagaagaaccctcctcaccaaaaggggcagtcagaagtccacctgtggactgtcccaggaaggacacaaaggccgccgagcacaatggcaattctgaacggatagaggagataaaaacacctgactcctttgaagagagtcaaggggaagaaatagggaaggtggaacggagtgacagcaagagcagcccacaggcagggcggaggtatggggtccaggtgatgggcagtggtctgctggcagagatgaaagccaagcaagtccagagaaccgctttggtttgggaacaccagaaaagaataccaaagcagaacccaaagcggaagcaggctccaggtctcggagctcatccagcacacctacgagcccgaagcccctcctgcagtcccccaaacccagtctggcagcacggcccgtcatcccgcagaaaccaagaaccgcctcacggcctgatgacattccagactctccatctagcccgaaagttgcccttcttccacctgtcctgaaaaaagttccttcagacaaagagagagatggccagagtagcccccagcccagccccaggacattttcacaggaagtttcaaggagaagctggggccagcaggcccaggagtatcaagaacaaaagcaacggtcctccagtaaagatggccatcaaggcagcaaatctaatgactccggggaagaagcagaaaaagagtttatttttgtgtaaaggtcacccacgcagaagtcttcctgtgcagggtgctttggtagccatcagagaggaaccaagggcaacatcttttcttcccaggcgttcttctctgggtgctttattctcttctttttctttatttcgcccccacccccatcccctgccttttttttttttttttttttgtatagaaacagatccatttcttggtaatcaaagcacatttgtttggtcttcctccaaccctttgcatttgatttctaaacattccttcatatgcctttaatgaaagccagcaattatcccatgggccctacttgaatttatctgaggcagctacagattgccctgcaagatgagtttttggagataaatgaaataactggacacacactcacacaagtaacaccacagcagacctcggagtactgctaagtgtacctgtgtcaaatccgcacaggactcaatatagcaatttattcttgatgtatgcaattgcacattgtaattatattaacagagcacactaataatttgtatatagttgattggaatgaggttttatgaatattcatgtttttgaaggcctttaatttctgtctgcatattagcttttaatgtgtgattttaagagagaatactttgacacctgtaaaaatcaaaatactactctttataagacatttcacaaatattcacttacattacaggctggaagtattttattcatatgtatatttataccaataaaatgattttacaagtggaaaaaaaaac

SEQ ID NO: 456055 - DNA, 3587 bp, Homo sapiens
ttgccgatttcatgactaaccagtgtaagtggcagtttagcgcatgggataatgtacccgtcctcattttttcaggttgccttgcccattctggacattttggctgtaagaatattggaaacaaagggggaaagctggtttattccatgtaggttgcgttgagaatttcctaggaaaagtaagttgtgcttaggaagtaggaaagcagccaggcccccgcttcccacatacagtcaaaaagcaagcatgagagtctgctatagtgagatggaaatggctagcttgcctttttcttgtctatttcatagccaaggaggaaggaaaaactggacctcattatggatttacttttgggatacactcattattccagaggagggtaaaaggctgagaagcttaaggtatttcagtctgttttatgttactcatttgcgaaaagcaggctcatcgaatacaggtgagtttcaacgtgtcttgaatatggcagcatttaaaagtcttcagaccaggcatggtggctcatgcctgtcatcccagcactttgggaggccgaggcaggcagatcatgaggtcaggagatcgagaccatcccggctaacagtggaaccctgtctctactgaaaatacaaaaaaaatcagcctcctgagtagctgggacttcagatgcatgccatcatgcctgactaatttttctattttttgcagagatggggggtctcactatgttgcctaggctggtctcaagctcgtgacctcaaacaattctcccatctcagtttcccaaagtgctgagatagattacaggcatgagccactgcacccagccaaaactagatttttggaaaccaaacctagagcagattctgtacatttctagcatgcaagggccctcatcacataaagcatcaggggctgcagagcctgcatagatgttcaacaagaaaaacagtaaaggtcaccaagcccactgactttccctggccccatgcacctctcacctgtgaggagccttccgaggaaccaaaccggccacactttggaccccagagtcctgaccgtaaacacagaatagaatgtgtttctcacagttttgtcccagccagagagcctatggagacaggtcaggcacagtcaccataacagcagctgagttaaagagcccttctttgctgtcatttattatctgcattgttttttcacttttgcattaaataaatgtgcactttttggggggatggtgcttgaattttttagaagcttgggaatgatgccgtatcccaggattcttccagcccagctttgagcagcgtagaacggtcggatggaggtggggcaggtaagtcaggccattgccatcacccccttaggaaaagcgcttaccttctgattgcagagtcacatgattgacagaagaaaaatttaaacagggaggcaagaactgatctctttgttgtgtgttctcagctatcatctgaaagaccatatcccttcacctgccttatcttcccctggggcacatcctgcccctctgtagcattgtgcctggacagggcactttttgatttcccaaagggaggaaattctgacggttttttcattgcaaactcctcagctttgagcattttggaaaagttgggggtgggggcagcatacaggatcatggctgatgtatttaagaataagccatgcatgacatatggaagatgggtggctgtcttgtttggtatgaacaatatgcttcgcttgcagcttgaatatgcatgaaatccaatatcccttgtccctctgacttcttaggtataataaaataagaaaataccttagatgaaaactagagagtaatgcgttaactgtgtgatagaatcctcactttgctatttgagagtcttatgcatagctacagtatcttggtgcagtaagagttggatgataaatcacattttatgggcttatttttgccagttgtcttgttaaattaaggcagcagtatggatggaggtgggggatgagatgacatttctggagctgttctcactaaacatgagattgcagccgtcagcatcaccctcctcactcagaacctgtagccagagccctaactgcttattgtccagaaccaaggcacttacatttggttatacctgtaccttgtgccagatctgagaaagacccaaatatttcaagtgcatgaagaaccactgttttccttgtatgtgattacggcactgtacattattaaatataaaagcttgtcatcgctggaatagtcaggggtgatcagaaaacaaccaaaaagtttattgcttttctacaaagaacgtcactcttcctccagcatgttttgattttaaaacatgctagaacagcatattcttaaaatactcttaaaacatccatgatgagaaacgatggcaaatgattacagcagtttgtaccagacttctagcttcaagttattggcttctttgacctttgatttttaaagtggcctttttcatcttagtgcctaaactgcacccaggtcttccagagaaccgctttggtttgggaacaccagaaaagaataccaaagcagaacccaaagcggaagcaggctccaggtctcggagctcatccagcacacctacgagcccgaagcccctcctgcagtcccccaaacccagtctggcagcacggcccgtcatcccgcagaaaccaagaaccgcctcacggcctggtaagagttttgcagttagggagttgcattgtgaccaggtggcttcccagagccagctggatcagactctgcaggtggtttcaggggcagctggtgagcgaggtacagcggcttctgcaggaggggatcacaagaaacctatgcaaagctgtgaaagtgatgagagctgatggatttttttatttaatgcagaggcccaccatgtgtgagagttggggactctgagactgtccttgctttcaggggtacaggttagtttgtaggcaagacagggaaatcagtcttttgtcatgttgacccatctgtagtgctcggcttggctttctaatatctgtctccagggcgttcagacattttgaaaagcagcagtttaaggaggaaggctacaaatggggaaagcacaagctctgtggtgtttatgccatattctatgatataacaagggtttagaacaagacttggcaaacaatgggcctgtttttgtgaatagttttagtggacacagccatactatttttgcgttggtgtcacctgtggctgtggctgcgctacagtggcagagtggtatacttgcaacagggccatatggtctgcaaagtgtaaaatatttactcttgggccctttacaaaaaagtttgctattagtttagaaaatctatgatagaagaaacttaaaaatattagaaatggattggtcttcaccttattctctcctgcacaaaataaggccaggtgtggtagtgcacacctgtagtccctgctacttgggaggctgaggtgggaggataacttgagcctaggaatttaggctgtgatcacactgtgaccacaccactgcactccagcctgggcgacagtgagactgcttctc

SEQ ID NO: 456056 - DNA, 2422 bp, Homo sapiens
  misc_feature (2390)..(2390): n is a, c, g, or t
cgggtctgatagtccctacctgtcaggactggtgttaggatgagataatgtttgtgaactgtaaacatatataaacgtgtgctactgtgagaactggaacaaagaagagagggagtgagagaaatcaagggagggctggggctgggaaagaacgaaaagggagtcgcgtatagaggagagcgcgacagtcgcgagccacactttgcaatgaaactctttagactttctgccgggagagcggcccagacgcgccaggtctgtagcaggaggccgcgcgagggcgggtccccagaagcctacaggtgagtatcggttctccccttcccggctttcggtccggaggaggcgggagcagcttccctgttctgatcctatcgcgggcggcgcagggccggcttggccttccgtgggacggggaggggggcgggatgtgtcacccaaataccagtggggacggtcggtggtggaaccagccgggcaggtcgggtagagtataagagccggagggagcggccgggcggcagacgcctgcagaccatcccagacgccggagcccgagccccgacgagtccccgcgcctcatccgcccgcgtccggtccgcgttcctccgccccaccatggctcggggccccggcctcgcgccgccaccgctgcggctgccgctgctgctgctggtgctggcggcggtgaccggccacacggccgcgcaggacaactgcacgtgtcccaccaacaagatgaccgtgtgcagccccgacggccccggcggccgctgccagtgccgcgcgctgggctcgggcatggcggtcgactgctccacgctgacctccaagtgtctgctgctcaaggcgcgcatgagcgcccccaagaacgcccgcacgctggtgcggccgagtgagcacgcgctcgtggacaacgatggcctctacgaccccgactgcgaccccgagggccgcttcaaggcgcgccagtgcaaccagacgtcggtgtgctggtgcgtgaactcggtgggcgtgcgccgcacggacaagggcgacctgagcctacgctgcgatgagctggtgcgcacccaccacatcctcattgacctgcgccaccgccccaccgccggcgccttcaaccactcagacctggacgccgagctgaggcggctcttccgcgagcgctatcggctgcaccccaagttcgtggcggccgtgcactacgagcagcccaccatccagatcgagctgcggcagaacacgtctcagaaggccgccggtgacgtggatatcggcgatgccgcctactacttcgagagggacatcaagggcgagtctctattccagggccgcggcggcctggacttgcgcgtgcgcggagaacccctgcaggtggagcgcacgctcatctattacctggacgagattcccccgaagttctccatgaagcgcctcaccgccggcctcatcgccgtcatcgtggtggtcgtggtggccctcgtcgccggcatggccgtcctggtgatcaccaaccggagaaagtcggggaagtacaagaaggtggagatcaaggaactgggggagttgagaaaggaaccgagcttgtaggtacccggcggggcaggggatggggtggggtaccggatttcggtatcgtcccagacccaagtgagtcacgcttcctgattcctcggcgcaaaggagacgtttatcctttcaaattcctgccttccccctcccttttgcgcacacaccaggtttaatagatcctggcctcagggtctcctttctttctcacttctgtcttgaaggaagcatttctaaaatgtatcccctttcggtccaacaacaggaaacctgactggggcagtgaaggaagggatggcatagcgttatgtgtaaaaaacaagtatctgtatgacaacccgggatcgtttgcaagtaactgaatccattgcgacattgtgaaggcttaaatgagtttagatgggaaatagcgttgttatcgccttgggtttaaattatttgatgagttccacttgtatcatggcctacccgaggagaagaggagtttgttaactgggcctatgtagtagcctcatttaccatcgtttgtattactgaccacatatgcttgtcactgggaaagaagcctgtttcagctgcctgaacgcagtttggatgtctttgaggacagacattgcccggaaactcagtctatttattcttcagcttgcccttactgccactgatattggtaatgttcttttttgtaaaatgtttgtacatatgttgtctttgataatgttgctgtaattttttaaaataaaacacgaatttaaatgaggctactacataggcccagttaacaaactcctcttctcctcgggtaggccatgatacaagtngaactcatcaaataatttaaacccagtcgagc

SEQ ID NO: 456057 - DNA, 1886 bp, Homo sapiens
cgggtctgatagtccctacctgtcaggactggtgttaggatgagataatgtttgtgaactgtaaacatatataaacgtgtgctactgtgagaactggaacaaagaagagagggagtgagagaaatcaagggagggctggggctgggaaagaacgaaaagggagtcgcgtatagaggagagcgcgacagtcgcgagccacactttgcaatgaaactctttagactttctgccgggagagcggcccagacgcgccaggtctgtagcaggaggccgcgcgagggcgggtccccagaagcctacagatcgagctgcggcagaacacgtctcagaaggccgccggtgacgtggatatcggcgatgccgcctactacttcgagagggacatcaagggcgagtctctattccagggccgcggcggcctggacttgcgcgtgcgcggagaacccctgcaggtggagcgcacgctcatctattacctggacgagattcccccgaagttctccatgaagcgcctcaccgccggcctcatcgccgtcatcgtggtggtcgtggtggccctcgtcgccggcatggccgtcctggtgatcaccaaccggagaaagtcggggaagtacaagaaggtggagatcaaggaactgggggagttgagaaaggaaccgagcttgtaggtacccggcggggcaggggatggggtggggtaccggatttcggtatcgtcccagacccaagtgagtcacgcttcctgattcctcggcgcaaaggagacgtttatcctttcaaattcctgccttccccctcccttttgcgcacacaccaggtttaatagatcctggcctcagggtctcctttctttctcacttctgtcttgaaggaagcatttctaaaatgtatcccctttcggtccaacaacaggaaacctgactggggcagtgaaggaagggatggcatagcgttatgtgtaaaaaacaagtatctgtatgacaacccgggatcgtttgcaagtaactgaatccattgcgacattgtgaaggcttaaatgagtttagatgggaaatagcgttgttatcgccttgggtttaaattatttgatgagttccacttgtatcatggcctacccgaggagaagaggagtttgttaactgggcctatgtagtagcctcatttaccatcgtttgtattactgaccacatatgcttgtcactgggaaagaagcctgtttcagctgcctgaacgcagtttggatgtctttgaggacagacattgcccggaaactcagtctatttattcttcagcttgcccttactgccactgatattggtaatgttcttttttgtaaaatgtttgtacatatgttgtctttgataatgttgctgtaattttttaaaataaaacacgaatttaataaaatatgggaaaggcacaaaccagaagtcggcatttgtgaaaagtccctccagatttctatcactttggtctctaatttcccaagacttgtattttttttttatttcaaattataacacttttttttcccccagaagtgggtgtttcatgttgctactctggtgtgtcccaagatatcctaactggccagtgtaaatgctattctttctaaataagattatttggaaacttccttcaaactgcaggagggcgagctctgagggcacgagaagctaaaactagctgcttttgatgaaaaagagtgccagtctttggtcatctctaaacaaggcttatcaccaatggagacagaaaactctagttcaagagctgtacctcctttgaatcccagccctactcgaaataagtggtactatttccatttagcctttgagcaaatcacttaactcaaaggcgttgtggctctaagattaaacgacttt

SEQ ID NO: 456058 - DNA, 2360 bp, Homo sapiens
  misc_feature (2328)..(2328): n is a, c, g, or t
cgggtctgatagtccctacctgtcaggactggtgttaggatgagataatgtttgtgaactgtaaacatatataaacgtgtgctactgtgagaactggaacaaagaagagagggagtgagagaaatcaagggagggctggggctgggaaagaacgaaaagggagtcgcgtatagaggagagcgcgacagtcgcgagccacactttgcaatgaaactctttagactttctgccgggagagcggcccagacgcgccaggtctgtagcaggaggccgcgcgagggcgggtccccagaagcctacaggtgagtatcggttctccccttcccggctttcggtccggaggaggcgggagcagcttccctgttctgatcctatcgcgggcggcgcagggccggcttggccttccgtgggacggggaggggggcgggatgtgtcacccaaataccagtggggacggtcggtggtggaaccagccgggcaggtcgggtagagtataagagccggagggagcggccgggcggcagacgcctgcagaccatcccagacgccggagcccgagccccgacgagtccccgcgcctcatccgcccgcgtccggtccgcgttcctccgccccaccatggctcggggccccggcctcgcgccgccaccgctgcggctgccgctgctgctgctggtgctggcggcggtgaccggccacacggccgcgcaggacaactgcacgtgtcccaccaacaagatgaccgtgtgcagccccgacggccccggcggccgctgccagtgccgcgcgctgggctcgggcatggcggtcgactgctccacgctgacctccaagtgtctgctgctcaaggcgcgcatgagcgcccccaagaacgcccgcacgctggtgcggccgagtgagcacgcgctcgtggacaacgatggcctctacgaccccgactgcgaccccgagggccgcttcaaggcgcgccagtgcaaccagacgtcggtgtgctggtgcgtgaactcggtgggcgtgcgccgcacggacaagggcgacctgagcctacgctgcgatgagctggtgcgcacccaccacatcctcattgacctgcgccaccgccccaccgccggcgccttcaaccactcagacctggacgccgagctgaggcggctcttccgcgagcgctatcggctgcaccccaagttcgtggcggccgtgcactacgagcagcccaccatccagatcgagctgcggcagaacacgtctcagaaggccgccggtgacgtggatatcggcgatgccgcctactacttcgagagggacatcaagggcgagtctctattccagggccgcggcggcctggacttgcgcgtgcgcggagaacccctgcaggtggagcgcacgctcatctattacctggacgagattcccccgaagttctccatgaagcgcctcaccgccggcctcatcgccgtcatcgtggtggtcgtggtggccctcgtcgccggcatggccgtcctggtgatcaccaaccggagaaagtcggggaagtacaagaaggtggagatcaaggaactgggggagttgagaaaggaaccgagcttgtaggtacccggcggggcaggggatggggtggggtaccggatttcggtatcgtcccagacccaagtgagtcacgcttcctgattcctcggcgcaaaggagacgtttatcctttcaaattcctgccttccccctcccttttgcgcacacaccaggtttaatagatcctggcctcagggtctcctttctttctcacttctgtcttgaaggaagcatttctaaaatgtatcccctttcggtccaacaacaggaaacctgactggggcagtgaaggaagggatggcatagcgttatgtgtaaaaaacaagtatctgtatgacaacccgggatcgtttgcaagtaactgaatccattgcgacattgtgaaggcttaaatgagtttagatgggaaatagcgttgttatcgccttgggtttaaattatttgatgagttccacttgtatcatggcctacccgaggagaagaggagtttgttaactgggcctatgtagtagcctcatttaccatcgtttgtattactgaccacatatgcttgtcactgggaaagaagcctgtttcagctgcctgaacgcagtttggatgtctttgaggacagacattgcccggaaactcagtctatttattcttcagcttgcccttactgccactgatattggtcagtaatacaaacgatggtaaatgaggctactacataggcccagttaacaaactcctcttctcctcgggtaggccatgatacaagtngaactcatcaaataatttaaacccagtcgagc

SEQ ID NO: 456059 - DNA, 841 bp, Homo sapiens
tactactactaaattcgcggccgcgtcgactttaaattatttgatgagttccacttgtatcatggcctacccgaggagaagaggagtttgttaactgggcctatgtagtagcctcatttaccatcgtttgtattactgaccacatatgcttgtcactgggaaagaagcctgtttcagctgcctgaacgcagtttggatgtctttgaggacagacattgcccggaaactcagtctatttattcttcagcttgcccttactgccactgatattggtaatgttcttttttgtaaaatgtttgtacatatgttgtctttgataatgttgctgtaattttttaaaataaaacacgaatttaataaaatatgggaaaggcacaaaccagaagtcggcatttgtgaaaagtccctccagatttctatcactttggtctctaatttcccaagacttgtattttttttttatttcaaattataacacttttttttcccccagaagtgggtgtttcatgttgctactctggtgtgtcccaagatatcctaactggccagtgtaaatgctattctttctaaataagattatttggaaacttccttcaaactgcaggagggcgagctctgagggcacgagaagctaaaactagctgcttttgatgaaaaagagtgccagtctttggtcatctctaaacaaggcttatcaccaatggagacagaaaactctagttcaagagctgtacctcctttgaatcccagccctactcgaaataagtggtactatttccatttagcctttgagcaaatcacttaactcaaaggcgttgtggctctaagattaaacgacttt

SEQ ID NO: 456060 - DNA, 2808 bp, Homo sapiens
cgggtctgatagtccctacctgtcaggactggtgttaggatgagataatgtttgtgaactgtaaacatatataaacgtgtgctactgtgagaactggaacaaagaagagagggagtgagagaaatcaagggagggctggggctgggaaagaacgaaaagggagtcgcgtatagaggagagcgcgacagtcgcgagccacactttgcaatgaaactctttagactttctgccgggagagcggcccagacgcgccaggtctgtagcaggaggccgcgcgagggcgggtccccagaagcctacaggtgagtatcggttctccccttcccggctttcggtccggaggaggcgggagcagcttccctgttctgatcctatcgcgggcggcgcagggccggcttggccttccgtgggacggggaggggggcgggatgtgtcacccaaataccagtggggacggtcggtggtggaaccagccgggcaggtcgggtagagtataagagccggagggagcggccgggcggcagacgcctgcagaccatcccagacgccggagcccgagccccgacgagtccccgcgcctcatccgcccgcgtccggtccgcgttcctccgccccaccatggctcggggccccggcctcgcgccgccaccgctgcggctgccgctgctgctgctggtgctggcggcggtgaccggccacacggccgcgcaggacaactgcacgtgtcccaccaacaagatgaccgtgtgcagccccgacggccccggcggccgctgccagtgccgcgcgctgggctcgggcatggcggtcgactgctccacgctgacctccaagtgtctgctgctcaaggcgcgcatgagcgcccccaagaacgcccgcacgctggtgcggccgagtgagcacgcgctcgtggacaacgatggcctctacgaccccgactgcgaccccgagggccgcttcaaggcgcgccagtgcaaccagacgtcggtgtgctggtgcgtgaactcggtgggcgtgcgccgcacggacaagggcgacctgagcctacgctgcgatgagctggtgcgcacccaccacatcctcattgacctgcgccaccgccccaccgccggcgccttcaaccactcagacctggacgccgagctgaggcggctcttccgcgagcgctatcggctgcaccccaagttcgtggcggccgtgcactacgagcagcccaccatccagatcgagctgcggcagaacacgtctcagaaggccgccggtgacgtggatatcggcgatgccgcctactacttcgagagggacatcaagggcgagtctctattccagggccgcggcggcctggacttgcgcgtgcgcggagaacccctgcaggtggagcgcacgctcatctattacctggacgagattcccccgaagttctccatgaagcgcctcaccgccggcctcatcgccgtcatcgtggtggtcgtggtggccctcgtcgccggcatggccgtcctggtgatcaccaaccggagaaagtcggggaagtacaagaaggtggagatcaaggaactgggggagttgagaaaggaaccgagcttgtaggtacccggcggggcaggggatggggtggggtaccggatttcggtatcgtcccagacccaagtgagtcacgcttcctgattcctcggcgcaaaggagacgtttatcctttcaaattcctgccttccccctcccttttgcgcacacaccaggtttaatagatcctggcctcagggtctcctttctttctcacttctgtcttgaaggaagcatttctaaaatgtatcccctttcggtccaacaacaggaaacctgactggggcagtgaaggaagggatggcatagcgttatgtgtaaaaaacaagtatctgtatgacaacccgggatcgtttgcaagtaactgaatccattgcgacattgtgaaggcttaaatgagtttagatgggaaatagcgttgttatcgccttgggtttaaattatttgatgagttccacttgtatcatggcctacccgaggagaagaggagtttgttaactgggcctatgtagtagcctcatttaccatcgtttgtattactgaccacatatgcttgtcactgggaaagaagcctgtttcagctgcctgaacgcagtttggatgtctttgaggacagacattgcccggaaactcagtctatttattcttcagcttgcccttactgccactgatattggtaatgttcttttttgtaaaatgtttgtacatatgttgtctttgataatgttgctgtaattttttaaaataaaacacgaatttaataaaatatgggaaaggcacaaaccagaagtcggcatttgtgaaaagtccctccagatttctatcactttggtctctaatttcccaagacttgtattttttttttatttcaaattataacacttttttttcccccagaagtgggtgtttcatgttgctactctggtgtgtcccaagatatcctaactggccagtgtaaatgctattctttctaaataagattatttggaaacttccttcaaactgcaggagggcgagctctgagggcacgagaagctaaaactagctgcttttgatgaaaaagagtgccagtctttggtcatctctaaacaaggcttatcaccaatggagacagaaaactctagttcaagagctgtacctcctttgaatcccagccctactcgaaataagtggtactatttccatttagcctttgagcaaatcacttaactcaaaggcgttgtggctctaagattaaacgacttt

SEQ ID NO: 456061 - DNA, 2467 bp, Homo sapiens
cgggtctgatagtccctacctgtcaggactggtgttaggatgagataatgtttgtgaactgtaaacatatataaacgtgtgctactgtgagaactggaacaaagaagagagggagtgagagaaatcaagggagggctggggctgggaaagaacgaaaagggagtcgcgtatagaggagagcgcgacagtcgcgagccacactttgcaatgaaactctttagactttctgccgggagagcggcccagacgcgccaggtctgtagcaggaggccgcgcgagggcgggtccccagaagcctacaggtgagtatcggttctccccttcccggctttcggtccggaggaggcgggagcagcttccctgttctgatcctatcgcgggcggcgcagggccggcttggccttccgtgggacggggaggggggcgggatgtgtcacccaaataccagtggggacggtcggtggtggaaccagccgggcaggtcgggtagagtataagagccggagggagcggccgggcggcagacgcctgcagaccatcccagacgccggagcccgagccccgacgagtccccgcgcctcatccgcccgcgtccggtccgcgttcctccgccccaccatggctcggggccccggcctcgcgccgccaccgctgcggctgccgctgctgctgctggtgctggcggcggtgaccggccacacggccgcgcaggacaactgcacgtgtcccaccaacaagatgaccgtgtgcagccccgacggccccggcggccgctgccagtgccgcgcgctgggctcgggcatggcggtcgactgctccacgctgacctccaagtgtctgctgctcaaggcgcgcatgagcgcccccaagaacgcccgcacgctggtgcggccgagtgagcacgcgctcgtggacaacgatggcctctacgaccccgactgcgaccccgagggccgcttcaaggcgcgccagtgcaaccagacgtcggtgtgctggtgcgtgaactcggtgggcgtgcgccgcacggacaagggcgacctgagcctacgctgcgatgagctggtgcgcacccaccacatcctcattgacctgcgccaccgccccaccgccggcgccttcaaccactcagacctggacgccgagctgaggcggctcttccgcgagcgctatcggctgcaccccaagttcgtggcggccgtgcactacgagcagcccaccatccagatcgagctgcggcagaacacgtctcagaaggccgccggtgacgtggatatcggcgatgccgcctactacttcgagagggacatcaagggcgagtctctattccagggccgcggcggcctggacttgcgcgtgcgcggagaacccctgcaggtggagcgcacgctcatctattacctggacgagattcccccgaagttctccatgaagcgcctcaccgccggcctcatcgccgtcatcgtggtggtcgtggtggccctcgtcgccggcatggccgtcctggtgatcaccaaccggagaaagtcggggaagtacaagaaggtggagatcaaggaactgggggagttgagaaaggaaccgagcttgtaggtacccggcggggcaggggatggggtggggtaccggatttcggtatcgtcccagacccaagtgagtcacgcttcctgattcctcggcgcaaaggagacgtttatcctttcaaattcctgccttccccctcccttttgcgcacacaccaggtttaatagatcctggcctcagggtctcctttctttctcacttctgtcttgaaggaagcatttctaaaatgtatcccctttcggtccaacaacaggaaacctgactggggcagtgaaggaagggatggcatagcgttatgtgtaaaaaacaagtatctgtatgacaacccgggatcgtttgcaagtaactgaatccattgcgacattgtgaaggcttaaatgagtttagatgggaaatagcgttgttatcgccttgggtttaaattatttgatgagttccacttgtatcatggcctacccgaggagaagaggagtttgttaactgggcctatgtagtagcctcatttaccatcgtttgtattactgaccacatatgcttgtcactgggaaagaagcctgtttcagctgcctgaacgcagtttggatgtctttgaggacagacattgcccggaaactcagtctatttattcttcagcttgcccttactgccactgatattggtaatgttcttttttgtaaaatgtttgtacatatgttgtctttgataatgttgctgtaatttttaattaaccgaattctaattggaagccaaaaaaaaaaaaaaaattgttggcccggcccgaaatttaaacaccttggcgccgcccgataaaggcatgtcagaccggcgaaggtgtgtcccaaaaccgggcggttgaacacgggtggttgttcagccaaacccccgg

SEQ ID NO: 456062 - DNA, 1106 bp, Homo sapiens
ctatacagatatctgctgtgtgctggaaaaattacctgtaattttgcattccaaaagtttaataatgactacatttatttcacaatttgagaatcagttatacacaagatatagttgtaagcacatactcctctaaatatgatttgtttgtacagtagaccaaataagtatgttcagcttagaatatgctccttatggtcatgtgtacaataaataaattatcttaaaacattatcaatattaaggttgatgttttcagaaacatgtaagaaagctagcttttaaaattgactagggaagttctctcaaactgccagtccatgagatattgtatattttctatctgaaaaacttttaatctcagaattctttaaaagagctctccctggggctcccattacttacttgtgactcccagtggaaatcgtacccagcccctcgagaggggctgaatctgttgggagtgggagggtagaaaaaatgctgcagcttcttgtgggtatccttcacacacaaacacccagtgccccaagcactgtgcagtcaaacatcaaccccactcagactttcctccttgggattgagaagcaatggattatagagaaagaaaggtggattagcactccaaaactttgaagagtaattgaccaagacccccaaagccaaagctgtgggcatccccacttccagtataccctgtaccaacacgtaatggctactagatacaggggcactagtacctacctgtctgcttggctacctgccctctttgcagaagtggtgaagggaatcactcaacctcagaaagggaaaatggctttctcattttcagattgaaagaggttggcagtgggtgaggagaataacaggtaaggatctcttttaatatacccatttgaagccaaaacctctgtttagacatacggtattttgaacctggtgattattcattgcccatgtttgtgaattatcagaaagcagaattcttgccaggcatagtggctcatgcctgtaatcccagcactttgggaagccaaggtgggaggatcacttgagcccaggagtttgagaccagcctgagcaacatggtgagatcctgtctctac

SEQ ID NO: 456063 - DNA, 3179 bp, Homo sapiens
cgcctcccgccccgcgtcgcgacgtagcacttccgtttttgctgggtaggcgacccggacggagggccggcgaggtgcggggtctggtgatgcgagctgcgcctctcggcaagatttcgcgctgcccatcccgggccctttcatcagtaatcggtagtggatcactctgccaagcggcaggaagaattaaggaaacgacaaggagacgctcggctctctcccgcttggctccttgcggcctcctcttcccttcgctccggcccggtgaaactgaacttataatcgtcactggattgtaagtacccgaggcgaagagagctcgctgagccctgattttttgagtgtctttgttccgggagagtttgtgagttgaaagtatctctgctgggctttctgggccgaaaaccgttccgggggagccgccatttgctttcctgttccctagctagctagctagctctctccgcgttgtccggcagcggcacctagaggttgggacttggcattgcatctgatttaatgaacttaagtctgtgaataagcctttgtgttaacgactggtattcggtcacagcatatttagagaaaagacttggagcttaaataaaaactaaggcaaaatagacgcttagctgctgatctacagagaacttcttgtaattaaaagatttcaattcatagcaaactggtgttttaaactattgcagtagctggaactttttagtgtaaccagcatttattggagaagtgaatcaccaaggaaattaaagatgagtaaaagcaaagatgatgctcctcacgaactggagagccagtttatcttacgtctgcctccagaatatgcctctactgtgagaagggcagtacagtctggtcatgtcaacctcaaggacagactgacaattgagttacatcctgatgggcgtcatggaatcgtcagagtggaccgtgttccattggcctcaaaattagtagacctgccctgtgttatggaaagcttgaaaaccattgataaaaaaactttttacaagacagctgatatctgtcagatgcttgtatccacagttgatggtgatctctatcctcctgtggaggagccagttgctagcactgatcctaaagcaagcaagaaaaaggataaggacaaagagaaaaagtttatctggaaccacggaattactctgcctctaaagaatgtcaggaagagaaggttccggaagacagcaaagaagaaatatattgaatctccagatgttgaaaaagaagtgaaacgattgctgagtacagatgctgaagctgttagtactcggtgggaaataattgccgaagatgaaacaaaggaggcagaaaatcaaggcctggatatctcttctccaggaatgtctggtcacaggcagggccatgactcattagaacatgatgagcttcgggagatattcaatgacctcagcagcagcagtgaggatgaagatgagacccagcatcaagatgaagaagatataaacatcattgacacggaggaagatctggagagacagctacaggacaagctaaatgaatcagatgaacagcaccaggaaaatgaaggaaccaatcagctggttatgggaattcagaagcagattgacaacatgaaaggcaagctccaagagacccaggacagggcaaaacgacaagaggatctcatcatgaaagtggaaaatctggctctcaagaacagatttcaggctgtactggatgagctcaaacaaaaggaagaccgagaaaaggagcaactcagctctttgcaagaggagctagaatcactcctagagaagtaaaaagaactgatatttaatttcagtcttcagactggtcagcattagaaaattcttggctttattgtactgggtattaagaccttgctcttcctagtccttttaatgctgtgtgttctgttaagttctttcatttgtttgtaattttgtttttcagcaaatttatattgttttgctaggtgttcatcctataagaagcaggattgtataggcagaaaaatgattgtaggaaagttgcaggattagcggaatgtatggttcaaccttaattatagcttcattgcaggactttactgtttctccattttctagaagctgctgttgctgctttgtgatgacgtgagatcaataagaagaacctagtctagagacaatgatgctagtttgcatatgttttcctatgcaatagttgttttcccagttattcaaagcagctttctatatgtagagatgcaaattattaagttgtttccaatacaataaataaaagcatctgtttttcactttaaaaaaaaaaaaaaaaaaaaaaaaaaaaaaaaaaaaaaaaaacaaaaaaaaaaaaaaaaaacaaaaaaaaaaaacaaaaacaaaacaagaggcggccgggcggcgacacagaataagtacccctcctagcgaggggcgagccacatcaagctaacgcagaccagaagagatattttgagaaagagagcaggccacacataatgaagcgatacatcatatcaagcacaaagacagccaggcaggacgagcgatcacaaaaacagcggacgtggacgtagaacacaaaacatccagcaacagacatccacattctagatggaacaaaaggacaccaaaacaagtgcgcgccggagaaggaacaaaaataagggagacaaagaccaaccacacaaagaccaggagactaaccacccaccgacgagagatagtaaacgccatacatagaaggtaggaatacgtagcagtcaaacaccaagcgcaataataccgcgacacgacaaaacaataacagtgcaaccaggacgtcttgactacaaaacacaataaaacacagggggcagggggatagaaataagtagcgaagaagaggaacgacaacaggagaacagagaagaagcagaaaaagaaacaggagaggacatgagaagagagagaagcagaaagaagaaggaaggaggcgcgaaaaccgcgagggacagggaacacaacgaaggagaaagaacaaaacggaagaaagaaggaggcggaagagacaaggccgagagacaagaaacagagagagacgaagacgagagaagagcaaggagaaaagacgaggaagagagagtagacggggcaaaaaaggaagaagaagag

SEQ ID NO: 456064 - DNA, 3130 bp, Homo sapiens
cgcctcccgccccgcgtcgcgacgtagcacttccgtttttgctgggtaggcgacccggacggagggccggcgaggtgcggggtctggtgatgcgagctgcgcctctcggcaagatttcgcgctgcccatcccgggccctttcatcagtaatcggtagtggatcactctgccaagcggcaggaagaattaaggaaacgacaaggagacgctcggctctctcccgcttggctccttgcggcctcctcttcccttcgctccggcccggtgaaactgaacttataatcgtcactggattgtaagtacccgaggcgaagagagctcgctgagccctgattttttgagtgtctttgttccgggagagtttgtgagttgaaagtatctctgctgggctttctgggccgaaaaccgttccgggggagccgccatttgctttcctgttccctagctagctagctagctctctccgcgttgtccggcagcggcacctagaggttgggacttggcattgcatctgatttaatgaacttaagtctgtgaataagcctttgtgttaacgactggtattcggtcacagcatatttagagaaaagacttggagcttaaataaaaactaaggcaaaatagacgcttagctgctgatctacagagaacttcttgtaattaaaagatttcaattcatagcaaactggtgttttaaactattgcagtagctggaactttttagtgtaaccagcatttattggagaagtgaatcaccaaggaaattaaagatgagtaaaagcaaagatgatgctcctcacgaactggagagccagtttatcttacgtctgcctccagaatatgcctctactgtgagaagggcagtacagtctggtcatgtcaacctcaaggacagactgacaattgagttacatcctgatgggcgtcatggaatcgtcagagtggaccgtgttccattggcctcaaaattagtagacctgccctgtgttatggaaagcttgaaaaccattgataaaaaaactttttacaagacagctgatatctgtcagatgcttgtatccacagttgatggtgatctctatcctcctgtggaggagccagttgctagcactgatcctaaagcaagcaagaaaaaggataaggacaaagagaaaaagtttatctggaaccacggaattactctgcctctaaagaatgtcaggaagagaaggttccggaagacagcaaagaagaaatatattgaatctccagatgttgaaaaagaagtgaaacgattgctgagtacagatgctgaagctgttagtactcggtgggaaataattgccgaagatgaaacaaaggaggcagaaaatcaaggcctggatatctcttctccaggaatgtctggtcacaggcagggccatgactcattagaacatgatgagcttcgggagatattcaatgacctcagcagcagcagtgaggatgaagatgagacccagcatcaagatgaagaagatataaacatcattgacacggaggaagatctggagagacagctacaggacaagctaaatgaatcagatgaacagcaccaggaaaaatgaaaggcaagctccaagagacccaggacagggcaaaacgacaagaggatctcatcatgaaagtggaaaatctggctctcaagaacagatttcaggctgtactggatgagctcaaacaaaaggaagaccgagaaaaggagcaactcagctctttgcaagaggagctagaatcactcctagagaagtaaaaagaactgatatttaatttcagtcttcagactggtcagcattagaaaattcttggctttattgtactgggtattaagaccttgctcttcctagtccttttaatgctgtgtgttctgttaagttctttcatttgtttgtaattttgtttttcagcaaatttatattgttttgctaggtgttcatcctataagaagcaggattgtataggcagaaaaatgattgtaggaaagttgcaggattagcggaatgtatggttcaaccttaattatagcttcattgcaggactttactgtttctccattttctagaagctgctgttgctgctttgtgatgacgtgagatcaataagaagaacctagtctagagacaatgatgctagtttgcatatgttttcctatgcaatagttgttttcccagttattcaaagcagctttctatatgtagagatgcaaattattaagttgtttccaatacaataaataaaagcatctgtttttcactttaaaaaaaaaaaaaaaaaaaaaaaaaaaaaaaaaaaaaaaaaacaaaaaaaaaaaaaaaaaacaaaaaaaaaaaacaaaaacaaaacaagaggcggccgggcggcgacacagaataagtacccctcctagcgaggggcgagccacatcaagctaacgcagaccagaagagatattttgagaaagagagcaggccacacataatgaagcgatacatcatatcaagcacaaagacagccaggcaggacgagcgatcacaaaaacagcggacgtggacgtagaacacaaaacatccagcaacagacatccacattctagatggaacaaaaggacaccaaaacaagtgcgcgccggagaaggaacaaaaataagggagacaaagaccaaccacacaaagaccaggagactaaccacccaccgacgagagatagtaaacgccatacatagaaggtaggaatacgtagcagtcaaacaccaagcgcaataataccgcgacacgacaaaacaataacagtgcaaccaggacgtcttgactacaaaacacaataaaacacagggggcagggggatagaaataagtagcgaagaagaggaacgacaacaggagaacagagaagaagcagaaaaagaaacaggagaggacatgagaagagagagaagcagaaagaagaaggaaggaggcgcgaaaaccgcgagggacagggaacacaacgaaggagaaagaacaaaacggaagaaagaaggaggcggaagagacaaggccgagagacaagaaacagagagagacgaagacgagagaagagcaaggagaaaagacgaggaagagagagtagacggggcaaaaaaggaagaagaagag

SEQ ID NO: 456065 - DNA, 3162 bp, Homo sapiens
tatttcattcacgggactgcgtttccttgctacgattcgcaggcccttggcctgtatcaattatacatggtgatgcgagctgcgcctctcggcaagatttcgcgctgcccatcccgggccctttcatcagtaatcggtagtggatcactctgccaagcggcaggaagaattaaggaaacgacaaggagacgctcggctctctcccgcttggctccttgcggcctcctcttcccttcgctccggcccggtgaaactgaacttataatcgtcactggattgtaagtacccgaggcgaagagagctcgctgagccctgattttttgagtgtctttgttccgggagagtttgtgagttgaaagtatctctgctgggctttctgggccgaaaaccgttccgggggagccgccatttgctttcctgttccctagctagctagctagctctctccgcgttgtccggcagcggcacctagaggttgggacttggcattgcatctgatttaatgaacttaagtctgtgaataagcctttgtgttaacgactggtattcggtcacagcatatttagagaaaagacttggagcttaaataaaaactaaggcaaaatagacgcttagctgctgatctacagagaacttcttgtaattaaaagatttcaattcatagcaaactggtgttttaaactattgcagtagctggaactttttagtgtaaccagcatttattggagaagtgaatcaccaaggaaattaaagatgagtaaaagcaaagatgatgctcctcacgaactggagagccagtttatcttacgtctgcctccagaatatgcctctactgtgagaagggcagtacagtctggtcatgtcaacctcaaggacagactgacaattgagttacatcctgatgggcgtcatggaatcgtcagagtggaccgtgttccattggcctcaaaattagtagacctgccctgtgttatggaaagcttgaaaaccattgataaaaaaactttttacaagacagctgatatctgtcagatgcttgtatccacagttgatggtgatctctatcctcctgtggaggagccagttgctagcactgatcctaaagcaagcaagaaaaaggataaggacaaagagaaaaagtttatctggaaccacggaattactctgcctctaaagaatgtcaggaagagaaggttccggaagacagcaaagaagaaatatattgaatctccagatgttgaaaaagaagtgaaacgattgctgagtacagatgctgaagctgttagtactcggtgggaaataattgccgaagatgaaacaaaggaggcagaaaatcaaggcctggatatctcttctccaggaatgtctggtcacaggcagggccatgactcattagaacatgatgagcttcgggagatattcaatgacctcagcagcagcagtgaggatgaagatgagacccagcatcaagatgaagaagatataaacatcattgacacggaggaagatctggagagacagctacaggacaagctaaatgaatcagatgaacagcaccaggaaaatgaaggaaccaatcagctggttatgggaattcagaagcagattgacaacatgaaaggcaagctccaagagacccaggacagggcaaaacgacaagaggatctcatcatgaaagtggaaaatctggctctcaagaacagatttcaggctgtactggatgagctcaaacaaaaggaagaccgagaaaaggagcaactcagctctttgcaagaggagctagaatcactcctagagaagtaaaaagaactgatatttaatttcagtcttcagactggtcagcattagaaaattcttggctttattgtactgggtattaagaccttgctcttcctagtccttttaatgctgtgtgttctgttaagttctttcatttgtttgtaattttgtttttcagcaaatttatattgttttgctaggtgttcatcctataagaagcaggattgtataggcagaaaaatgattgtaggaaagttgcaggattagcggaatgtatggttcaaccttaattatagcttcattgcaggactttactgtttctccattttctagaagctgctgttgctgctttgtgatgacgtgagatcaataagaagaacctagtctagagacaatgatgctagtttgcatatgttttcctatgcaatagttgttttcccagttattcaaagcagctttctatatgtagagatgcaaattattaagttgtttccaatacaataaataaaagcatctgtttttcactttaaaaaaaaaaaaaaaaaaaaaaaaaaaaaaaaaaaaaaaaaacaaaaaaaaaaaaaaaaaacaaaaaaaaaaaacaaaaacaaaacaagaggcggccgggcggcgacacagaataagtacccctcctagcgaggggcgagccacatcaagctaacgcagaccagaagagatattttgagaaagagagcaggccacacataatgaagcgatacatcatatcaagcacaaagacagccaggcaggacgagcgatcacaaaaacagcggacgtggacgtagaacacaaaacatccagcaacagacatccacattctagatggaacaaaaggacaccaaaacaagtgcgcgccggagaaggaacaaaaataagggagacaaagaccaaccacacaaagaccaggagactaaccacccaccgacgagagatagtaaacgccatacatagaaggtaggaatacgtagcagtcaaacaccaagcgcaataataccgcgacacgacaaaacaataacagtgcaaccaggacgtcttgactacaaaacacaataaaacacagggggcagggggatagaaataagtagcgaagaagaggaacgacaacaggagaacagagaagaagcagaaaaagaaacaggagaggacatgagaagagagagaagcagaaagaagaaggaaggaggcgcgaaaaccgcgagggacagggaacacaacgaaggagaaagaacaaaacggaagaaagaaggaggcggaagagacaaggccgagagacaagaaacagagagagacgaagacgagagaagagcaaggagaaaagacgaggaagagagagtagacggggcaaaaaaggaagaagaagag

SEQ ID NO: 456066 - DNA, 2639 bp, Homo sapiens
cgcctcccgccccgcgtcgcgacgtagcacttccgtttttgctgggtaggcgacccggacggagggccggcgaggtgcggggtctggtgatgcgagctgcgcctctcggcaagatttcgcgctgcccatcccgggccctttcatcagtaatcggtagtggatcactctgccaagcggcaggaagaattaaggaaacgacaaggagacgctcggctctctcccgcttggctccttgcggcctcctcttcccttcgctccggcccggtgaaactgaacttataatcgtcactggattgtaagtacccgaggcgaagagagctcgctgagccctgattttttgagtgtctttgttccgggagagtttgtgagttgaaagtatctctgctgggctttctgggccgaaaaccgttccgggggagccgccatttgctttcctgttccctagctagctagctagctctctccgcgttgtccggcagcggcacctagaggttgggacttggcattgcatctgatttaatgaacttaagtctgtgaataagcctttgtgttaacgactggtattcggtcacagcatatttagagaaaagacttggagcttaaataaaaactaaggcaaaatagacgcttagctgctgatctacagagaacttcttgtaattaaaagatttcaattcatagcaaactggtgttttaaactattgcagtagctggaactttttagtgtaaccagcatttattggagaagtgaatcaccaaggaaattaaagatgagtaaaagcaaagatgatgctcctcacgaactggagagccagtttatcttacgtctgcctccagaatatgcctctactgtgagaagggcagtacagtctggtcatgtcaacctcaaggacagactgacaattgagttacatcctgatgggcgtcatggaatcgtcagagtggaccgtgttccattggcctcaaaattagtagacctgccctgtgttatggaaagcttgaaaaccattgataaaaaaactttttacaagacagctgatatctgtcagatgcttgtatccacagttgatggtgatctctatcctcctgtggaggagccagttgctagcactgatcctaaagcaagcaagaaaaaggataaggacaaagagaaaaagtttatctggaaccacggaattactctgcctctaaagaatgtcaggaagagaaggttccggaagacagcaaagaagaaatatattgaatctccagatgttgaaaaagaagtgaaacgattgctgagtacagatgctgaagctgttagtactcggtgggaaataattgccgaagatgaaacaaaggaggcagaaaatcaaggcctggatatctcttctccaggaatgtctggtcacaggcagggccatgactcattagaacatgatgagcttcgggagatattcaatgacctcagcagcagcagtgaggatgaagatgagacccagcatcaagatgaaaaaatgattgtaggaaagttgcaggattagcggaatgtatggttcaaccttaattatagcttcattgcaggactttactgtttctccattttctagaagctgctgttgctgctttgtgatgacgtgagatcaataagaagaacctagtctagagacaatgatgctagtttgcatatgttttcctatgcaatagttgttttcccagttattcaaagcagctttctatatgtagagatgcaaattattaagttgtttccaatacaataaataaaagcatctgtttttcactttaaaaaaaaaaaaaaaaaaaaaaaaaaaaaaaaaaaaaaaaaacaaaaaaaaaaaaaaaaaacaaaaaaaaaaaacaaaaacaaaacaagaggcggccgggcggcgacacagaataagtacccctcctagcgaggggcgagccacatcaagctaacgcagaccagaagagatattttgagaaagagagcaggccacacataatgaagcgatacatcatatcaagcacaaagacagccaggcaggacgagcgatcacaaaaacagcggacgtggacgtagaacacaaaacatccagcaacagacatccacattctagatggaacaaaaggacaccaaaacaagtgcgcgccggagaaggaacaaaaataagggagacaaagaccaaccacacaaagaccaggagactaaccacccaccgacgagagatagtaaacgccatacatagaaggtaggaatacgtagcagtcaaacaccaagcgcaataataccgcgacacgacaaaacaataacagtgcaaccaggacgtcttgactacaaaacacaataaaacacagggggcagggggatagaaataagtagcgaagaagaggaacgacaacaggagaacagagaagaagcagaaaaagaaacaggagaggacatgagaagagagagaagcagaaagaagaaggaaggaggcgcgaaaaccgcgagggacagggaacacaacgaaggagaaagaacaaaacggaagaaagaaggaggcggaagagacaaggccgagagacaagaaacagagagagacgaagacgagagaagagcaaggagaaaagacgaggaagagagagtagacggggcaaaaaaggaagaagaagag

SEQ ID NO: 456067 - DNA, 2350 bp, Homo sapiens
cgcctcccgccccgcgtcgcgacgtagcacttccgtttttgctgggtaggcgacccggacggagggccggcgaggtgcggggtctggtgatgcgagctgcgcctctcggcaagatttcgcgctgcccatcccgggccctttcatcagtaatcggtagtggatcactctgccaagcggcaggaagaattaaggaaacgacaaggagacgctcggctctctcccgcttggctccttgcggcctcctcttcccttcgctccggcccggtgaaactgaacttataatcgtcactggattgtaagtacccgaggcgaagagagctcgctgagccctgattttttgagtgtctttgttccgggagagtttgtgagttgaaagtatctctgctgggctttctgggccgaaaaccgttccgggggagccgccatttgctttcctgttccctagctagctagctagctctctccgcgttgtccggcagcggcacctagaggttgggacttggcattgcatctgatttaatgaacttaagtctgtgaataagcctttgtgttaacgactggtattcggtcacagcatatttagagaaaagacttggagcttaaataaaaactaaggcaaaatagacgcttagctgctgatctacagagaacttcttgtaattaaaagatttcaattcatagcaaactggtgttttaaactattgcagtagctggaactttttagtgtaaccagcatttattggagaagtgaattgaaggaaccaatcagctggttatgggaattcagaagcagattgacaacatgaaaggcaagctccaagagacccaggacagggcaaaacgacaagaggatctcatcatgaaagtggaaaatctggctctcaagaacagatttcaggctgtactggatgagctcaaacaaaaggaagaccgagaaaaggagcaactcagctctttgcaagaggagctagaatcactcctagagaagtaaaaagaactgatatttaatttcagtcttcagactggtcagcattagaaaattcttggctttattgtactgggtattaagaccttgctcttcctagtccttttaatgctgtgtgttctgttaagttctttcatttgtttgtaattttgtttttcagcaaatttatattgttttgctaggtgttcatcctataagaagcaggattgtataggcagaaaaatgattgtaggaaagttgcaggattagcggaatgtatggttcaaccttaattatagcttcattgcaggactttactgtttctccattttctagaagctgctgttgctgctttgtgatgacgtgagatcaataagaagaacctagtctagagacaatgatgctagtttgcatatgttttcctatgcaatagttgttttcccagttattcaaagcagctttctatatgtagagatgcaaattattaagttgtttccaatacaataaataaaagcatctgtttttcactttaaaaaaaaaaaaaaaaaaaaaaaaaaaaaaaaaaaaaaaaaacaaaaaaaaaaaaaaaaaacaaaaaaaaaaaacaaaaacaaaacaagaggcggccgggcggcgacacagaataagtacccctcctagcgaggggcgagccacatcaagctaacgcagaccagaagagatattttgagaaagagagcaggccacacataatgaagcgatacatcatatcaagcacaaagacagccaggcaggacgagcgatcacaaaaacagcggacgtggacgtagaacacaaaacatccagcaacagacatccacattctagatggaacaaaaggacaccaaaacaagtgcgcgccggagaaggaacaaaaataagggagacaaagaccaaccacacaaagaccaggagactaaccacccaccgacgagagatagtaaacgccatacatagaaggtaggaatacgtagcagtcaaacaccaagcgcaataataccgcgacacgacaaaacaataacagtgcaaccaggacgtcttgactacaaaacacaataaaacacagggggcagggggatagaaataagtagcgaagaagaggaacgacaacaggagaacagagaagaagcagaaaaagaaacaggagaggacatgagaagagagagaagcagaaagaagaaggaaggaggcgcgaaaaccgcgagggacagggaacacaacgaaggagaaagaacaaaacggaagaaagaaggaggcggaagagacaaggccgagagacaagaaacagagagagacgaagacgagagaagagcaaggagaaaagacgaggaagagagagtagacggggcaaaaaaggaagaagaagag

SEQ ID NO: 456068 - DNA, 1852 bp, Homo sapiens
tatttcattcacgggactgcgtttccttgctacgattcgcaggcccttggcctgtatcaattatacatggtgatgcgagctgcgcctctcggcaagatttcgcgctgcccatcccgggccctttcatcagtaatcggtagtggatcactctgccaagcggcaggaagaagatataaacatcattgacacggaggaagatctggagagacagctacaggacaagctaaatgaatcagatgaacagcaccaggaaaatgaaggaaccaatcagctggttatgggaattcagaagcagattgacaacatgaaaggcaagctccaagagacccaggacagggcaaaacgacaagaggatctcatcatgaaagtggaaaatctggctctcaagaacagatttcaggctgtactggatgagctcaaacaaaaggaagaccgagaaaaggagcaactcagctctttgcaagaggagctagaatcactcctagagaagtaaaaagaactgatatttaatttcagtcttcagactggtcagcattagaaaattcttggctttattgtactgggtattaagaccttgctcttcctagtccttttaatgctgtgtgttctgttaagttctttcatttgtttgtaattttgtttttcagcaaatttatattgttttgctaggtgttcatcctataagaagcaggattgtataggcagaaaaatgattgtaggaaagttgcaggattagcggaatgtatggttcaaccttaattatagcttcattgcaggactttactgtttctccattttctagaagctgctgttgctgctttgtgatgacgtgagatcaataagaagaacctagtctagagacaatgatgctagtttgcatatgttttcctatgcaatagttgttttcccagttattcaaagcagctttctatatgtagagatgcaaattattaagttgtttccaatacaataaataaaagcatctgtttttcactttaaaaaaaaaaaaaaaaaaaaaaaaaaaaaaaaaaaaaaaaaacaaaaaaaaaaaaaaaaaacaaaaaaaaaaaacaaaaacaaaacaagaggcggccgggcggcgacacagaataagtacccctcctagcgaggggcgagccacatcaagctaacgcagaccagaagagatattttgagaaagagagcaggccacacataatgaagcgatacatcatatcaagcacaaagacagccaggcaggacgagcgatcacaaaaacagcggacgtggacgtagaacacaaaacatccagcaacagacatccacattctagatggaacaaaaggacaccaaaacaagtgcgcgccggagaaggaacaaaaataagggagacaaagaccaaccacacaaagaccaggagactaaccacccaccgacgagagatagtaaacgccatacatagaaggtaggaatacgtagcagtcaaacaccaagcgcaataataccgcgacacgacaaaacaataacagtgcaaccaggacgtcttgactacaaaacacaataaaacacagggggcagggggatagaaataagtagcgaagaagaggaacgacaacaggagaacagagaagaagcagaaaaagaaacaggagaggacatgagaagagagagaagcagaaagaagaaggaaggaggcgcgaaaaccgcgagggacagggaacacaacgaaggagaaagaacaaaacggaagaaagaaggaggcggaagagacaaggccgagagacaagaaacagagagagacgaagacgagagaagagcaaggagaaaagacgaggaagagagagtagacggggcaaaaaaggaagaagaagag

SEQ ID NO: 456069 - DNA, 1213 bp, Homo sapiens
cgcctcccgccccgcgtcgcgacgtagcacttccgtttttgctgggtaggcgacccggacggagggccggcgaggtgcggggtctggtgatgcgagctgcgcctctcggcaagatttcgcgctgcccatcccgggccctttcatcagtaatcggtagtggatcactctgccaagcggcaggaagaattaaggaaacgacaaggagacgctcggctctctcccgcttggctccttgcggcctcctcttcccttcgctccggcccggtgaaactgaacttataatcgtcactggattatggagtctcgcactgtcgtccaggctggaatgcaatggcacgatctcagctcactgcaacctccgcctcctgaattcaaccaattcttctgcctcagcctcctgagtaactgggattacaggccctcgattgattaaatggtgcccagccacgctggatgaggcctgatcttccttactcaacctacggattccaatgtcaatctgttctggactaccctcacagatatatccaaaattaatgctttaccaggtacctgagtatccttaacccagtcaaattgacccataaagttaaccatcacacagtgatttttcatattgtttacaattatagaggctgtcttcggtgtttgttctcacatttctattgaaagaagagggcaaactgtatacttgcccatctttcttacatgcataaagttcctttttggtttattttcatttgaacaggaagttttgaggaataaatgaaggcttttcttcattctctatattgataaatcctctctccaacgttagttcttacatgtacagcaagagatctggaagaaatcaagcctatctcacattcttttatatccatagggtaaattacaatatgagttatcacatatgccctaaaggattaggggcaactcaaggtttttctacatttttatgttaataagatttctcttcagtgagagttttcacatgttttctaaaagattaaagaaaattgaaagctttttcacatttcttatactcataaggcttatctccactgtctactgtgagttcatttttttttttttttttttttgtgagacggagtctcgctctgtcacccaggctggagtgcagtggcatgatcctggctcactacaacctctacctcctgggttcaagcaattctcctgtctcagcctcctgagt

SEQ ID NO: 456070 - DNA, 1267 bp, Homo sapiens
cgcctcccgccccgcgtcgcgacgtagcacttccgtttttgctgggtaggcgacccggacggagggccggcgaggtgcggggtctggtgatgcgagctgcgcctctcggcaagatttcgcgctgcccatcccgggccctttcatcagtaatcggtagtggatcactctgccaagcggcaggaagaattaaggaaacgacaaggagacgctcggctctctcccgcttggctccttgcggcctcctcttcccttcgctccggcccggtgaaactgaacttataatcgtcactggattatggagtctcgcactgtcgtccaggctggaatgcaatggcacgatctcagctcactgcaacctccgcctcctgaattcaaccaattcttctgcctcagcctcctgagtaactgggattacaggccctcgattgattaaatggtgcccagccacgctggatgaggcctgatcttccttactcaacctacggattccaatgtcaatctgttctggactaccctcacagatatatccaaaattaatgctttaccaggtacctgagtatccttaacccagtcaaattgacccataaagttaaccatcacacagtgtttctccaatgtgtattatcacatgagtggtaaaatatgaagaataaatgaaggatttttcatattgtttacaattatagaggctgtcttcggtgtttgttctcacatttctattgaaagaagagggcaaactgtatacttgcccatctttcttacatgcataaagttcctttttggtttattttcatttgaacaggaagttttgaggaataaatgaaggcttttcttcattctctatattgataaatcctctctccaacgttagttcttacatgtacagcaagagatctggaagaaatcaagcctatctcacattcttttatatccatagggtaaattacaatatgagttatcacatatgccctaaaggattaggggcaactcaaggtttttctacatttttatgttaataagatttctcttcagtgagagttttcacatgttttctaaaagattaaagaaaattgaaagctttttcacatttcttatactcataaggcttatctccactgtctactgtgagttcatttttttttttttttttttttgtgagacggagtctcgctctgtcacccaggctggagtgcagtggcatgatcctggctcactacaacctctacctcctgggttcaagcaattctcctgtctcagcctcctgagt

SEQ ID NO: 456071 - DNA, 2372 bp, Homo sapiens
cgcctcccgccccgcgtcgcgacgtagcacttccgtttttgctgggtaggcgacccggacggagggccggcgaggtgcggggtctggtgatgcgagctgcgcctctcggcaagatttcgcgctgcccatcccgggccctttcatcagtaatcggtagtggatcactctgccaagcggcaggaagaattaaggaaacgacaaggagacgctcggctctctcccgcttggctccttgcggcctcctcttcccttcgctccggcccggtgaaactgaacttataatcgtcactggattgtaagtacccgaggcgaagagagctcgctgagccctgattttttgagtgtctttgttccgggagagtttgtgagttgaaagtatctctgctgggctttctgggccgaaaaccgttccgggggagccgccatttgctttcctgttccctagctagctagctagctctctccgcgttgtccggcagcggcacctagaggttgggacttggcattgcatctgatttaatgaacttaagtctgtgaataagcctttgtgttaacgactggtattcggtcacagcatatttagagaaaagacttggagcttaaataaaaactaaggcaaaatagacgcttagctgctgatctacagagaacttcttgtaattaaaagatttcaattcatagcaaactggtgttttaaactattgcagtagctggaactttttagtgtaaccagcatttattggagaagtgaatcaccaaggaaattaaagatgagtaaaagcaaagatgatgctcctcacgaactggagagccagtttatcttacgtctgcctccagaatatgcctctactgtgagaagggcagtacagtctggtcatgtcaacctcaaggacagactgacaattgagttacatcctgatgggcgtcatggaatcgtcagagtggaccgtgttccattggcctcaaaattagtagacctgccctgtgttatggaaagcttgaaaaccattgataaaaaaactttttacaagacagctgatatctgtcagatgcttgtatccacagttgatggtgatctctatcctcctgtggaggagccagttgctagcactgatcctaaagcaagcaagaaaaaggataaggacaaagagaaaaagtttatctggaaccacggaattactctgcctctaaagaatgtcaggaagagaaggttccggaagacagcaaagaagaaatatattgaatctccagatgttgaaaaagaagtgaaacgattgctgagtacagatgctgaagctgttagtactcggtgggaaataattgccgaagatgaaacaaaggaggcagaaaatcaaggcctggatatctcttctccaggaatgtctggtcacaggcagggccatgactcattagaacatgatgagcttcgggagatattcaatgacctcagcagcagcagtgaggatgaagatgagacccagcatcaagatgaagaagatataaacatcattgacacggaggaagatctggagagacagctacaggacaagctaaatgaatcagatgaacagcaccaggaaaatgaaggaaccaatcagctggttatgggaattcagaagcagattgacaacatgaaaggcaagctccaagagacccaggacagggcaaaacgacaagaggatctcatcatgaaagtggaaaatctggctctcaagaacagatttcaggctgtactggatgagctcaaacaaaaggaagaccgagaaaaggagcaactcagctctttgcaagaggagctagaatcactcctagagaagtaaaaagaactgatatttaatttcagtcttcagactggtcagcattagaaaattcttggctttattgtactgggtattaagaccttgctcttcctagtccttttaatgctgtgtgttctgttaagttctttcatttgtttgtaattttgtttttcagcaaatttatattgttttgctaggtgttcatcctataagaagcaggattgtataggcagaaaaatgattgtaggaaagttgcaggattagcggaatgtatggttcaaccttaattatagcttcattgcaggactttactgtttctccattttctagaagctgctgttgctgctttgtgatgacgtgagatcaataagaagaacctagtctagagacaatgatgctagtttgcatatgttttcctatgcaatagttgttttcccagttattcaaagcagctttttttaaagtgaaaaacagatgcttttatttattgtattggaaacaacttaataatttgcatctctacatatagaaagctgctttgaataactgggaaaacaactattgcataggtcg

SEQ ID NO: 456072 - DNA, 2480 bp, Homo sapiens
  misc_feature (38)..(38): n is a, c, g, or t
ttttttgagagggagtctcactctgtcatccaggctgnagtaaagtggtgtgatcaaggctcactgcagcctcaacctcctgggctcaagtgattctatctcagcctcccgagtagctgggattataggcacctaccaccgggcctggttaatatttgtatttttagtagaggtaaagtttcgccgtgttggccaggctggtctcggagttacatcctgatgggcgtcatggaatcgtcagagtggaccgtgttccattggcctcaaaattagtagacctgccctgtgttatggaaagcttgaaaaccattgataaaaaaactttttacaagacagctgatatctgtcagatgcttgtatccacagttgatggtgatctctatcctcctgtggaggagccagttgctagcactgatcctaaagcaagcaagaaaaaggataaggacaaagagaaaaagtttatctggaaccacggaattactctgcctctaaagaatgtcaggaagagaaggttccggaagacagcaaagaagaaatatattgaatctccagatgttgaaaaagaagtgaaacgattgctgagtacagatgctgaagctgttagtactcggtgggaaataattgccgaagatgaaacaaaggaggcagaaaatcaaggcctggatatctcttctccaggaatgtctggtcacaggcagggccatgactcattagaacatgatgagcttcgggagatattcaatgacctcagcagcagcagtgaggatgaagatgagacccagcatcaagatgaagaagatataaacatcattgacacggaggaagatctggagagacagctacaggacaagctaaatgaatcagatgaacagcaccaggaaaatgaaggaaccaatcagctggttatgggaattcagaagcagattgacaacatgaaaggcaagctccaagagacccaggacagggcaaaacgacaagaggatctcatcatgaaagtggaaaatctggctctcaagaacagatttcaggctgtactggatgagctcaaacaaaaggaagaccgagaaaaggagcaactcagctctttgcaagaggagctagaatcactcctagagaagtaaaaagaactgatatttaatttcagtcttcagactggtcagcattagaaaattcttggctttattgtactgggtattaagaccttgctcttcctagtccttttaatgctgtgtgttctgttaagttctttcatttgtttgtaattttgtttttcagcaaatttatattgttttgctaggtgttcatcctataagaagcaggattgtataggcagaaaaatgattgtaggaaagttgcaggattagcggaatgtatggttcaaccttaattatagcttcattgcaggactttactgtttctccattttctagaagctgctgttgctgctttgtgatgacgtgagatcaataagaagaacctagtctagagacaatgatgctagtttgcatatgttttcctatgcaatagttgttttcccagttattcaaagcagctttctatatgtagagatgcaaattattaagttgtttccaatacaataaataaaagcatctgtttttcactttaaaaaaaaaaaaaaaaaaaaaaaaaaaaaaaaaaaaaaaaaacaaaaaaaaaaaaaaaaaacaaaaaaaaaaaacaaaaacaaaacaagaggcggccgggcggcgacacagaataagtacccctcctagcgaggggcgagccacatcaagctaacgcagaccagaagagatattttgagaaagagagcaggccacacataatgaagcgatacatcatatcaagcacaaagacagccaggcaggacgagcgatcacaaaaacagcggacgtggacgtagaacacaaaacatccagcaacagacatccacattctagatggaacaaaaggacaccaaaacaagtgcgcgccggagaaggaacaaaaataagggagacaaagaccaaccacacaaagaccaggagactaaccacccaccgacgagagatagtaaacgccatacatagaaggtaggaatacgtagcagtcaaacaccaagcgcaataataccgcgacacgacaaaacaataacagtgcaaccaggacgtcttgactacaaaacacaataaaacacagggggcagggggatagaaataagtagcgaagaagaggaacgacaacaggagaacagagaagaagcagaaaaagaaacaggagaggacatgagaagagagagaagcagaaagaagaaggaaggaggcgcgaaaaccgcgagggacagggaacacaacgaaggagaaagaacaaaacggaagaaagaaggaggcggaagagacaaggccgagagacaagaaacagagagagacgaagacgagagaagagcaaggagaaaagacgaggaagagagagtagacggggcaaaaaaggaagaagaagag

SEQ ID NO: 456073 - DNA, 2128 bp, Homo sapiens
cttgctttaggatcagtgctagcaacgggcgcctccacaggaggatagagatcaccatcaactgtggatacaagcatctgacagataccagctgtcttgtaaaaagtttatctggaaccacggaattactctgcctctaaagaatgtcaggaagagaaggttccggaagacagcaaagaagaaatatattgaatctccagatgttgaaaaagaagtgaaacgattgctgagtacagatgctgaagctgttagtactcggtgggaaataattgccgaagatgaaacaaaggaggcagaaaatcaaggcctggatatctcttctccaggaatgtctggtcacaggcagggccatgactcattagaacatgatgagcttcgggagatattcaatgacctcagcagcagcagtgaggatgaagatgagacccagcatcaagatgaagaagatataaacatcattgacacggaggaagatctggagagacagctacaggacaagctaaatgaatcagatgaacagcaccaggaaaatgaaggaaccaatcagctggttatgggaattcagaagcagattgacaacatgaaaggcaagctccaagagacccaggacagggcaaaacgacaagaggatctcatcatgaaagtggaaaatctggctctcaagaacagatttcaggctgtactggatgagctcaaacaaaaggaagaccgagaaaaggagcaactcagctctttgcaagaggagctagaatcactcctagagaagtaaaaagaactgatatttaatttcagtcttcagactggtcagcattagaaaattcttggctttattgtactgggtattaagaccttgctcttcctagtccttttaatgctgtgtgttctgttaagttctttcatttgtttgtaattttgtttttcagcaaatttatattgttttgctaggtgttcatcctataagaagcaggattgtataggcagaaaaatgattgtaggaaagttgcaggattagcggaatgtatggttcaaccttaattatagcttcattgcaggactttactgtttctccattttctagaagctgctgttgctgctttgtgatgacgtgagatcaataagaagaacctagtctagagacaatgatgctagtttgcatatgttttcctatgcaatagttgttttcccagttattcaaagcagctttctatatgtagagatgcaaattattaagttgtttccaatacaataaataaaagcatctgtttttcactttaaaaaaaaaaaaaaaaaaaaaaaaaaaaaaaaaaaaaaaaaacaaaaaaaaaaaaaaaaaacaaaaaaaaaaaacaaaaacaaaacaagaggcggccgggcggcgacacagaataagtacccctcctagcgaggggcgagccacatcaagctaacgcagaccagaagagatattttgagaaagagagcaggccacacataatgaagcgatacatcatatcaagcacaaagacagccaggcaggacgagcgatcacaaaaacagcggacgtggacgtagaacacaaaacatccagcaacagacatccacattctagatggaacaaaaggacaccaaaacaagtgcgcgccggagaaggaacaaaaataagggagacaaagaccaaccacacaaagaccaggagactaaccacccaccgacgagagatagtaaacgccatacatagaaggtaggaatacgtagcagtcaaacaccaagcgcaataataccgcgacacgacaaaacaataacagtgcaaccaggacgtcttgactacaaaacacaataaaacacagggggcagggggatagaaataagtagcgaagaagaggaacgacaacaggagaacagagaagaagcagaaaaagaaacaggagaggacatgagaagagagagaagcagaaagaagaaggaaggaggcgcgaaaaccgcgagggacagggaacacaacgaaggagaaagaacaaaacggaagaaagaaggaggcggaagagacaaggccgagagacaagaaacagagagagacgaagacgagagaagagcaaggagaaaagacgaggaagagagagtagacggggcaaaaaaggaagaagaagag

SEQ ID NO: 456074 - DNA, 1111 bp, Homo sapiens
attcgcggccgcgtcgaccagcagcttctagaaaatggagaaacagtaaagtcctgcaatgaagctgctgttgctgctttgtgatgacgtgagatcaataagaagaacctagtctagagacaatgatgctagtttgcatatgttttcctatgcaatagttgttttcccagttattcaaagcagctttctatatgtagagatgcaaattattaagttgtttccaatacaataaataaaagcatctgtttttcactttaaaaaaaaaaaaaaaaaaaaaaaaaaaaaaaaaaaaaaaaaacaaaaaaaaaaaaaaaaaacaaaaaaaaaaaacaaaaacaaaacaagaggcggccgggcggcgacacagaataagtacccctcctagcgaggggcgagccacatcaagctaacgcagaccagaagagatattttgagaaagagagcaggccacacataatgaagcgatacatcatatcaagcacaaagacagccaggcaggacgagcgatcacaaaaacagcggacgtggacgtagaacacaaaacatccagcaacagacatccacattctagatggaacaaaaggacaccaaaacaagtgcgcgccggagaaggaacaaaaataagggagacaaagaccaaccacacaaagaccaggagactaaccacccaccgacgagagatagtaaacgccatacatagaaggtaggaatacgtagcagtcaaacaccaagcgcaataataccgcgacacgacaaaacaataacagtgcaaccaggacgtcttgactacaaaacacaataaaacacagggggcagggggatagaaataagtagcgaagaagaggaacgacaacaggagaacagagaagaagcagaaaaagaaacaggagaggacatgagaagagagagaagcagaaagaagaaggaaggaggcgcgaaaaccgcgagggacagggaacacaacgaaggagaaagaacaaaacggaagaaagaaggaggcggaagagacaaggccgagagacaagaaacagagagagacgaagacgagagaagagcaaggagaaaagacgaggaagagagagtagacggggcaaaaaaggaagaagaagag

SEQ ID NO: 456075 - DNA, 3560 bp, Homo sapiens
agcggagtgaggtagccgccgccgccgccgccgccgcgtcccctcgccggctcgctggtaccggcagtgccatggcggccttcagcaagtacttgacggcgcgaaactcctcgctggctggtgccgcgttcctgctgctctgcctgctccacaagcggcgccgcgccctcggcctgcacggaaagaggggaaaaaggagcgagctgtggtggacaaggtgtttttctcaaggctcatacagattctgaaaatcatggtccctagaacattttgtaaagagacaggttacttggtacttattgctgttatgctggtgtctcgaacatattgtgatgtttggatgattcaaaatgggacactaattgaaagtggtatcattggtcgtagcaggaaagatttcaagagatacttactcaacttcatcgctgccatgcctcttatctctctggttaataacttcttgaagtatgggttaaatgagcttaaactgtgcttccgagtaaggctcactaaatacctctatgaggagtatcttcaagctttcacatattataaaatggggaatctggacaacagaatagctaatccagaccagctgcttacacaagatgtagaaaaattttgtaacagtgtagtcgatctgtattcaaatcttagtaagccatttttagacatagttttgtatatctttaagttaacgagtgcaattggagctcagggcccagcgagcatgatggcctacttggttgtttctgggctattcctaactcgacttcgaagacccattggtaagatgacaataactgagcaaaagtatgaaggagaatatagatatgttaattctcggctcatcacaaacagtgaagaaattgccttttacaatgggaataaaagagaaaagcagacagtccactcagtcttccgaaaactggtggaacacctacataatttcattttgtttcggttttcaatgggcttcattgatagtattattgccaaataccttgccactgttgttggttacctagttgtcagtcgccctttcttagatttgtctcatcctcgacatctcaagagtacacattcggaacttctagaggattactaccaaagtggaagaatgcttttgcgaatgtctcaagctctgggtcgaatagttttggctgggcgtgaaatgactagattggccggttttactgctcggattacagaattaatgcaagtactgaaggatttaaatcatggcaaatatgagcgcacaatggtctcacaacaggaaaagggtattgaaggagtacaagtcattcccttgatacctggtgctggagaaatcattattgcagataacattataaagtttgatcatgttcctttagcaacgccaaatggagatgttttgatccgagaccttaattttgaagttcgatctggggctaatgttctaatttgtggtccaaatggctgcggaaagagttcacttttccgtgttcttggtgaattatggcctctttttggaggacgtctaactaaacctgaaagaggaaaattattttatgttcctcagagaccttacatgacccttggaacacttcgagatcaagtgatatatccagatggacgagaagatcagaaaaggaagggaatttctgacctagtactgaaggaatacttagacaatgtccagttgggtcatatccttgaacgtgaaggaggctgggacagtgttcaggattggatggacgtactcagtggtggagaaaagcaaagaatggcgatggcaagattattttatcataaaccccagtttgccattttggatgaatgcacaagtgcagttagtgtcgacgtggaaggctacatttatagtcattgtcgaaaggttggcatcactctcttcactgtgtctcataggaaatctctttggaaacatcatgagtactacctgcatatggatggcagaggcaactatgaattcaaacagataacagaagatacagttgagtttggctcttagagaaatctggagaactatacctgcttcagtgaaataattacagaatatacttagaaaggcaaagtacattgtaaaataaagttgagcttagttttttttaaaaaaaaaaacaaagcaacaaattaactagatacagaataatggagaacaagttgttaaaacatttaatattatataggatattgctaattgtgtatatgttggtttaattaataatatgtactaagaatgtccttattcttgtggttaaaaacctgcctaaattaaattgggcttcaatcactgtaacctgattcatcctgggatgtaaaccattcgaagtcagctaattggacttttatggctctatcttttccttcagtgaagaaccctatttaaaactgggtcatcatttgtcctgttctagcaagatagtcttcagtttcattttcctgtgccctgtggtagttggaaacaaatcataatgtattatttaaatgtttaacatcattgcataacagcgtttattatacagtggcagatttctttagctgccacagtaatactcattccttgtgtgtgtcttggagtgcatttgactccaggaaaagccattttggttttccttaactaaatgataaatgtacccctctcagtctgcagtattgagttgtttaaagtatatgtgcagtcttgcttacaaggaggggttaccatgtatcacacctaatcttcccaatgtttgggatattaaaacacaaagtccttaacatgccaggctcaaggtcttataagagttctagatttttaagagaattagacaaatttgtgtgtgttagaagcccattcattagaagtgtggtggttatttggtattaaactccaaatgagccataggaaggcactacatgaaataatgcactgagtatgcaatgctatcactgtctttgactgtgattttatgtttaaaaagtatgttctaaaattattatatatacatgggtgaattatgtttccgaggcactgttttatctctgtgaatcttgaataacttttttatatttgggttatgatgtcaaacgatcctaagcgaagatgatttcagttcatcaaatcatcattaatgactttatgtattatttgcacagggagaattgaaactgagtataatcaataagctagatacgaaatcagtttctcaaactgagcttcagaaaggggcattttgtactcttgtttttgcataactggttttgtttttttgcagaattaactataacaatcactggctaccgaagtaaactgatgtactgaattccataatacataacattcaatttttaccacttctgtttagcgaacttgtatacttattttctgttcagattaaaaaaaaaaaaaaaaactcagatatcctatacaacctttgcttgttctttttattctggtatctaaatactgagaagttcatttataattcagccttgacttgaaaacatagatagtttaatcttgacttgaaaaacacaaaaataaattcagaaaatgcttttaaaaaaaagtctct

SEQ ID NO: 456076 - DNA, 3605 bp, Homo sapiens
agcgggggcgaaccggcgcccagccagcactcaggcagcggcctccagttgggggtgggagggggacgcggtgtgtcccccacccccttccctacatcacccccttctgtgtcaactttctgggtgaggaataagtaaaaatggtatctaattatgagagtccttaagttcgaattaaccatgtggaagtaagaaaagtggaaaaccaccattacagaacaatgagaaagaggggaaaaaggagcgagctgtggtggacaaggtgtttttctcaaggctcatacagattctgaaaatcatggtccctagaacattttgtaaagagacaggttacttggtacttattgctgttatgctggtgtctcgaacatattgtgatgtttggatgattcaaaatgggacactaattgaaagtggtatcattggtcgtagcaggaaagatttcaagagatacttactcaacttcatcgctgccatgcctcttatctctctggttaataacttcttgaagtatgggttaaatgagcttaaactgtgcttccgagtaaggctcactaaatacctctatgaggagtatcttcaagctttcacatattataaaatggggaatctggacaacagaatagctaatccagaccagctgcttacacaagatgtagaaaaattttgtaacagtgtagtcgatctgtattcaaatcttagtaagccatttttagacatagttttgtatatctttaagttaacgagtgcaattggagctcagggcccagcgagcatgatggcctacttggttgtttctgggctattcctaactcgacttcgaagacccattggtaagatgacaataactgagcaaaagtatgaaggagaatatagatatgttaattctcggctcatcacaaacagtgaagaaattgccttttacaatgggaataaaagagaaaagcagacagtccactcagtcttccgaaaactggtggaacacctacataatttcattttgtttcggttttcaatgggcttcattgatagtattattgccaaataccttgccactgttgttggttacctagttgtcagtcgccctttcttagatttgtctcatcctcgacatctcaagagtacacattcggaacttctagaggattactaccaaagtggaagaatgcttttgcgaatgtctcaagctctgggtcgaatagttttggctgggcgtgaaatgactagattggccggttttactgctcggattacagaattaatgcaagtactgaaggatttaaatcatggcaaatatgagcgcacaatggtctcacaacaggaaaagggtattgaaggagtacaagtcattcccttgatacctggtgctggagaaatcattattgcagataacattataaagtttgatcatgttcctttagcaacgccaaatggagatgttttgatccgagaccttaattttgaagttcgatctggggctaatgttctaatttgtggtccaaatggctgcggaaagagttcacttttccgtgttcttggtgaattatggcctctttttggaggacgtctaactaaacctgaaagaggaaaattattttatgttcctcagagaccttacatgacccttggaacacttcgagatcaagtgatatatccagatggacgagaagatcagaaaaggaagggaatttctgacctagtactgaaggaatacttagacaatgtccagttgggtcatatccttgaacgtgaaggaggctgggacagtgttcaggattggatggacgtactcagtggtggagaaaagcaaagaatggcgatggcaagattattttatcataaaccccagtttgccattttggatgaatgcacaagtgcagttagtgtcgacgtggaaggctacatttatagtcattgtcgaaaggttggcatcactctcttcactgtgtctcataggaaatctctttggaaacatcatgagtactacctgcatatggatggcagaggcaactatgaattcaaacagataacagaagatacagttgagtttggctcttagagaaatctggagaactatacctgcttcagtgaaataattacagaatatacttagaaaggcaaagtacattgtaaaataaagttgagcttagttttttttaaaaaaaaaaacaaagcaacaaattaactagatacagaataatggagaacaagttgttaaaacatttaatattatataggatattgctaattgtgtatatgttggtttaattaataatatgtactaagaatgtccttattcttgtggttaaaaacctgcctaaattaaattgggcttcaatcactgtaacctgattcatcctgggatgtaaaccattcgaagtcagctaattggacttttatggctctatcttttccttcagtgaagaaccctatttaaaactgggtcatcatttgtcctgttctagcaagatagtcttcagtttcattttcctgtgccctgtggtagttggaaacaaatcataatgtattatttaaatgtttaacatcattgcataacagcgtttattatacagtggcagatttctttagctgccacagtaatactcattccttgtgtgtgtcttggagtgcatttgactccaggaaaagccattttggttttccttaactaaatgataaatgtacccctctcagtctgcagtattgagttgtttaaagtatatgtgcagtcttgcttacaaggaggggttaccatgtatcacacctaatcttcccaatgtttgggatattaaaacacaaagtccttaacatgccaggctcaaggtcttataagagttctagatttttaagagaattagacaaatttgtgtgtgttagaagcccattcattagaagtgtggtggttatttggtattaaactccaaatgagccataggaaggcactacatgaaataatgcactgagtatgcaatgctatcactgtctttgactgtgattttatgtttaaaaagtatgttctaaaattattatatatacatgggtgaattatgtttccgaggcactgttttatctctgtgaatcttgaataacttttttatatttgggttatgatgtcaaacgatcctaagcgaagatgatttcagttcatcaaatcatcattaatgactttatgtattatttgcacagggagaattgaaactgagtataatcaataagctagatacgaaatcagtttctcaaactgagcttcagaaaggggcattttgtactcttgtttttgcataactggttttgtttttttgcagaattaactataacaatcactggctaccgaagtaaactgatgtactgaattccataatacataacattcaatttttaccacttctgtttagcgaacttgtatacttattttctgttcagattaaaaaaaaaaaaaaaaactcagatatcctatacaacctttgcttgttctttttattctggtatctaaatactgagaagttcatttataattcagccttgacttgaaaacatagatagtttaatcttgacttgaaaaacacaaaaataaattcagaaaatgcttttaaaaaaaagtctct

SEQ ID NO: 456077 - DNA, 3084 bp, Homo sapiens
tgagcaaaatgtaggagagctgagggataagctacagtggtaagaggaaaagcccatgagtagtaaaagtgtagaggctactgtgtactttttcagaaaaaaaacaaagggaaaaaattacccagtagggcaatttctttcagtcattgaggttaattataaaaattgtacatgtttgtatctaagtgaatttattattatatcccagaactttgtgtatctttctctcccaataataatagggcccagcgagcatgatggcctacttggttgtttctgggctattcctaactcgacttcgaagacccattggtaagatgacaataactgagcaaaagtatgaaggagaatatagatatgttaattctcggctcatcacaaacagtgaagaaattgccttttacaatgggaataaaagagaaaagcagacagtccactcagtcttccgaaaactggtggaacacctacataatttcattttgtttcggttttcaatgggcttcattgatagtattattgccaaataccttgccactgttgttggttacctagttgtcagtcgccctttcttagatttgtctcatcctcgacatctcaagagtacacattcggaacttctagaggattactaccaaagtggaagaatgcttttgcgaatgtctcaagctctgggtcgaatagttttggctgggcgtgaaatgactagattggccggttttactgctcggattacagaattaatgcaagtactgaaggatttaaatcatggcaaatatgagcgcacaatggtctcacaacaggaaaagggtattgaaggagtacaagtcattcccttgatacctggtgctggagaaatcattattgcagataacattataaagtttgatcatgttcctttagcaacgccaaatggagatgttttgatccgagaccttaattttgaagttcgatctggggctaatgttctaatttgtggtccaaatggctgcggaaagagttcacttttccgtgttcttggtgaattatggcctctttttggaggacgtctaactaaacctgaaagaggaaaattattttatgttcctcagagaccttacatgacccttggaacacttcgagatcaagtgatatatccagatggacgagaagatcagaaaaggaagggaatttctgacctagtactgaaggaatacttagacaatgtccagttgggtcatatccttgaacgtgaaggaggctgggacagtgttcaggattggatggacgtactcagtggtggagaaaagcaaagaatggcgatggcaagattattttatcataaaccccagtttgccattttggatgaatgcacaagtgcagttagtgtcgacgtggaaggctacatttatagtcattgtcgaaaggttggcatcactctcttcactgtgtctcataggaaatctctttggaaacatcatgagtactacctgcatatggatggcagaggcaactatgaattcaaacagataacagaagatacagttgagtttggctcttagagaaatctggagaactatacctgcttcagtgaaataattacagaatatacttagaaaggcaaagtacattgtaaaataaagttgagcttagttttttttaaaaaaaaaaacaaagcaacaaattaactagatacagaataatggagaacaagttgttaaaacatttaatattatataggatattgctaattgtgtatatgttggtttaattaataatatgtactaagaatgtccttattcttgtggttaaaaacctgcctaaattaaattgggcttcaatcactgtaacctgattcatcctgggatgtaaaccattcgaagtcagctaattggacttttatggctctatcttttccttcagtgaagaaccctatttaaaactgggtcatcatttgtcctgttctagcaagatagtcttcagtttcattttcctgtgccctgtggtagttggaaacaaatcataatgtattatttaaatgtttaacatcattgcataacagcgtttattatacagtggcagatttctttagctgccacagtaatactcattccttgtgtgtgtcttggagtgcatttgactccaggaaaagccattttggttttccttaactaaatgataaatgtacccctctcagtctgcagtattgagttgtttaaagtatatgtgcagtcttgcttacaaggaggggttaccatgtatcacacctaatcttcccaatgtttgggatattaaaacacaaagtccttaacatgccaggctcaaggtcttataagagttctagatttttaagagaattagacaaatttgtgtgtgttagaagcccattcattagaagtgtggtggttatttggtattaaactccaaatgagccataggaaggcactacatgaaataatgcactgagtatgcaatgctatcactgtctttgactgtgattttatgtttaaaaagtatgttctaaaattattatatatacatgggtgaattatgtttccgaggcactgttttatctctgtgaatcttgaataacttttttatatttgggttatgatgtcaaacgatcctaagcgaagatgatttcagttcatcaaatcatcattaatgactttatgtattatttgcacagggagaattgaaactgagtataatcaataagctagatacgaaatcagtttctcaaactgagcttcagaaaggggcattttgtactcttgtttttgcataactggttttgtttttttgcagaattaactataacaatcactggctaccgaagtaaactgatgtactgaattccataatacataacattcaatttttaccacttctgtttagcgaacttgtatacttattttctgttcagattaaaaaaaaaaaaaaaaactcagatatcctatacaacctttgcttgttctttttattctggtatctaaatactgagaagttcatttataattcagccttgacttgaaaacatagatagtttaatcttgacttgaaaaacacaaaaataaattcagaaaatgcttttaaaaaaaagtctct

SEQ ID NO: 456078 - DNA, 1965 bp, Homo sapiens
ggtggcgtgggtcgacgcacgcgtctgagaaacggacgggaatactgaacctagatttagtactgaaggaatacttagacaatgtccagttgggtcatatccttgaacgtgaaggaggctgggacagtgttcaggattggatggacgtactcagtggtggagaaaagcaaagaatggcgatggcaagattattttatcataaaccccagtttgccattttggatgaatgcacaagtgcagttagtgtcgacgtggaaggctacatttatagtcattgtcgaaaggttggcatcactctcttcactgtgtctcataggaaatctctttggaaacatcatgagtactacctgcatatggatggcagaggcaactatgaattcaaacagataacagaagatacagttgagtttggctcttagagaaatctggagaactatacctgcttcagtgaaataattacagaatatacttagaaaggcaaagtacattgtaaaataaagttgagcttagttttttttaaaaaaaaaaacaaagcaacaaattaactagatacagaataatggagaacaagttgttaaaacatttaatattatataggatattgctaattgtgtatatgttggtttaattaataatatgtactaagaatgtccttattcttgtggttaaaaacctgcctaaattaaattgggcttcaatcactgtaacctgattcatcctgggatgtaaaccattcgaagtcagctaattggacttttatggctctatcttttccttcagtgaagaaccctatttaaaactgggtcatcatttgtcctgttctagcaagatagtcttcagtttcattttcctgtgccctgtggtagttggaaacaaatcataatgtattatttaaatgtttaacatcattgcataacagcgtttattatacagtggcagatttctttagctgccacagtaatactcattccttgtgtgtgtcttggagtgcatttgactccaggaaaagccattttggttttccttaactaaatgataaatgtacccctctcagtctgcagtattgagttgtttaaagtatatgtgcagtcttgcttacaaggaggggttaccatgtatcacacctaatcttcccaatgtttgggatattaaaacacaaagtccttaacatgccaggctcaaggtcttataagagttctagatttttaagagaattagacaaatttgtgtgtgttagaagcccattcattagaagtgtggtggttatttggtattaaactccaaatgagccataggaaggcactacatgaaataatgcactgagtatgcaatgctatcactgtctttgactgtgattttatgtttaaaaagtatgttctaaaattattatatatacatgggtgaattatgtttccgaggcactgttttatctctgtgaatcttgaataacttttttatatttgggttatgatgtcaaacgatcctaagcgaagatgatttcagttcatcaaatcatcattaatgactttatgtattatttgcacagggagaattgaaactgagtataatcaataagctagatacgaaatcagtttctcaaactgagcttcagaaaggggcattttgtactcttgtttttgcataactggttttgtttttttgcagaattaactataacaatcactggctaccgaagtaaactgatgtactgaattccataatacataacattcaatttttaccacttctgtttagcgaacttgtatacttattttctgttcagattaaaaaaaaaaaaaaaaactcagatatcctatacaacctttgcttgttctttttattctggtatctaaatactgagaagttcatttataattcagccttgacttgaaaacatagatagtttaatcttgacttgaaaaacacaaaaataaattcagaaaatgcttttaaaaaaaagtctct

SEQ ID NO: 456079 - DNA, 1744 bp, Homo sapiens
tcgacgagagaggcgagggcggcgcggcggtagatgggcggccgggaggaagaaagcctgagggttggcatcactctcttcactgtgtctcataggaaatctctttggaaacatcatgagtactacctgcatatggatggcagaggcaactatgaattcaaacagataacagaagatacagttgagtttggctcttagagaaatctggagaactatacctgcttcagtgaaataattacagaatatacttagaaaggcaaagtacattgtaaaataaagttgagcttagttttttttaaaaaaaaaaacaaagcaacaaattaactagatacagaataatggagaacaagttgttaaaacatttaatattatataggatattgctaattgtgtatatgttggtttaattaataatatgtactaagaatgtccttattcttgtggttaaaaacctgcctaaattaaattgggcttcaatcactgtaacctgattcatcctgggatgtaaaccattcgaagtcagctaattggacttttatggctctatcttttccttcagtgaagaaccctatttaaaactgggtcatcatttgtcctgttctagcaagatagtcttcagtttcattttcctgtgccctgtggtagttggaaacaaatcataatgtattatttaaatgtttaacatcattgcataacagcgtttattatacagtggcagatttctttagctgccacagtaatactcattccttgtgtgtgtcttggagtgcatttgactccaggaaaagccattttggttttccttaactaaatgataaatgtacccctctcagtctgcagtattgagttgtttaaagtatatgtgcagtcttgcttacaaggaggggttaccatgtatcacacctaatcttcccaatgtttgggatattaaaacacaaagtccttaacatgccaggctcaaggtcttataagagttctagatttttaagagaattagacaaatttgtgtgtgttagaagcccattcattagaagtgtggtggttatttggtattaaactccaaatgagccataggaaggcactacatgaaataatgcactgagtatgcaatgctatcactgtctttgactgtgattttatgtttaaaaagtatgttctaaaattattatatatacatgggtgaattatgtttccgaggcactgttttatctctgtgaatcttgaataacttttttatatttgggttatgatgtcaaacgatcctaagcgaagatgatttcagttcatcaaatcatcattaatgactttatgtattatttgcacagggagaattgaaactgagtataatcaataagctagatacgaaatcagtttctcaaactgagcttcagaaaggggcattttgtactcttgtttttgcataactggttttgtttttttgcagaattaactataacaatcactggctaccgaagtaaactgatgtactgaattccataatacataacattcaatttttaccacttctgtttagcgaacttgtatacttattttctgttcagattaaaaaaaaaaaaaaaaactcagatatcctatacaacctttgcttgttctttttattctggtatctaaatactgagaagttcatttataattcagccttgacttgaaaacatagatagtttaatcttgacttgaaaaacacaaaaataaattcagaaaatgcttttaaaaaaaagtctct

SEQ ID NO: 456080 - DNA, 3543 bp, Homo sapiens
agcggagtgaggtagccgccgccgccgccgccgccgcgtcccctcgccggctcgctggtaccggcagtgccatggcggccttcagcaagtacttgacggcgcgaaactcctcgctggctggtgccgcgttcctgctgctctgcctgctccacaagcggcgccgcgccctcggcctgcacggtaagaaaagtggaaaaccaccattacagaacaatgagaaagaggggaaaaaggagcgagctgtggtggacaaggtgtttttctcaaggctcatacagattctgaaaatcatggtccctagaacattttgtaaagagacaggttacttggtacttattgctgttatgctggtgtctcgaacatattgtgatgtttggatgattcaaaatgggacactaattgaaagtggtatcattggtcgtagcaggaaagatttcaagagatacttactcaacttcatcgctgccatgcctcttatctctctggttaataacttcttgaagtatgggttaaatgagcttaaactgtgcttccgagtaaggctcactaaatacctctatgaggagtatcttcaagctttcacatattataaaatggggaatctggacaacagaatagctaatccagaccagctgcttacacaagatgtagaaaaattttgtaacagtgtagtcgatctgtattcaaatcttagtaagccatttttagacatagttttgtatatctttaagttaacgagtgcaattggagctcagggcccagcgagcatgatggcctacttggttgtttctgggctattcctaactcgacttcgaagacccattggtaagatgacaataactgagcaaaagtatgaaggagaatatagatatgttaattctcggctcatcacaaacagtgaagaaattgccttttacaatgggaataaaagagaaaagcagacagtccactcagtcttccgaaaactggtggaacacctacataatttcattttgtttcggttttcaatgggcttcattgatagtattattgccaaataccttgccactgttgttggttacctagttgtcagtcgccctttcttagatttgtctcatcctcgacatctcaagagtacacattcggaacttctagaggattactaccaaagtggaagaatgcttttgcgaatgtctcaagctctgggtcgaatagttttggctgggcgtgaaatgactagattggccggttttactgctcggattacagaattaatgcaagtactgaaggatttaaatcatggcaaatatgagcgcacaatggtctcacaacaggaaaagggtattgaaggagtacaagtcattcccttgatacctggtgctggagaaatcattattgcagataacattataaagtttgatcatgttcctttagcaacgccaaatggagatgttttgatccgagaccttaattttgaagttcgatctggggctaatgttctaatttgtggtccaaatggctgcggaaagagttcacttttccgtgttcttggtgaattatggcctctttttggaggacgtctaactaaacctgaaagaggaaaattattttatgttcctcagagaccttacatgacccttggaacacttcgagatcaagtgatatatccagatggacgagaagatcagaaaaggaagggaatttctgacctagtactgaaggaatacttagacaatgtccagttgggtcatatccttgaacgtgaaggaggctgggacagtgttcaggattggatggacgtactcagtggtggagaaaagcaaagaatggcgatggcaagattattttatcataaaccccagtttgccattttggatgaatgcacaagtgcagttagtgtcgacgtggaaggctacatttatagtcattgtcgaaaggttggcatcactctcttcactgtgtctcataggaaatctctttggaaacatcatgagtactacctgcatatggatggcagaggcaactatgaattcaaacagataacagaagatacagttgagtttggctcttagagaaatctggagaactatacctgcttcagtgaaataattacagaatatacttagaaaggcaaagtacattgtaaaataaagttgagcttagttttttttaaaaaaaaaaacaaagcaacaaattaactagatacagaataatggagaacaagttgttaaaacatttaatattatataggatattgctaattgtgtatatgttggtttaattaataatatgtactaagaatgtccttattcttgtggttaaaaacctgcctaaattaaattgggcttcaatcactgtaacctgattcatcctgggatgtaaaccattcgaagtcagctaattggacttttatggctctatcttttccttcagtgaagaaccctatttcctgtgccctgtggtagttggaaacaaatcataatgtattatttaaatgtttaacatcattgcataacagcgtttattatacagtggcagatttctttagctgccacagtaatactcattccttgtgtgtgtcttggagtgcatttgactccaggaaaagccattttggttttccttaactaaatgataaatgtacccctctcagtctgcagtattgagttgtttaaagtatatgtgcagtcttgcttacaaggaggggttaccatgtatcacacctaatcttcccaatgtttgggatattaaaacacaaagtccttaacatgccaggctcaaggtcttataagagttctagatttttaagagaattagacaaatttgtgtgtgttagaagcccattcattagaagtgtggtggttatttggtattaaactccaaatgagccataggaaggcactacatgaaataatgcactgagtatgcaatgctatcactgtctttgactgtgattttatgtttaaaaagtatgttctaaaattattatatatacatgggtgaattatgtttccgaggcactgttttatctctgtgaatcttgaataacttttttatatttgggttatgatgtcaaacgatcctaagcgaagatgatttcagttcatcaaatcatcattaatgactttatgtattatttgcacagggagaattgaaactgagtataatcaataagctagatacgaaatcagtttctcaaactgagcttcagaaaggggcattttgtactcttgtttttgcataactggttttgtttttttgcagaattaactataacaatcactggctaccgaagtaaactgatgtactgaattccataatacataacattcaatttttaccacttctgtttagcgaacttgtatacttattttctgttcagattaaaaaaaaaaaaaaaaactcagatatcctatacaacctttgcttgttctttttattctggtatctaaatactgagaagttcatttataattcagccttgacttgaaaacatagatagtttaatcttgacttgaaaaacacaaaaataaattcagaaaatgcttttaaaaaaaagtctct

SEQ ID NO: 456081 - DNA, 984 bp, Homo sapiens
agcggagtgaggtagccgccgccgccgccgccgccgcgtcccctcgccggctcgctggtaccggcagtgccatggcggccttcagcaagtacttgacggcgcgaaactcctcgctggctggtgccgcgttcctgctgctctgcctgctccacaagcggcgccgcgccctcggcctgcacggtaagaaaagtggaaaaccaccattacagaacaatgagaaagaggggaaaaaggagcgagctgtggtggacaaggtgtttttctcaaggctcatacagattctgaaaatcatggtccctagaacattttgtaaagagacaggttacttggtacttattgctgttatgctggtgtctcgaacatattgtgatgtttggatgattcaaaatgggacactaattgaaagtggtatcattggtcgtagcaggaaagatttcaagagatacttactcaacttcatcgctgccatgcctcttatctctctggttaataacttcttgaagtatgggttaaatgagcttaaactgtgcttccgagtaaggctcactaaatacctctatgaggagtatcttcaagctttcacatattataaaatggggaatctggacaacagaatagctaatccagaccagctgcttacacaagatgtagaaaaattttgtaacagtgtagtcgatctgtattcaaatcttagtaagccatttttagacatagttttgtatatctttaagttaacgagtgcaattggagctcaggtacttggaaaaattttgtggcattaaaaaccagacaaatgtattggccaggcgtggtggctcatgcctgtaatcccagcactttgggaggctgagatgggaggatcgcttgaatccaggagttcgagacaagcctggacaaaaagcgagacccgcttctttaaaaaataataataaacccggatgcggcagcttgtttttttttttctttatttaatttttctaaatt

SEQ ID NO: 456082 - DNA, 666 bp, Homo sapiens
gggaacacaactagaatgtgaggggccaggatagctaagaaatagtaatacagaaaatggaaactcagaaagctttctgaaaataagccactaaataaaaacagaaggctttgtaactgctgttgtgtcttcagaggttaggatatatcggcagtttttatagctctttttcccctctactaaattaaaaacaaataaaaagccttaagctggagatttcaagctgattaggaaatcaggctacaggaaacaatactgactgacctatggaacagtcttgcatttagcacagtttaacctactggtagctgagatccttggtcatggagttacggaagcattctgatttgtgggatgcttatagatttagctcccttaaaataatgaggaagtctgtattttacttttcataaaagacagtactatattcactcttagttactgactttttttcccccttctttcccatagtactacctgcatatggatggcagaggcaactatgaattcaaacagataacagaagatacagttgagtttggctcttagagaaatctggagaactatacctgcttcagtgaaataattacagaatatacttagaaaggcaaagtacattgtaaaataaagttgagcttagttttttttaaaaaaaaaaacaaagca

SEQ ID NO: 456083 - DNA, 3597 bp, Homo sapiens
agcggagtgaggtagccgccgccgccgccgccgccgcgtcccctcgccggctcgctggtaccggcagtgccatggcggccttcagcaagtacttgacggcgcgaaactcctcgctggctggtgccgcgttcctgctgctctgcctgctccacaagcggcgccgcgccctcggcctgcacggtaagaaaagtggaaaaccaccattacagaacaatgagaaagaggggaaaaaggagcgagctgtggtggacaaggtgtttttctcaaggctcatacagattctgaaaatcatggtccctagaacattttgtaaagagacaggttacttggtacttattgctgttatgctggtgtctcgaacatattgtgatgtttggatgattcaaaatgggacactaattgaaagtggtatcattggtcgtagcaggaaagatttcaagagatacttactcaacttcatcgctgccatgcctcttatctctctggttaataacttcttgaagtatgggttaaatgagcttaaactgtgcttccgagtaaggctcactaaatacctctatgaggagtatcttcaagctttcacatattataaaatggggaatctggacaacagaatagctaatccagaccagctgcttacacaagatgtagaaaaattttgtaacagtgtagtcgatctgtattcaaatcttagtaagccatttttagacatagttttgtatatctttaagttaacgagtgcaattggagctcagggcccagcgagcatgatggcctacttggttgtttctgggctattcctaactcgacttcgaagacccattggtaagatgacaataactgagcaaaagtatgaaggagaatatagatatgttaattctcggctcatcacaaacagtgaagaaattgccttttacaatgggaataaaagagaaaagcagacagtccactcagtcttccgaaaactggtggaacacctacataatttcattttgtttcggttttcaatgggcttcattgatagtattattgccaaataccttgccactgttgttggttacctagttgtcagtcgccctttcttagatttgtctcatcctcgacatctcaagagtacacattcggaacttctagaggattactaccaaagtggaagaatgcttttgcgaatgtctcaagctctgggtcgaatagttttggctgggcgtgaaatgactagattggccggttttactgctcggattacagaattaatgcaagtactgaaggatttaaatcatggcaaatatgagcgcacaatggtctcacaacaggaaaagggtattgaaggagtacaagtcattcccttgatacctggtgctggagaaatcattattgcagataacattataaagtttgatcatgttcctttagcaacgccaaatggagatgttttgatccgagaccttaattttgaagttcgatctggggctaatgttctaatttgtggtccaaatggctgcggaaagagttcacttttccgtgttcttggtgaattatggcctctttttggaggacgtctaactaaacctgaaagaggaaaattattttatgttcctcagagaccttacatgacccttggaacacttcgagatcaagtgatatatccagatggacgagaagatcagaaaaggaagggaatttctgacctagtactgaaggaatacttagacaatgtccagttgggtcatatccttgaacgtgaaggaggctgggacagtgttcaggattggatggacgtactcagtggtggagaaaagcaaagaatggcgatggcaagattattttatcataaaccccagtttgccattttggatgaatgcacaagtgcagttagtgtcgacgtggaaggctacatttatagtcattgtcgaaaggttggcatcactctcttcactgtgtctcataggaaatctctttggaaacatcatgagtactacctgcatatggatggcagaggcaactatgaattcaaacagataacagaagatacagttgagtttggctcttagagaaatctggagaactatacctgcttcagtgaaataattacagaatatacttagaaaggcaaagtacattgtaaaataaagttgagcttagttttttttaaaaaaaaaaacaaagcaacaaattaactagatacagaataatggagaacaagttgttaaaacatttaatattatataggatattgctaattgtgtatatgttggtttaattaataatatgtactaagaatgtccttattcttgtggttaaaaacctgcctaaattaaattgggcttcaatcactgtaacctgattcatcctgggatgtaaaccattcgaagtcagctaattggacttttatggctctatcttttccttcagtgaagaaccctatttaaaactgggtcatcatttgtcctgttctagcaagatagtcttcagtttcattttcctgtgccctgtggtagttggaaacaaatcataatgtattatttaaatgtttaacatcattgcataacagcgtttattatacagtggcagatttctttagctgccacagtaatactcattccttgtgtgtgtcttggagtgcatttgactccaggaaaagccattttggttttccttaactaaatgataaatgtacccctctcagtctgcagtattgagttgtttaaagtatatgtgcagtcttgcttacaaggaggggttaccatgtatcacacctaatcttcccaatgtttgggatattaaaacacaaagtccttaacatgccaggctcaaggtcttataagagttctagatttttaagagaattagacaaatttgtgtgtgttagaagcccattcattagaagtgtggtggttatttggtattaaactccaaatgagccataggaaggcactacatgaaataatgcactgagtatgcaatgctatcactgtctttgactgtgattttatgtttaaaaagtatgttctaaaattattatatatacatgggtgaattatgtttccgaggcactgttttatctctgtgaatcttgaataacttttttatatttgggttatgatgtcaaacgatcctaagcgaagatgatttcagttcatcaaatcatcattaatgactttatgtattatttgcacagggagaattgaaactgagtataatcaataagctagatacgaaatcagtttctcaaactgagcttcagaaaggggcattttgtactcttgtttttgcataactggttttgtttttttgcagaattaactataacaatcactggctaccgaagtaaactgatgtactgaattccataatacataacattcaatttttaccacttctgtttagcgaacttgtatacttattttctgttcagattaaaaaaaaaaaaaaaaactcagatatcctatacaacctttgcttgttctttttattctggtatctaaatactgagaagttcatttataattcagccttgacttgaaaacatagatagtttaatcttgacttgaaaaacacaaaaataaattcagaaaatgcttttaaaaaaaagtctct

SEQ ID NO: 456084 - DNA, 3543 bp, Homo sapiens
agcggagtgaggtagccgccgccgccgccgccgccgcgtcccctcgccggctcgctggtaccggcagtgccatggcggccttcagcaagtacttgacggcgcgaaactcctcgctggctggtgccgcgttcctgctgctctgcctgctccacaagcggcgccgcgccctcggcctgcacggtaagaaaagtggaaaaccaccattacagaacaatgagaaagaggggaaaaaggagcgagctgtggtggacaaggtgtttttctcaaggctcatacagattctgaaaatcatggtccctagaacattttgtaaagagacaggttacttggtacttattgctgttatgctggtgtctcgaacatattgtgatgtttggatgattcaaaatgggacactaattgaaagtggtatcattggtcgtagcaggaaagatttcaagagatacttactcaacttcatcgctgccatgcctcttatctctctggttaataacttcttgaagtatgggttaaatgagcttaaactgtgcttccgagtaaggctcactaaatacctctatgaggagtatcttcaagctttcacatattataaaatggggaatctggacaacagaatagctaatccagaccagctgcttacacaagatgtagaaaaattttgtaacagtgtagtcgatctgtattcaaatcttagtaagccatttttagacatagttttgtatatctttaagttaacgagtgcaattggagctcagggcccagcgagcatgatggcctacttggttgtttctgggctattcctaactcgacttcgaagacccattggtaagatgacaataactgagcaaaagtatgaaggagaatatagatatgttaattctcggctcatcacaaacagtgaagaaattgccttttacaatgggaataaaagagaaaagcagacagtccactcagtcttccgaaaactggtggaacacctacataatttcattttgtttcggttttcaatgggcttcattgatagtattattgccaaataccttgccactgttgttggttacctagttgtcagtcgccctttcttagatttgtctcatcctcgacatctcaagagtacacattcggaacttctagaggattactaccaaagtggaagaatgcttttgcgaatgtctcaagctctgggtcgaatagttttggctgggcgtgaaatgactagattggccggttttactgctcggattacagaattaatgcaagtactgaaggatttaaatcatggcaaatatgagcgcacaatggtctcacaacaggaaaagggtattgaaggagtacaagtcattcccttgatacctggtgctggagaaatcattattgcagataacattataaagtttgatcatgttcctttagcaacgccaaatggagatgttttgatccgagaccttaattttgaagttcgatctggggctaatgttctaatttgtggtccaaatggctgcggaaagagttcacttttccgtgttcttggtgaattatggcctctttttggaggacgtctaactaaacctgaaagaggtcaagtgatatatccagatggacgagaagatcagaaaaggaagggaatttctgacctagtactgaaggaatacttagacaatgtccagttgggtcatatccttgaacgtgaaggaggctgggacagtgttcaggattggatggacgtactcagtggtggagaaaagcaaagaatggcgatggcaagattattttatcataaaccccagtttgccattttggatgaatgcacaagtgcagttagtgtcgacgtggaaggctacatttatagtcattgtcgaaaggttggcatcactctcttcactgtgtctcataggaaatctctttggaaacatcatgagtactacctgcatatggatggcagaggcaactatgaattcaaacagataacagaagatacagttgagtttggctcttagagaaatctggagaactatacctgcttcagtgaaataattacagaatatacttagaaaggcaaagtacattgtaaaataaagttgagcttagttttttttaaaaaaaaaaacaaagcaacaaattaactagatacagaataatggagaacaagttgttaaaacatttaatattatataggatattgctaattgtgtatatgttggtttaattaataatatgtactaagaatgtccttattcttgtggttaaaaacctgcctaaattaaattgggcttcaatcactgtaacctgattcatcctgggatgtaaaccattcgaagtcagctaattggacttttatggctctatcttttccttcagtgaagaaccctatttaaaactgggtcatcatttgtcctgttctagcaagatagtcttcagtttcattttcctgtgccctgtggtagttggaaacaaatcataatgtattatttaaatgtttaacatcattgcataacagcgtttattatacagtggcagatttctttagctgccacagtaatactcattccttgtgtgtgtcttggagtgcatttgactccaggaaaagccattttggttttccttaactaaatgataaatgtacccctctcagtctgcagtattgagttgtttaaagtatatgtgcagtcttgcttacaaggaggggttaccatgtatcacacctaatcttcccaatgtttgggatattaaaacacaaagtccttaacatgccaggctcaaggtcttataagagttctagatttttaagagaattagacaaatttgtgtgtgttagaagcccattcattagaagtgtggtggttatttggtattaaactccaaatgagccataggaaggcactacatgaaataatgcactgagtatgcaatgctatcactgtctttgactgtgattttatgtttaaaaagtatgttctaaaattattatatatacatgggtgaattatgtttccgaggcactgttttatctctgtgaatcttgaataacttttttatatttgggttatgatgtcaaacgatcctaagcgaagatgatttcagttcatcaaatcatcattaatgactttatgtattatttgcacagggagaattgaaactgagtataatcaataagctagatacgaaatcagtttctcaaactgagcttcagaaaggggcattttgtactcttgtttttgcataactggttttgtttttttgcagaattaactataacaatcactggctaccgaagtaaactgatgtactgaattccataatacataacattcaatttttaccacttctgtttagcgaacttgtatacttattttctgttcagattaaaaaaaaaaaaaaaaactcagatatcctatacaacctttgcttgttctttttattctggtatctaaatactgagaagttcatttataattcagccttgacttgaaaacatagatagtttaatcttgacttgaaaaacacaaaaataaattcagaaaatgcttttaaaaaaaagtctct

SEQ ID NO: 456085 - DNA, 3543 bp, Homo sapiens
agcggagtgaggtagccgccgccgccgccgccgccgcgtcccctcgccggctcgctggtaccggcagtgccatggcggccttcagcaagtacttgacggcgcgaaactcctcgctggctggtgccgcgttcctgctgctctgcctgctccacaagcggcgccgcgccctcggcctgcacggtaagaaaagtggaaaaccaccattacagaacaatgagaaagaggggaaaaaggagcgagctgtggtggacaaggtgtttttctcaaggctcatacagattctgaaaatcatggtccctagaacattttgtaaagagacaggttacttggtacttattgctgttatgctggtgtctcgaacatattgtgatgtttggatgattcaaaatgggacactaattgaaagtggtatcattggtcgtagcaggaaagatttcaagagatacttactcaacttcatcgctgccatgcctcttatctctctggttaataacttcttgaagtatgggttaaatgagcttaaactgtgcttccgagtaaggctcactaaatacctctatgaggagtatcttcaagctttcacatattataaaatggggaatctggacaacagaatagctaatccagaccagctgcttacacaagatgtagaaaaattttgtaacagtgtagtcgatctgtattcaaatcttagtaagccatttttagacatagttttgtatatctttaagttaacgagtgcaattggagctcagggcccagcgagcatgatggcctacttggttgtttctgggctattcctaactcgacttcgaagacccattggtaagatgacaataactgagcaaaagtatgaaggagaatatagatatgttaattctcggctcatcacaaacagtgaagaaattgccttttacaatgggaataaaagagaaaagcagacagtccactcagtcttccgaaaactggtggaacacctacataatttcattttgtttcggttttcaatgggcttcattgatagtattattgccaaataccttgccactgttgttggttacctagttgtcagtcgccctttcttagatttgtctcatcctcgacatctcaagagtacacattcggaacttctagaggattactaccaaagtggaagaatgcttttgcgaatgtctcaagctctgggtcgaatagttttggctgggcgtgaaatgactagattggccggttttactgctcggattacagaattaatgcaagtactgaaggatttaaatcatggcaaatatgagcgcacaatggtctcacaacaggaaaagggtattgaaggagtacaagtcattcccttgatacctggtgctggagaaatcattattgcagataacattataaagtttgatcatgttcctttagcaacgccaaatggagatgttttgatccgagaccttaattttgaagttcgatctggggctaatgttctaatttgtggtccaaatggctgcggaaagagttcacttttccgtgttcttggtgaattatggcctctttttggaggacgtctaactaaacctgaaagaggaaaattattttatgttcctcagagaccttacatgacccttggaacacttcgagatcaagtgatatatccagatggacgagaagatcagttgggtcatatccttgaacgtgaaggaggctgggacagtgttcaggattggatggacgtactcagtggtggagaaaagcaaagaatggcgatggcaagattattttatcataaaccccagtttgccattttggatgaatgcacaagtgcagttagtgtcgacgtggaaggctacatttatagtcattgtcgaaaggttggcatcactctcttcactgtgtctcataggaaatctctttggaaacatcatgagtactacctgcatatggatggcagaggcaactatgaattcaaacagataacagaagatacagttgagtttggctcttagagaaatctggagaactatacctgcttcagtgaaataattacagaatatacttagaaaggcaaagtacattgtaaaataaagttgagcttagttttttttaaaaaaaaaaacaaagcaacaaattaactagatacagaataatggagaacaagttgttaaaacatttaatattatataggatattgctaattgtgtatatgttggtttaattaataatatgtactaagaatgtccttattcttgtggttaaaaacctgcctaaattaaattgggcttcaatcactgtaacctgattcatcctgggatgtaaaccattcgaagtcagctaattggacttttatggctctatcttttccttcagtgaagaaccctatttaaaactgggtcatcatttgtcctgttctagcaagatagtcttcagtttcattttcctgtgccctgtggtagttggaaacaaatcataatgtattatttaaatgtttaacatcattgcataacagcgtttattatacagtggcagatttctttagctgccacagtaatactcattccttgtgtgtgtcttggagtgcatttgactccaggaaaagccattttggttttccttaactaaatgataaatgtacccctctcagtctgcagtattgagttgtttaaagtatatgtgcagtcttgcttacaaggaggggttaccatgtatcacacctaatcttcccaatgtttgggatattaaaacacaaagtccttaacatgccaggctcaaggtcttataagagttctagatttttaagagaattagacaaatttgtgtgtgttagaagcccattcattagaagtgtggtggttatttggtattaaactccaaatgagccataggaaggcactacatgaaataatgcactgagtatgcaatgctatcactgtctttgactgtgattttatgtttaaaaagtatgttctaaaattattatatatacatgggtgaattatgtttccgaggcactgttttatctctgtgaatcttgaataacttttttatatttgggttatgatgtcaaacgatcctaagcgaagatgatttcagttcatcaaatcatcattaatgactttatgtattatttgcacagggagaattgaaactgagtataatcaataagctagatacgaaatcagtttctcaaactgagcttcagaaaggggcattttgtactcttgtttttgcataactggttttgtttttttgcagaattaactataacaatcactggctaccgaagtaaactgatgtactgaattccataatacataacattcaatttttaccacttctgtttagcgaacttgtatacttattttctgttcagattaaaaaaaaaaaaaaaaactcagatatcctatacaacctttgcttgttctttttattctggtatctaaatactgagaagttcatttataattcagccttgacttgaaaacatagatagtttaatcttgacttgaaaaacacaaaaataaattcagaaaatgcttttaaaaaaaagtctct

SEQ ID NO: 456086 - DNA, 3543 bp, Homo sapiens
agcggagtgaggtagccgccgccgccgccgccgccgcgtcccctcgccggctcgctggtaccggcagtgccatggcggccttcagcaagtacttgacggcgcgaaactcctcgctggctggtgccgcgttcctgctgctctgcctgctccacaagcggcgccgcgccctcggcctgcacggtaagaaaagtggaaaaccaccattacagaacaatgagaaagaggggaaaaaggagcgagctgtggtggacaaggtgtttttctcaaggctcatacagattctgaaaatcatggtccctagaacattttgtaaagagacaggttacttggtacttattgctgttatgctggtgtctcgaacatattgtgatgtttggatgattcaaaatgggacactaattgaaagtggtatcattggtcgtagcaggaaagatttcaagagatacttactcaacttcatcgctgccatgcctcttatctctctggttaataacttcttgaagtatgggttaaatgagcttaaactgtgcttccgagtaaggctcactaaatacctctatgaggagtatcttcaagctttcacatattataaaatggggaatctggacaacagaatagctaatccagaccagctgcttacacaagatgtagaaaaattttgtaacagtgtagtcgatctgtattcaaatcttagtaagccatttttagacatagttttgtatatctttaagttaacgagtgcaattggagctcagggcccagcgagcatgatggcctacttggttgtttctgggctattcctaactcgacttcgaagacccattggtaagatgacaataactgagcaaaagtatgaaggagaatatagatatgttaattctcggctcatcacaaacagtgaagaaattgccttttacaatgggaataaaagagaaaagcagacagtccactcagtcttccgaaaactggtggaacacctacataatttcattttgtttcggttttcaatgggcttcattgatagtattattgccaaataccttgccactgttgttggttacctagttgtcagtcgccctttcttagatttgtctcatcctcgacatctcaagagtacacattcggaacttctagaggattactaccaaagtggaagaatgcttttgcgaatgtctcaagctctgggtcgaatagttttggctgggcgtgaaatgactagattggccggttttactgctcggattacagaattaatgcaagtactgaaggatttaaatcatggcaaatatgagcgcacaatggtctcacaacaggaaaagggtattgaaggagtacaagtcattcccttgatacctggtgctggagaaatcattattgcagataacattataaagtttgatcatgttcctttagcaacgccaaatggagatgttttgatccgagaccttaattttgaagttcgatctggggctaatgttctaatttgtggtccaaatggctgcggaaagagttcacttttccgtgttcttggtgaattatggcctctttttggaggacgtctaactaaacctgaaagaggaaaattattttatgttcctcagagaccttacatgacccttggaacacttcgagatcaagtgatatatccagatggacgagaagatcagaaaaggaagggaatttctgacctagtactgaaggaatacttagacaatgtccagttgggtcatatccttgaacgtgaaggaggctgggacagtgttcaggattggatggacgtactcagtggtggagaaaagcaaagaatggcgatggcaagattattttatcataaaccccagtttgccattttggatgaatgcacaagtgcagttagtgtcgacgtggaaggctacatttatagtcattgtcgaaaggttggcatcactctcttcactgtgtctcataggaaatctctttggaaacatcatgagtactacctgcatatggatggcagaggcaactatgaattcaaacagataacagaagatacagttgagtttggctcttagagaaatctggagaactatacctgcttcagtgaaataattacagaatatacttagaaaggcaaagtacattgtaaaataaagttgagcttagttttttttaaaaaaaaaaacaaagcaacaaattaactagatacagaataatggagaacaagttgttaaaacatttaatattatataggatattgctaattgtgtatatgttggtttaattaataatatgtactaagaatgtccttattcttgtggttagatgtaaaccattcgaagtcagctaattggacttttatggctctatcttttccttcagtgaagaaccctatttaaaactgggtcatcatttgtcctgttctagcaagatagtcttcagtttcattttcctgtgccctgtggtagttggaaacaaatcataatgtattatttaaatgtttaacatcattgcataacagcgtttattatacagtggcagatttctttagctgccacagtaatactcattccttgtgtgtgtcttggagtgcatttgactccaggaaaagccattttggttttccttaactaaatgataaatgtacccctctcagtctgcagtattgagttgtttaaagtatatgtgcagtcttgcttacaaggaggggttaccatgtatcacacctaatcttcccaatgtttgggatattaaaacacaaagtccttaacatgccaggctcaaggtcttataagagttctagatttttaagagaattagacaaatttgtgtgtgttagaagcccattcattagaagtgtggtggttatttggtattaaactccaaatgagccataggaaggcactacatgaaataatgcactgagtatgcaatgctatcactgtctttgactgtgattttatgtttaaaaagtatgttctaaaattattatatatacatgggtgaattatgtttccgaggcactgttttatctctgtgaatcttgaataacttttttatatttgggttatgatgtcaaacgatcctaagcgaagatgatttcagttcatcaaatcatcattaatgactttatgtattatttgcacagggagaattgaaactgagtataatcaataagctagatacgaaatcagtttctcaaactgagcttcagaaaggggcattttgtactcttgtttttgcataactggttttgtttttttgcagaattaactataacaatcactggctaccgaagtaaactgatgtactgaattccataatacataacattcaatttttaccacttctgtttagcgaacttgtatacttattttctgttcagattaaaaaaaaaaaaaaaaactcagatatcctatacaacctttgcttgttctttttattctggtatctaaatactgagaagttcatttataattcagccttgacttgaaaacatagatagtttaatcttgacttgaaaaacacaaaaataaattcagaaaatgcttttaaaaaaaagtctct

SEQ ID NO: 456087 - DNA, 3121 bp, Homo sapiens
agcggagtgaggtagccgccgccgccgccgccgccgcgtcccctcgccggctcgctggtaccggcagtgccatggcggccttcagcaagtacttgacggcgcgaaactcctcgctggctggtgccgcgttcctgctgctctgcctgctccacaagcggcgccgcgccctcggcctgcacggtaagaaaagtggaaaaccaccattacagaacaatgagaaagaggggaaaaaggagcgagctgtggtggacaaggtgtttttctcaaggctcatacagattctgaaaatcatggtccctagaacattttgtaaagagacaggttacttggtacttattgctgttatgctggtgtctcgaacatattgtgatgtttggatgattcaaaatgggacactaattgaaagtggtatcattggtcgtagcaggaaagatttcaagagatacttactcaacttcatcgctgccatgcctcttatctctctggttaataacttcttgaagtatgggttaaatgagcttaaactgtgcttccgagtaaggctcactaaatacctctatgaggagtatcttcaagctttcacatattataaaatggggaatctggacaacagaatagctaatccagaccagctgcttacacaagatgtagaaaaattttgtaacagtgtagtcgatctgtattcaaatcttagtaagccatttttagacatagttttgtatatctttaagttaacgagtgcaattggagctcagggcccagcgagcatgatggcctacttggttgtttctgggctattcctaactcgacttcgaagacccattggtaagatgacaataactgagcaaaagtatgaaggagaatatagatatgttaattctcggctcatcacaaacagtgaagaaattgccttttacaatgggaataaaagagaaaagcagacagtccactcagtcttccgaaaactggtggaacacctacataatttcattttgtttcggttttcaatgggcttcattgatagtattattgccaaataccttgccactgttgttggttacctagttgtcagtcgccctttcttagatttgtctcatcctcgacatctcaagagtacacattcggaacttctagaggattactaccaaagtggaagaatgcttttgcgaatgtctcaagctctgggtcgaatagttttggctgggcgtgaaatgactagattggccggttttactgctcggattacagaattaatgcaagtactgaaggatttaaatcatggcaaatatgagcgcacaatggtctcacaacaggaaaagggtattgaaggagtacaagtcattcccttgatacctggtgctggagaaatcattattgcagataacattataaagtttgatcatgttcctttagcaacgccaaatggagatgttttgatccgagaccttaattttgaagttcgatctggggctaatgttctaatttgtggtccaaatggctgcggaaagagttcacttttccgtgttcttggtgaattatggcctctttttggaggacgtctaactaaacctgaaagaggaaaattattttatgttcctcagagaccttacatgacccttggaacacttcgagatcaagtgatatatccagatggacgagaagatcagaaaaggaagggaatttctgacctagtactgaaggaatacttagacaatgtccagttgggtcatatccttgaacgtgaaggaggctgggacagtgttcaggattggatggacgtactcagtggtggagaaaagcaaagaatggcgatggcaagattattttatcataaaccccagtttgccattttggatgaatgcacaagtgcagttagtgtcgacgtggaaggctacatttatagtcattgtcgaaaggttggcatcactctcttcactgtgtctcataggaaatctctttggaaacatcatgagtactacctgcatatggatggcagaggcaactatgaattcaaacagataacagaagatacagttgagtttggctcttagagaaatctggagaactatacctgcttcagtgaaataattacagaatatacttagaaaggcaaagtacattgtaaaataaagttgagcttagttttttttaaaaaaaaaaacaaagcaacaaattaactagatacagaataatggagaacaagttgttaaaacatttaatattatataggatattgctaattgtgtatatgttggtttaattaataatatgtactaagaatgtccttattcttgtggttaaaaacctgcctaaattaaattgggcttcaatcactgtaacctgattcatcctgggatgtaaaccattcgaagtcagctaattggacttttatggctctatcttttccttcagtgaagaaccctatttaaaactgggtcatcatttgtcctgttctagcaagatagtcttcagtttcattttcctgtgccctgtggtagttggaaacaaatcataatgtattatttaaatgtttaacatcattgcataacagcgtttattatacagtggcagatttctttagctgccacagtaatactcattccttgtgtgtgtcttggagtgcatttgactccaggaaaagccattttggttttccttaactaaatgataaatgtacccctctcagtctgcagtattgagttgtttaaagtatatgtgcagtcttgcttacaaggaggggttaccatgtatcacacctaatcttcccaatgtttgggatattaaaacacaaagtccttaacatgccaggctcaaggtcttataagagttctagatttttaagagaattagacaaatttgtgtgtgttagaagcccattcattagaagtgtggtggttatttggtattaaactccaaatgagccataggaaggcactacatgaaataatgcactgagtatgcaatgctatcactgtctttgactgtgattttatgtttaaaaagtatgttctaaaattattatatatacatgggtgaattatgtttccgaggcactgtttggactctgggcactgtttggactctgggcactgtttggactctgggcactgtttggactctg

SEQ ID NO: 456088 - DNA, 2083 bp, Homo sapiens
gccgacgcgtgcagacgtccttctaatcctagtcttcgtttggtccggttgcactcttcctatagcccagagggcgagagggcctgtggcctgggggaaggaggacgaggttctgcctggatcccagcagtaggacgctgtgccatttgggaacaaaggaatagtctgcctggaatccctgcagatcttggggccggaggccagtccaacccttggagcaggaagaaacgcaaagttgtcaagaaccaagtcgagctgcctcagagccggcccgcagtagctgcagactccgcccgcgacgtgtgcgcgcttctctgggccagagcgagcctgttttgtgctcgggttaagagatttgtcccagctataccatgggccgcactcgggaagctggctgcgtggccgctggtgtggttatcggggctggtgcctgctactgtgtatacagactggcttggggaagagacgagaacgagaaaatctgggacgaagacgaggagtctacggacacctcagagattggggttgagactgtgaaaggagctaaaactaacgctggggcagggtctggggccaaacttcagggtgattcagaggtcaagcctgaggtgagtttgggactcgaggattgtccgggtgtaaaagagaaggcccattcaggatcccacagcggaggtggcctagaggccaaggccaaggcccttttcaacacgctgaaggaacaggcaagtgcaaaggcaggcaaaggggctagggtgggtaccatctctgggaacaggacccttgcaccgagtttaccctgcccaggaggcaggggtggaggctgccaccccaccaggagtggatctagggccgggggcagggcaagtggaaaatccaagggaaaggcccgaagtaagagcaccagggctccagctacaacatggcctgtccggagaggcaagttcaactttccttataaaattgatgatattctgagtgctcccgacctccaaaaggtcctcaacatcctggagcgaacaaatgatccttttattcaagaagtagccttggtcactctgggtaacaatgcagcatattcatttaaccagaatgccatacgtgaattgggtggtgtcccaattattgcaaaactgataaaaacaaaagaccccataattagggaaaagacttacaatgcccttaataacttgagtgtgaacgcagaaaatcagggcaagattaagacgtacatcagtcaagtgtgtgatgacaccatggtctgtcgcttggactcagctgtgcagatggctgggctaagactgttaaccaacatgactgtgactaatcattaccaacatttgctttcctattcttttccagacttttttgctttgttattcctgggaaatcacttcaccaagatacagattatgaaactaattataaactttactgaaaatccagccatgacaagagagctggtcagttgtaaagtaccatcagaattgatttccctctttaataaagaatgggatagagagattcttcttaatatccttaccctatttgagaatataaatgacaacataaaaaatgaagggctcgcatcatccaggaaagaattcagcagaagttcactttttttcttattcaaagagtctggagtttgtgttaagaaaatattaaccaaactctaatttggagtctgtcccaaacaatattgagatatttgcagttggtacgatgtgatttgtaaattctttgtttttcattgtgcgtatatggtaaagagatcttttcagctgctattttggaataatgactatcatatatcataacagtgactgatgttggttgtaatggttgggtttaggatgaaccattttaaggatgccaaatgaaatattagtatttgtacacagaaagaatttattgatttgatcttattacctagattgagattttttaatctttcctctacctaaactgacaatgaattggttatacatcatgcataagctacacttttatattagtttatatttgttattctaagacttgtgtttcatcaataaagttgtgttttaagcagcagaaaaaa

SEQ ID NO: 456089 - DNA, 2137 bp, Homo sapiens
gccgacgcgtgcagacgtccttctaatcctagtcttcgtttggtccggttgcactcttcctatagcccagagggcgagagggcctgtggcctgggggaaggaggacgaggttctgcctggatcccagcagtaggacgctgtgccatttgggaacaaaggaatagtctgcctggaatccctgcagatcttggggccggaggccagtccaacccttggagcaggaagaaacgcaaagttgtcaagaaccaagtcgagctgcctcagagccggcccgcagtagctgcagactccgcccgcgacgtgtgcgcgcttctctgggccagagcgagcctgttttgtgctcgggttaagagatttgtcccagctataccatgggccgcactcgggaagctggctgcgtggccgctggtgtggttatcggggctggtgcctgctactgtgtatacagactggcttggggaagagacgagaacgagaaaatctgggacgaagacgaggagtctacggacacctcagagattggggttgagactgtgaaaggagctaaaactaacgctggggcagggtctggggccaaacttcagggtgattcagaggtcaagcctgaggtgagtttgggactcgaggattgtccgggtgtaaaagagaaggcccattcaggatcccacagcggaggtggcctagaggccaaggccaaggcccttttcaacacgctgaaggaacaggcaagtgcaaaggcaggcaaaggggctagggtgggtaccatctctgggaacaggacccttgcaccgagtttaccctgcccaggaggcaggggtggaggctgccaccccaccaggagtggatctagggccgggggcagggcaagtggaaaatccaagggaaaggcccgaagtaagagcaccagggctccagctacaacatggcctgtccggagaggcaagttcaactttccttataaaattgatgatattctgagtgctcccgacctccaaaaggtcctcaacatcctggagcgaacaaatgatccttttattcaagaagtagccttggtcactctgggtaacaatgcagcatattcatttaaccagaatgccatacgtgaattgggtggtgtcccaattattgcaaaactgataaaaacaaaagaccccataattagggaaaagacttacaatgcccttaataacttgagtgtgaacgcagaaaatcagggcaagattaagacgtacatcagtcaagtgtgtgatgacaccatggtctgtcgcttggactcagctgtgcagatggctgggctaagactgttaaccaacatgactgtgactaatcattaccaacatttgctttcctattcttttccagacttttttgctttgttattcctgggaaatcacttcaccaagatacagattatgaaactaattataaactttactgaaaatccagccatgacaagagagctggtcagttgtaaagtaccatcagaattgatttccctctttaataaagaatgggatagagagattcttcttaatatccttaccctatttgagaatataaatgacaacataaaaaatgaagggctcgcatcatccaggaaagaattcagcagaagttcactttttttcttattcaaagagtctggagtttgtgttaagaaaatcaaagcactagcaaatcacaatgatctggtggtgaaagtaaaagtcctgaaagtattaaccaaactctaatttggagtctgtcccaaacaatattgagatatttgcagttggtacgatgtgatttgtaaattctttgtttttcattgtgcgtatatggtaaagagatcttttcagctgctattttggaataatgactatcatatatcataacagtgactgatgttggttgtaatggttgggtttaggatgaaccattttaaggatgccaaatgaaatattagtatttgtacacagaaagaatttattgatttgatcttattacctagattgagattttttaatctttcctctacctaaactgacaatgaattggttatacatcatgcataagctacacttttatattagtttatatttgttattctaagacttgtgtttcatcaataaagttgtgttttaagcagcagaaaaaa

SEQ ID NO: 456090 - DNA, 897 bp, Homo sapiens
  misc_feature (594)..(594): n is a, c, g, or t
  misc_feature (612)..(612): n is a, c, g, or t
  misc_feature (631)..(631): n is a, c, g, or t
  misc_feature (633)..(633): n is a, c, g, or t
  misc_feature (637)..(637): n is a, c, g, or t
  misc_feature (643)..(643): n is a, c, g, or t
  misc_feature (648)..(648): n is a, c, g, or t
  misc_feature (650)..(650): n is a, c, g, or t
  misc_feature (658)..(659): n is a, c, g, or t
  misc_feature (662)..(662): n is a, c, g, or t
  misc_feature (667)..(667): n is a, c, g, or t
  misc_feature (680)..(680): n is a, c, g, or t
  misc_feature (683)..(683): n is a, c, g, or t
aagcagtggtatcaacgcagagtggccattacggccggggcttttttcttttttttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaaaaaaaaaaaaaaaaaaaaaaaaaaaaaaaaaaaaaaangggggggggggtaaaaantttcccccggggggggccnangttnacgggntaccncnggtttttnnttnacaangggggcccataanggngagcgaggtttattaagagaggacgaggggccgcggtaaaaaagcgtgggtagtgggtacaacgtgctacgttgggcatcttggggaaggaactctacttgggggggtggaccattaggggccacccccaaggaaatttaagggcctagggaatattaacatgacggtatgtggaacacgggatttgtggggaagttggcaggtattttacatt

SEQ ID NO: 456091 - DNA, 501 bp, Homo sapiens
  misc_feature (22)..(22): n is a, c, g, or t
aaaacagctaggtggaggacgnggttgaagatgtcgaagcggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaa

SEQ ID NO: 456092 - DNA, 828 bp, Homo sapiens
  misc_feature (575)..(575): n is a, c, g, or t
  misc_feature (584)..(584): n is a, c, g, or t
cccacgcgtccgcggacgcgtggggtcgaagcggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaaaaaaaaaaaaaaaaaaaaaaaaaaaaaaaaaaaaaaaaaaaaaaagaaaaaaaaaaaaaaaaaaaaaagggggggggggggnaaaaaaatnccccgggggggggcacaaatttgggcgccccccccatttttcgagaaaaggggggcgcccataaggaggaggcgccataataaaaagcgagacgaacgggggccgcgtaaaacacagcggcgcggcgtgggacacaccgctccgcggggggaaaccggggaaaagacccccacggggggggggcaattggggacacacccccagaaaaatagagcgggggacaaaaacacggggcatcggggac

SEQ ID NO: 456093 - DNA, 961 bp, Homo sapiens
  misc_feature (22)..(22): n is a, c, g, or t
  misc_feature (511)..(511): n is a, c, g, or t
  misc_feature (515)..(515): n is a, c, g, or t
  misc_feature (519)..(519): n is a, c, g, or t
  misc_feature (525)..(525): n is a, c, g, or t
aaaacagctaggtggaggacgnggttgaagatgtcgaagcggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaaaagaaaacanacancaanacacanaaacaccaacaacacacaccaccaccccccccacaccacccacccccccccccctccaccccaccccacacacacccacccccccccccacccaccccccccccaccaccatcaccaccccgacgctccacactccatcccccccacccacactaacacacaaccccacactacccccccacaaccaacacccgcccggccgcgcaacacacccacgtgcgaccaagacaaaccccgctccccctcaaccacacaaaccaccccagcgcacccacagccgcaccgacacgacacccacaccccagcacacaccctcgccctgcgcccagccaataccgcacaatcccacggccccaccaccaccagccgcccgcacccccccaccccacccccaccgacacccccaccaccccccaccccccaccccccgctgcgg

SEQ ID NO: 456094 - DNA, 496 bp, Homo sapiens
  misc_feature (1)..(1): n is a, c, g, or t
  misc_feature (11)..(11): n is a, c, g, or t
  misc_feature (18)..(19): n is a, c, g, or t
  misc_feature (41)..(41): n is a, c, g, or t
  misc_feature (44)..(44): n is a, c, g, or t
  misc_feature (48)..(48): n is a, c, g, or t
  misc_feature (51)..(51): n is a, c, g, or t
  misc_feature (56)..(56): n is a, c, g, or t
  misc_feature (107)..(107): n is a, c, g, or t
  misc_feature (120)..(120): n is a, c, g, or t
ntttctttttnccggcgnncaagaattctttgctaggacgnggngggnccncaggngcgaaaagccgttttttattaaaacttgcgggagcacccccaatcaattgngctgacaacacangagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaa

SEQ ID NO: 456095 - DNA, 543 bp, Homo sapiens
ttttatttacattcttttgtaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgctggagtgcagtaacaccactgaagctcactgtaactttgaactgctggacttggaatcctcctgctgtggccttcaaagggctgcaattacaagtgtgagccactgcatcccacctcacattttattctttggagattttttttgacttggattaaaaaactttatatttacacttca

SEQ ID NO: 456096 - DNA, 1101 bp, Homo sapiens
aggcttgcccatggtgtcagactaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaaaaaaaaaaaaaacaaaacaacaacaaatgtggggcgcgcgaccaggcgccctggaaacaccttcaaaaccccacgagaagggaccccgcggcccacaaaggcacacgggaaacaggggccaaaccatgacacccaaggaaaaccgggagccaaaacacaaggcgacggaaatcccaccaaaatacaaaccgccggaggacaacccgaaacgtcgagacacaaccccacaagagcacaccagcgagaacaccacacggcgaccccaaccacagagagctcaaagcgaagccacgtaaacaaaaatagcggcccaaaacgagggaaacacaacacaccacaaaaacaacacgcaaaaccacagacagcaccaacacagagcaacacacagaagcacaccaccgccaacccgaccaccacaacacgacactccacaacacgccacaaacatctatggacaccatataccatactcactcccgtcacacatcaccctaattaatcaattcattcacacgaccacactcacctcatctgtaccattcagccacaacgctgagtgccacccatcggtggtgcgtagtgtccgtgtgcggctgttgtggcagccctgacccccggcgcagccatatcgggaggccgggcgttgggcgtaggagtagaaagcgtcggtgactgtggcgtgatcggcaggcgctacgggaggggtcagttagactggagggtagagcgagggacgacgccctggcgcgcgggcgggcggtacaccggtgaggcgggagggaggagtggtcgtcggcgcgagc

SEQ ID NO: 456097 - DNA, 950 bp, Homo sapiens
gcggccgcctactactactaaattcgcggccgcgtcgacgagtcgaagcgtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaaaaaaacacaaacaaaacaaaaacaaatgtttgggcccccccccgcggcccacaaaacaagacctttaaaaaccacaaatggctttagtgggcccgagcggccccaccatgtgcgggacactaccacaaccagctcggaaccaggcccgcctcgactccacccaaaagaggaaaacccaccgggccgcgcacccaacagcgcgcacgaggacccccaccccacaaaatgaaaacaaccccgccgcggcagagacacccaagacgcaggctccagaaacaaactaaactcccaaatggcaggcacaacagccacggcaccacccagggaaccacaaaccaacccgcgcgcaccacacgcaggccccgcgaatcatccaaataacatcaccgccacggcagggaacacaccacacaaccaccaacgcccccccccacaccggcaccaacgacaaacacaacgccaacacgcccgaagcaggggtaccaacaccgacggggaaccacccgaaaggcaccacaaatccaacgacaccacccccaccacaagacaacaggacgcacagacgcgcaccaaaggcacacactagcgcatccgactacccacataccgaaagaaccaaacgaccagcgcgcacatgcacttgcatagcgtac

SEQ ID NO: 456098 - DNA, 251 bp, Homo sapiens
atggaccatggatgtgacggaatgtgcgagctgcgggaccccgccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaagtctgccattacaggccagtagcagcaggagaaatgccgggggaaacccggctcga

SEQ ID NO: 456099 - DNA, 542 bp, Homo sapiens
  misc_feature (27)..(27): n is a, c, g, or t
  misc_feature (31)..(31): n is a, c, g, or t
  misc_feature (33)..(34): n is a, c, g, or t
  misc_feature (38)..(38): n is a, c, g, or t
cgaccacgcgtcgcggacgcgtgggtngacncnngcgnccttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaa

SEQ ID NO: 456100 - DNA, 554 bp, Homo sapiens
ctgtggccatcaccatgtcacccacaccagcagcgggaagtctgttcagccgttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaa

SEQ ID NO: 456101 - DNA, 971 bp, Homo sapiens
  misc_feature (971)..(971): n is a, c, g, or t
agcgggctcgggccacgtgaggagggtgggcggggcgttaaagttcatatcccagtgtcctttgaatcgacttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaaaaaaaaaaaaaaaaagggcgccgtcgcgatctagaattaagccctcgtagtaacagccattctcatccaaaccccctgaagtttaaccggcgcagtcattctcataatcgcccagggtttaatcctcattagtattcgtggctagcaaactcaaatacgaacgcatcacagtcgcatcataatcctctctcaaggatttcaaatctatcccaataataggtttggaaggacttctaggcaagctcgtaacttcgctttacccccattattactatggggagaacctctgggtaataacaggctcctgataatataatttctattaggatcgaatataggaagcttatcctttaaatttcccaacaggggtctcccccattaaataaccttaaggaaan

SEQ ID NO: 456102 - DNA, 954 bp, Homo sapiens
  misc_feature (649)..(649): n is a, c, g, or t
  misc_feature (665)..(665): n is a, c, g, or t
  misc_feature (673)..(673): n is a, c, g, or t
  misc_feature (683)..(683): n is a, c, g, or t
  misc_feature (685)..(685): n is a, c, g, or t
  misc_feature (693)..(693): n is a, c, g, or t
  misc_feature (695)..(695): n is a, c, g, or t
  misc_feature (703)..(703): n is a, c, g, or t
  misc_feature (709)..(709): n is a, c, g, or t
  misc_feature (714)..(714): n is a, c, g, or t
  misc_feature (725)..(725): n is a, c, g, or t
  misc_feature (727)..(727): n is a, c, g, or t
  misc_feature (729)..(729): n is a, c, g, or t
  misc_feature (739)..(739): n is a, c, g, or t
  misc_feature (745)..(745): n is a, c, g, or t
  misc_feature (752)..(752): n is a, c, g, or t
  misc_feature (761)..(761): n is a, c, g, or t
  misc_feature (765)..(765): n is a, c, g, or t
  misc_feature (768)..(768): n is a, c, g, or t
  misc_feature (772)..(772): n is a, c, g, or t
  misc_feature (776)..(776): n is a, c, g, or t
  misc_feature (781)..(781): n is a, c, g, or t
  misc_feature (787)..(787): n is a, c, g, or t
  misc_feature (789)..(791): n is a, c, g, or t
  misc_feature (793)..(793): n is a, c, g, or t
  misc_feature (796)..(797): n is a, c, g, or t
  misc_feature (954)..(954): n is a, c, g, or t
agcgggctcgggccacgtgaggagggtgggcggggcgttaaagttcatatcccagtgtcctttgaatcgacttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaaaaaaaaaaaaaaaaaaaaaaaaaaaaaaaaaaaaaaaaaaaaaaaaaaaaaaaaaaaaaaaaaaaaaaaaaaaaanaaaaaaaaaaaccttntgggccgnttgggccaantnaattttanantgggcaantttatncttgnggccgaatttngngntaattgggcnatttcnccttatngggggcggnttanaantaantggncgggntttaanannntnggnnttggaaaacccttgggtgttcccaaatttaaacgcctttgaacaaattccccttttggcaagtgtggttaatggcaaaagggcccaacgattggcttttccaaaaagtgggcaacctttatgggcaaagggaattgggcgttttttgggttcgggcn

SEQ ID NO: 456103 - DNA, 2797 bp, Homo sapiens
agcgggctcgggccacgtgaggagggtgggcggggcgttaaagttcatatcccagtgtcctttgaatcgacttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaaaaagtatttgtttgcagtgcttgtctccctgttcacttccagggttcaagcgattctcctgcctcagcctcctaagtagctgggattacaggcacctgccgtcatgcctggctagtttttgtatttttggtggagacagggtttcaccatgtttgccaaacgactcaaactcctgatctcaagtgatctgcccacccaggcctctgcagtgtttttgacataccctgaccatcacttttctgaaatggaaactctgggcattttttttttaaagcaatccttgcttttttgtgagtttgcagactttcagcatcttccaattgctgtatttacaattttggcctcaaaaagtattatttgggttttgagtcccaaaaataatagtagatactgctcaatgactggctatacatggtagcttctcctggagtgaggaaggcattcaaatggctgggcgcggtagctggcacctgtaatcccaacactttcggaggccaaggcaggcagatcatgaggtcaggagttcaagaccaggctgaccaacgtggtgaaacctcctcttttctaaaaatacaaaaattagctgggcgtggtggcgcaccgcctgtaatctcagctactgagagaatcgcttgaacctgggaggtggagtttgcagcgagtcgagattgcaccattgtactccatccagcctgggcaacggagcaagattccgttcccgcccccgccccaaaaaaaggcattgaagttaagatagactatatagttagatcctggacacacacatggattttgaggaatgatgtgagtttgtttatgtatgtacattttagcagttaacaggtttggagtaaattgaatatttataaaacaacagtaattgccatgtaggtttactgtcatagtggaagatgattaagttgatggtacctacaggtattttgctatgaaaatgttttgacaaacaggatgatcgtgtaatttatgttccaagctctagtttgagaatggaagaatgtggtaaatttttgccaactgaacaggcataaagcgctgataataagggacttggccttaaggtaggaggttgttagcatttctttctaaacgtgtaagagtttatttaggtgacacccagcgttttggaaaaatgggtgtttgtttagaacaataatttggagggaagtggactaaacagggtttttagattaaggtttgtgtttatgtatctgtatctgcaaatactcagccataaatgtttctacctgtaagttgggtataatacaagctccacttggtatcaaaaaggactacccttagtgtcttccatgactagttatggaatgtaccagacctagagaggagttgttctaacctggagcttttgaaaatgtttccggtccataccctagaccaattaagtcagactgcagaataggactcagacatcagaattgtgaagctcccaggagatgtcaaggtatacccaagactgagaaccagtaccctgtctagactgaaccaggcttggttttagaagtattaaatctcacctgggtacggtggctcacacctataatcccagcactttgggaggctgaggtgggtggatcatctgaggtcaggagagtgagaccagcctgtccaacatgttgaaaccccatctctactatacaaaattagccaggcatggtggtgcatgctgtaatcccagctacttgggaggctgaggcaggagaattgcttgaaccccggagatggaggttgcagtgagctgaggtcgcacgattgtgctccagcctgggcaaccagtgaaactctggggggaaagaaaaaaaatgtattaaatctctagttttagagagttacaccataacatccctgagtatggtcaatttcaagtcagctttagtgtgacaagcccctaggcccaccatttatgtctttatatattatggcaatatatgatccttatatattaaccactaatcgctgctgtttttgaatgttatcttttctgaggcagtcttgctctgtcacacaggctggagtgcagtaacaccactgaagctcactgtaactttgaactgctggacttggaatcctcctgctgtggccttcaaagggctgcaattacaagtgtgagccactgcatcccacctcacattttattctttggagattttttttgacttggattaaaaaactttatatttacacttca

SEQ ID NO: 456104 - DNA, 786 bp, Homo sapiens
  misc_feature (786)..(786): n is a, c, g, or t
agcgggctcgggccacgtgaggagggtgggcggggcgttaaagttcatatcccagtgtcctttgaatcgacttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaaaaaaaaaaaaaaaaaaaacatggcggccggtttggtccaatagactttagactagggcaagcttaaaaaagaaatggggaccgccttggcaccaggcaaatttagctttgagcaggttaatgattggcgcccaaattcgggctttattggccaattgcccttataggggtcggtataacattaactggcccggggttacggtcctttgggccn

SEQ ID NO: 456105 - DNA, 1212 bp, Homo sapiens
agcgggctcgggccacgtgaggagggtgggcggggcgttaaagttcatatcccagtgtcctttgaatcgacttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaagaaaaaaagagagagagaggggggcggcgcccctctccgctccggggggagacaaaaagagagacaccacgacgcgacaaagcaagcaaagaaggcgggagagcacacaagagcggcgcgggagctagaaaaacagggagagaaggaggggacaaggaaatagaaagcaaaaagagcagaaaggaaaaaaaacgagacgagagacaaacaaaaagaaggaggagaccaaaccacacaaaaagagggcggcggggggaaacccacagaggcggcagcaaaaacaacacaacaaaagcgacgaaaggaaaatagacgacccgcgcagggccgcagacaccagacgaaagacagaagacagggacggagcgcagacgcagcgcgggcggcgcccgaacccaaagacagaaaaaggagaaaacaaagcgaagaggaagaagacaagagcacgcagcggacgacgacaaagaacagacgagaacgcgcggacgaaagagacaaaaaacacacgaaggggacagacgagcacaagaccaagcagacgagggggg

SEQ ID NO: 456106 - DNA, 930 bp, Homo sapiens
  misc_feature (625)..(625): n is a, c, g, or t
  misc_feature (641)..(641): n is a, c, g, or t
  misc_feature (649)..(649): n is a, c, g, or t
  misc_feature (659)..(659): n is a, c, g, or t
  misc_feature (661)..(661): n is a, c, g, or t
  misc_feature (669)..(669): n is a, c, g, or t
  misc_feature (671)..(671): n is a, c, g, or t
  misc_feature (679)..(679): n is a, c, g, or t
  misc_feature (685)..(685): n is a, c, g, or t
  misc_feature (690)..(690): n is a, c, g, or t
  misc_feature (701)..(701): n is a, c, g, or t
  misc_feature (703)..(703): n is a, c, g, or t
  misc_feature (705)..(705): n is a, c, g, or t
  misc_feature (715)..(715): n is a, c, g, or t
  misc_feature (721)..(721): n is a, c, g, or t
  misc_feature (728)..(728): n is a, c, g, or t
  misc_feature (737)..(737): n is a, c, g, or t
  misc_feature (741)..(741): n is a, c, g, or t
  misc_feature (744)..(744): n is a, c, g, or t
  misc_feature (748)..(748): n is a, c, g, or t
  misc_feature (752)..(752): n is a, c, g, or t
  misc_feature (757)..(757): n is a, c, g, or t
  misc_feature (763)..(763): n is a, c, g, or t
  misc_feature (765)..(767): n is a, c, g, or t
  misc_feature (769)..(769): n is a, c, g, or t
  misc_feature (772)..(773): n is a, c, g, or t
  misc_feature (930)..(930): n is a, c, g, or t
agcgggctcgggccacgtgaggagggtgggcggggcgttaaagttcatatcccagtgtcctttgaatcgacttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaaaaaaaaaaaaaaaaaaaaaaaaaaaaaaaaaaaaaaaaaaaaaaaaaaaaanaaaaaaaaaaaccttntgggccgnttgggccaantnaattttanantgggcaantttatncttgnggccgaatttngngntaattgggcnatttcnccttatngggggcggnttanaantaantggncgggntttaanannntnggnnttggaaaacccttgggtgttcccaaatttaaacgcctttgaacaaattccccttttggcaagtgtggttaatggcaaaagggcccaacgattggcttttccaaaaagtgggcaacctttatgggcaaagggaattgggcgttttttgggttcgggcn

SEQ ID NO: 456107 - DNA, 881 bp, Homo sapiens
agcgggctcgggccacgtgaggagggtgggcggggcgttaaagttcatatcccagtgtcctttgaatcgacttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaaaaagaaaaaacctcggagactagttctctctctctctcctcgggagggaaggccaagggtggcaactttccttcgggtcgtcccgaatccggggtctcatccggacgaccagccggcctccaccatggccgccgaatgttcgaccccaaggagatcaaaggtcggtatacctggagggtggccccggtgagggtgaaatgtcgggtggaccattttggcctgtgggccccaaagatcgggccccctgggagtctgggtgcttcccaaaaaactgctgggtgatggccttcggccagggccagggggta

SEQ ID NO: 456108 - DNA, 599 bp, Homo sapiens
  misc_feature (577)..(577): n is a, c, g, or t
  misc_feature (590)..(590): n is a, c, g, or t
agcgggctcgggccacgtgaggagggtgggcggggcgttaaagttcatatcccagtgtcctttgaatcgacttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaacccntaataaaacaaanactcaaaaa

SEQ ID NO: 456109 - DNA, 908 bp, Homo sapiens
  misc_feature (655)..(655): n is a, c, g, or t
  misc_feature (664)..(664): n is a, c, g, or t
agcgggctcgggccacgtgaggagggtgggcggggcgttaaagttcatatcccagtgtcctttgaatcgacttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaaaaaaaaaaaaaaaaaaaaaaaaaaaaaaaaaaaaaaaaaaaaaaagaaaaaaaaaaaaaaaaaaaaaagggggggggggggnaaaaaaatnccccgggggggggcacaaatttgggcgccccccccatttttcgagaaaaggggggcgcccataaggaggaggcgccataataaaaagcgagacgaacgggggccgcgtaaaacacagcggcgcggcgtgggacacaccgctccgcggggggaaaccggggaaaagacccccacggggggggggcaattggggacacacccccagaaaaatagagcgggggacaaaaacacggggcatcggggac

SEQ ID NO: 456110 - DNA, 510 bp, Homo sapiens
gcggccgcctactactactaaattcgcggccgcgtcgacgagtcgaagcggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaa

SEQ ID NO: 456111 - DNA, 491 bp, Homo sapiens
gaggactctcctttaatcaagcagtcaagcggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaa

SEQ ID NO: 456112 - DNA, 2761 bp, Homo sapiens
aagcagtggtatcaacgcagagtggccattacggccggggcttttttcttttttccggcgttcaagatgtcgaagcggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaaaaagtatttgtttgcagtgcttgtctccctgttcacttccagggttcaagcgattctcctgcctcagcctcctaagtagctgggattacaggcacctgccgtcatgcctggctagtttttgtatttttggtggagacagggtttcaccatgtttgccaaacgactcaaactcctgatctcaagtgatctgcccacccaggcctctgcagtgtttttgacataccctgaccatcacttttctgaaatggaaactctgggcattttttttttaaagcaatccttgcttttttgtgagtttgcagactttcagcatcttccaattgctgtatttacaattttggcctcaaaaagtattatttgggttttgagtcccaaaaataatagtagatactgctcaatgactggctatacatggtagcttctcctggagtgaggaaggcattcaaatggctgggcgcggtagctggcacctgtaatcccaacactttcggaggccaaggcaggcagatcatgaggtcaggagttcaagaccaggctgaccaacgtggtgaaacctcctcttttctaaaaatacaaaaattagctgggcgtggtggcgcaccgcctgtaatctcagctactgagagaatcgcttgaacctgggaggtggagtttgcagcgagtcgagattgcaccattgtactccatccagcctgggcaacggagcaagattccgttcccgcccccgccccaaaaaaaggcattgaagttaagatagactatatagttagatcctggacacacacatggattttgaggaatgatgtgagtttgtttatgtatgtacattttagcagttaacaggtttggagtaaattgaatatttataaaacaacagtaattgccatgtaggtttactgtcatagtggaagatgattaagttgatggtacctacaggtattttgctatgaaaatgttttgacaaacaggatgatcgtgtaatttatgttccaagctctagtttgagaatggaagaatgtggtaaatttttgccaactgaacaggcataaagcgctgataataagggacttggccttaaggtaggaggttgttagcatttctttctaaacgtgtaagagtttatttaggtgacacccagcgttttggaaaaatgggtgtttgtttagaacaataatttggagggaagtggactaaacagggtttttagattaaggtttgtgtttatgtatctgtatctgcaaatactcagccataaatgtttctacctgtaagttgggtataatacaagctccacttggtatcaaaaaggactacccttagtgtcttccatgactagttatggaatgtaccagacctagagaggagttgttctaacctggagcttttgaaaatgtttccggtccataccctagaccaattaagtcagactgcagaataggactcagacatcagaattgtgaagctcccaggagatgtcaaggtatacccaagactgagaaccagtaccctgtctagactgaaccaggcttggttttagaagtattaaatctcacctgggtacggtggctcacacctataatcccagcactttgggaggctgaggtgggtggatcatctgaggtcaggagagtgagaccagcctgtccaacatgttgaaaccccatctctactatacaaaattagccaggcatggtggtgcatgctgtaatcccagctacttgggaggctgaggcaggagaattgcttgaaccccggagatggaggttgcagtgagctgaggtcgcacgattgtgctccagcctgggcaaccagtgaaactctggggggaaagaaaaaaaatgtattaaatctctagttttagagagttacaccataacatccctgagtatggtcaatttcaagtcagctttagtgtgacaagcccctaggcccaccatttatgtctttatatattatggcaatatatgatccttatatattaaccactaatcgctgctgtttttgaatgttatcttttctgaggcagtcttgctctgtcacacaggctggagtgcagtaacaccactgaagctcactgtaactttgaactgctggacttggaatcctcctgctgtggccttcaaagggctgcaattacaagtgtgagccactgcatcccacctcacattttattctttggagattttttttgacttggattaaaaaactttatatttacacttca

SEQ ID NO: 456113 - DNA, 573 bp, Homo sapiens
  misc_feature (545)..(545): n is a, c, g, or t
aagcagtggtatcaacgcagagtggccattacggccggggcttttttcttttttccggcgttcaagatgtcgaagcggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaaaaaaaaanaacacaagaaacaaaaaaaaaaaatgtg

SEQ ID NO: 456114 - DNA, 2730 bp, Homo sapiens
ctgtggccatcaccatgtcacccacaccagcagcgggaagtctgttcagccgttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaagcccggattgcatccaatgctggcagcattgcatgattctccagtatatttgtaaaaaataaaaaaaaactaaacccattaaaaaaaaagtatttgtttgcagtgcttgtctccctgttcacttccagggttcaagcgattctcctgcctcagcctcctaagtagctgggattacaggcacctgccgtcatgcctggctagtttttgtatttttggtggagacagggtttcaccatgtttgccaaacgactcaaactcctgatctcaagtgatctgcccacccaggcctctgcagtgtttttgacataccctgaccatcacttttctgaaatggaaactctgggcattttttttttaaagcaatccttgcttttttgtgagtttgcagactttcagcatcttccaattgctgtatttacaattttggcctcaaaaagtattatttgggttttgagtcccaaaaataatagtagatactgctcaatgactggctatacatggtagcttctcctggagtgaggaaggcattcaaatggctgggcgcggtagctggcacctgtaatcccaacactttcggaggccaaggcaggcagatcatgaggtcaggagttcaagaccaggctgaccaacgtggtgaaacctcctcttttctaaaaatacaaaaattagctgggcgtggtggcgcaccgcctgtaatctcagctactgagagaatcgcttgaacctgggaggtggagtttgcagcgagtcgagattgcaccattgtactccatccagcctgggcaacggagcaagattccgttcccgcccccgccccaaaaaaaggcattgaagttaagatagactatatagttagatcctggacacacacatggattttgaggaatgatgtgagtttgtttatgtatgtacattttagcagttaacaggtttggagtaaattgaatatttataaaacaacagtaattgccatgtaggtttactgtcatagtggaagatgattaagttgatggtacctacaggtattttgctatgaaaatgttttgacaaacaggatgatcgtgtaatttatgttccaagctctagtttgagaatggaagaatgtggtaaatttttgccaactgaacaggcataaagcgctgataataagggacttggccttaaggtaggaggttgttagcatttctttctaaacgtgtaagagtttatttaggtgacacccagcgttttggaaaaatgggtgtttgtttagaacaataatttggagggaagtggactaaacagggtttttagattaaggtttgtgtttatgtatctgtatctgcaaatactcagccataaatgtttctacctgtaagttgggtataatacaagctccacttggtatcaaaaaggactacccttagtgtcttccatgactagttatggaatgtaccagacctagagaggagttgttctaacctggagcttttgaaaatgtttccggtccataccctagaccaattaagtcagactgcagaataggactcagacatcagaattgtgaagctcccaggagatgtcaaggtatacccaagactgagaaccagtaccctgtctagactgaaccaggcttggttttagaagtattaaatctcacctgggtacggtggctcacacctataatcccagcactttgggaggctgaggtgggtggatcatctgaggtcaggagagtgagaccagcctgtccaacatgttgaaaccccatctctactatacaaaattagccaggcatggtggtgcatgctgtaatcccagctacttgggaggctgaggcaggagaattgcttgaaccccggagatggaggttgcagtgagctgaggtcgcacgattgtgctccagcctgggcaaccagtgaaactctggggggaaagaaaaaaaatgtattaaatctctagttttagagagttacaccataacatccctgagtatggtcaatttcaagtcagctttagtgtgacaagcccctaggcccaccatttatgtctttatatattatggcaatatatgatccttatatattaaccactaatcgctgctgtttttgaatgttatcttttctgaggcagtcttgctctgtcacacaggctggagtgcagtaacaccactgaagctcactgtaactttgaactgctggacttggaatcctcctgctgtggccttcaaagggctgcaattacaagtgtgagccactgcatcccacctcacattttattctttggagattttttttgacttggattaaaaaactttatatttacacttca

SEQ ID NO: 456115 - DNA, 448 bp, Homo sapiens
aaccaaggccttgtatgccacgccttatgaagcactgtttcacagttactttcacttcccgaataaaggttaccaggtaattaataaaaaaaaaaaaagtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaa

SEQ ID NO: 456116 - DNA, 2684 bp, Homo sapiens
ctgtggccatcaccatgtcacccacaccagcagcgggaagtctgttcagccgttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggggtgagtaaacactgagcccaccttaatactgatgagtagtggggggacgctttcctttattggaaaatggatcagttttcaaggcctcaagtttgttttccattgagaggcagtgtgagataagtatcttaagtttttgctcatattgtgttggaggggggaccatcatcttgtcacttccataccttagttgtttttttgttgttgtttttgttttgttttgttttgttttttgagatggagtctctctctgtcgcccagcccatactggagtgcaatggcacgatcttggctcactgcaacctccgcctcctgggctctcaaaaaaaaatatattacaaaacgaaaacaagctgcccgttgcttattttattatttgtttttgagatggagtctcacttgttgcccaggctggagtgcagtggcacatatctgttcactgcaacctccacctcccgggctcaagagattgtcctgcctcagcctcccgagtagctgggatcataggtgtgcaccaccacacccggctaattgctcattacttaatctcaggctccccactcaaaatttttcctgtcaggtgtatgatttaaagggggaggcctcaaaatacttgcagcttgtgtcctgtctggctttagaacttctggtgtttggtgcattttaacttcagcgcttgcacttttttcctgtgcctgcctaatctgtctctaccctgggatgtcttgctcttctaaagagttcctggccatcccttgatttacaaatgtgatgttgatttgtcagccctgtattacagttactcctattcctgtatccaccccacgatgctgtccagtagatttttagcctttgggttagaaattgttttttgttcaccattaatatccatttgagggctgggtagcactgtgattgtgattcagcaattgcatgggctttttcctcttctcagaacacttcctgggtctgattggtggcccagggagctgtcagagaagagcagagcaaatggccttcactttgtagatgagatggcaggagggtggattgttggtctcagtcagtggtgggacagaccagagctccgaacacttcagttttaaaactagttgtgagtttccaattctgttaatgtcttttttggtccttgtttctgctaaatgaatacatcccctccccttggaacttaatatcaataaataacaagcacagaaatatgcaaaaggaccaggtctacttgaagaatttgtgaggattaaatggtttatgagtagaggagggtcagtcagtaagtattggctacctcatgtgtgtcccattactaacttggttagacttatctattttttgtgtagtcttcctgtcataaaaattctgtgtaaggaccccatgctagtatcagtgaagattgtgaatccaggtgtgtctgactctacaatagttcttcacaagcattatatttcactgtgtagtgatacttcattttgaaagttgggaaaagcgtctttttcactttagtacagatgggtataaaagttacttaggacactagaaaacagttcattaaaagtaaaacaaagcctggtgcttgggcccaggaattcaaactgttttccagtgtaaatctgaatagcttggtctctgctcattgccaggactgggaggagttgggggtcccaggtcccatttctacatcccaattcagtgatactgggatcttaataacctacctgtgaggtgaagttggaaaaggcataggcaaggatagttgtcctgagagttttacacttgtgagaaaatactggcagctttgattttaagatgtgaatagatgatcgtggttcatgcctatactccctatactcccagcactttgggaggccaggcttgccaacatggcaaaaccctgtctctatgaaaaaaaaaaaaaaatctgggcatggtagtgtgcacctgtagtccaagatactagagaggctgaggtgggaggatcaccttgaagattgatatttacactgtcactgtctcaaacgctgagtgtacattctgtctagttggaaactgcttttgtggtggcactgcgacttgacaggttaatgactgctgtccttttttcttctctcagttacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaa

SEQ ID NO: 456117 - DNA, 486 bp, Homo sapiens
ctgtggccatcaccatgtcacccacaccagcagcgggaagtctgttcagccgttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaagttctgccattacaggaccagtagcaaaggagtgtgcagacttgtggccccggattgcatccaatgctggcagcattgcatgattctccagtatatttgtaaaaaataaaaaaaaactaaacccattaaaaaa

SEQ ID NO: 456118 - DNA, 404 bp, Homo sapiens
ctgtggccatcaccatgtcacccacaccagcagcgggaagtctgttcagccgttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaagaagaagaaaatgatccggatcattttcttcttccggaagaagaaaatgat

SEQ ID NO: 456119 - DNA, 339 bp, Homo sapiens
acaaatatactggagaattatgcaatgctgccagcattggatgcagtccggggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaa

SEQ ID NO: 456120 - DNA, 1864 bp, Homo sapiens
cttttgcaggaattagtactgaaattaatattaatcaatggcaaggaagaccagagcagaggatagtcctgtgacaaatggtcacaagcttctcccagctgtgaaatgtctttccttcataagtgactatttccattccctttcatgtatttgccttgtctggaagactttgattatgtgcttcttaggacacatataaagtccttactttgtatttggggcccagagaagtttagcaatttgcttaagctcacatagctagttagcagcagagctgggcctaaaatcttggaccatttccaaatccagtgtttgctttactgtatcacactgtgcaacgcttgtgttgatcactgtgagtacttaatatactagatttctaacagcagcctatttgcttctgattgccgactagttcacttcaattcatatttatcttaactgaaaaccactccttctgacggctcgtctgttgtctatagaaaatgagttggtgggctcattctagccctgttggacagccgaacccatcacaacaaatcaatgccaaaaatggcatttcaagaggaaaacatagcatttatttagtacccccaacagagtagctcaaagtgatttgaaaatgtctcattaatcctcataacacccctgtgggataataataatattattataacgtttaggcgtagaactgtggcaaagccaacagcttctctgagcatgtgcaggatttcctcatatttcagtctgcaatactagagcctgactaaaaccgtcaggtttgcaaacagcaagggtaaataaatcttggtgtttggcctttctgtgttgctctaggcatagtttgtgtttcctactgaccacatcaatcccagaaatagttcaccagttgtttgccagatggtaagcagcatttaggattagctcagaagtgtttgagagtgggacaaggcagggctagaggtcctgatccacaattacagataaatgaatggagaaatagcacctagtaacagtgtaaaagcgttcctatttctccacatcctctccagcatctgttgttttctgactttttaatgatcgccattctaactggcatgagatggtatctcattgtggttttgatttgcatttctctaatgaccagtgatggtgagctttttttcatgtttgttggctgcataaatgtcttcttttgagaggtgtctgttcatatccttcacccgctttttgatgggattgtttttttcttgtaaatttgtttaagttccttgcagattctggatattaaccctttgtcagatggatagatggcaaaaattttctcccattctgtaggttgtctgttcactctgatgatagtttcttttgctgtgcagaagctctttagtttaattaggccctatttgtcaattttggcttttgttcgcattgcttttactcatgcagtctttgcccatgcctatgtcctaaatggtattgcctaggttttcttctagggtttttatggttttaggttttacgtttaagtctttaatccatcttgagttaatttttgtatactgtataaggaaggggtccagtttcagttttctgcatatggctagccagttttcctacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaa

SEQ ID NO: 456121 - DNA, 434 bp, Homo sapiens
caaatatttattgatgttaaatccacattacaccagcacaacaatccaaagtagtatgattgattgatagtacttttttttttataaatacaatataaaggtggcaaaataatgctagttaatcccaaacccagcaaatcagcaaaaaaaggtcacattcagaaaaatttggcaagtaagacataagtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaa

SEQ ID NO: 456122 - DNA, 298 bp, Homo sapiens
aggcttgcccatggtgtcagactaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaa

SEQ ID NO: 456123 - DNA, 398 bp, Homo sapiens
  misc_feature (346)..(346): n is a, c, g, or t
ctgtggccatcaccatgtcacccacaccagcagcgggaagtctgttcagccgttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggggtacattcagcagtgtcattcgcaacgaagtcattccntgaaagatgcgtgtttcttattttgaggtatttggggcatgtttcaattggc

SEQ ID NO: 456124 - DNA, 2584 bp, Homo sapiens
  misc_feature (185)..(185): n is a, c, g, or t
  misc_feature (187)..(187): n is a, c, g, or t
  misc_feature (190)..(190): n is a, c, g, or t
ggctgagctcaacacaggaggaagtgcatcagctgagaagaggcatcgagaaactgagagttcgcattgaggccgatgaaaagaagcagctgcacatcgcagagaaactgaaagaacgcgagcgggagaatgattcacttaaggataaagttgagaaccttgaaagggaattgcagatgtcagangnaanccaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaaaaagtatttgtttgcagtgcttgtctccctgttcacttccagggttcaagcgattctcctgcctcagcctcctaagtagctgggattacaggcacctgccgtcatgcctggctagtttttgtatttttggtggagacagggtttcaccatgtttgccaaacgactcaaactcctgatctcaagtgatctgcccacccaggcctctgcagtgtttttgacataccctgaccatcacttttctgaaatggaaactctgggcattttttttttaaagcaatccttgcttttttgtgagtttgcagactttcagcatcttccaattgctgtatttacaattttggcctcaaaaagtattatttgggttttgagtcccaaaaataatagtagatactgctcaatgactggctatacatggtagcttctcctggagtgaggaaggcattcaaatggctgggcgcggtagctggcacctgtaatcccaacactttcggaggccaaggcaggcagatcatgaggtcaggagttcaagaccaggctgaccaacgtggtgaaacctcctcttttctaaaaatacaaaaattagctgggcgtggtggcgcaccgcctgtaatctcagctactgagagaatcgcttgaacctgggaggtggagtttgcagcgagtcgagattgcaccattgtactccatccagcctgggcaacggagcaagattccgttcccgcccccgccccaaaaaaaggcattgaagttaagatagactatatagttagatcctggacacacacatggattttgaggaatgatgtgagtttgtttatgtatgtacattttagcagttaacaggtttggagtaaattgaatatttataaaacaacagtaattgccatgtaggtttactgtcatagtggaagatgattaagttgatggtacctacaggtattttgctatgaaaatgttttgacaaacaggatgatcgtgtaatttatgttccaagctctagtttgagaatggaagaatgtggtaaatttttgccaactgaacaggcataaagcgctgataataagggacttggccttaaggtaggaggttgttagcatttctttctaaacgtgtaagagtttatttaggtgacacccagcgttttggaaaaatgggtgtttgtttagaacaataatttggagggaagtggactaaacagggtttttagattaaggtttgtgtttatgtatctgtatctgcaaatactcagccataaatgtttctacctgtaagttgggtataatacaagctccacttggtatcaaaaaggactacccttagtgtcttccatgactagttatggaatgtaccagacctagagaggagttgttctaacctggagcttttgaaaatgtttccggtccataccctagaccaattaagtcagactgcagaataggactcagacatcagaattgtgaagctcccaggagatgtcaaggtatacccaagactgagaaccagtaccctgtctagactgaaccaggcttggttttagaagtattaaatctcacctgggtacggtggctcacacctataatcccagcactttgggaggctgaggtgggtggatcatctgaggtcaggagagtgagaccagcctgtccaacatgttgaaaccccatctctactatacaaaattagccaggcatggtggtgcatgctgtaatcccagctacttgggaggctgaggcaggagaattgcttgaaccccggagatggaggttgcagtgagctgaggtcgcacgattgtgctccagcctgggcaaccagtgaaactctggggggaaagaaaaaaaatgtattaaatctctagttttagagagttacaccataacatccctgagtatggtcaatttcaagtcagctttagtgtgacaagcccctaggcccaccatttatgtctttatatattatggcaatatatgatccttatatattaaccactaatcgctgctgtttttgaatgttatcttttctgaggcagtcttgctctgtcacacaggctggagtgcagtaacaccactgaagctcactgtaactttgaactgctggacttggaatcctcctgctgtggccttcaaagggctgcaattacaagtgtgagccactgcatcccacctcacattttattctttggagattttttttgacttggattaaaaaactttatatttacacttca

SEQ ID NO: 456125 - DNA, 573 bp, Homo sapiens
agcgggctcgggccacgtgaggagggtgggcggggcgttaaagttcatatcccagtgtcctttgaatcgacttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaa

SEQ ID NO: 456126 - DNA, 537 bp, Homo sapiens
aagcagtggtatcaacgcagagtggccattacggccggggcttttttcttttttccggcgttcaagatgtcgaagcggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaa

SEQ ID NO: 456127 - DNA, 493 bp, Homo sapiens
cccacgcgtccgcggacgcgtggggtcgaagcggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaa

SEQ ID NO: 456128 - DNA, 830 bp, Homo sapiens
  misc_feature (27)..(27): n is a, c, g, or t
  misc_feature (31)..(31): n is a, c, g, or t
  misc_feature (33)..(34): n is a, c, g, or t
  misc_feature (38)..(38): n is a, c, g, or t
cgaccacgcgtcgcggacgcgtgggtngacncnngcgnccgacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaacaaaacacacaccaccccccccacacaccccccacccaccccccccccacccccccccacccccagcagacaaccgagtagcaccaagacaccacaacgggggggcccgcccccacccgccccccgccgggcaacccggcccacaccaccaccagagccaccggcgcccaagcgcgggcaccagaagagcggccgtcccaaccaacgaccgcggcaaacccgcccgcacctccgagcaaccaccctggggcccaccccacccacccagaaggcgcgcgcaacaacacccggcgtgcccacacaccggacacccggatcaaaatacgccgg

SEQ ID NO: 456129 - DNA, 400 bp, Homo sapiens
gcggccgcctactactactaaattcgcggccgcgtcgacgagtcgaagcggtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaa

SEQ ID NO: 456130 - DNA, 675 bp, Homo sapiens
  misc_feature (185)..(185): n is a, c, g, or t
  misc_feature (187)..(187): n is a, c, g, or t
  misc_feature (190)..(190): n is a, c, g, or t
  misc_feature (367)..(367): n is a, c, g, or t
  misc_feature (675)..(675): n is a, c, g, or t
ggctgagctcaacacaggaggaagtgcatcagctgagaagaggcatcgagaaactgagagttcgcattgaggccgatgaaaagaagcagctgcacatcgcagagaaactgaaagaacgcgagcgggagaatgattcacttaaggataaagttgagaaccttgaaagggaattgcagatgtcagangnaanccaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaaaaaaaanaaaaaaaaacaacaaaaacagaacagaaaaaaaaaaaaaaaaaaaaaaaaaaaaagcaaaaaaaaaaacaaaccagcaaaagaaaaaaaaagaaaaaaaaaaaaaaaaaaaaacatggcggccggtttggtccaatagactttagactagggcaagcttaaaaaagaaatggggaccgccttggcaccaggcaaatttagctttgagcaggttaatgattggcgcccaaattcgggctttattggccaattgcccttataggggtcggtataacattaactggcccggggttacggtcctttgggccn

SEQ ID NO: 456131 - DNA, 1034 bp, Homo sapiens
agcgggctcgggccacgtgaggagggtgggcggggcgttaaagttcatatcccagtgtcctttgaatcgacttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaaaaaaaaaaaaaaaaagatcgggggatttaatgggggggggggaaaagggggtaggaaatgtggcacatgtggccacgaggttcccggaacccgagtgtcttgctaccagggggaaaatcggcgggatccccaaagaggagaacgcgatataaatgcggaaagagcagggttaacccgggttaagaagcgggcacaactagagagaaagagagagagaaagcaacgacaaagcacgcagcgagaacaaacgagcaagagggacgcaacgacaacagtagaaaacaacaacaggaagagagaaaggagaaagacacaaaacgaatagacaacaacaaagaaagaaacaggagacgcgcaaagaaagaagaaagaagaagacgaaagaaaagagaagaagggggaggaaagaaaaagggaagggggaaaacagagggaagagaaaaggcggagaagagcggagt

SEQ ID NO: 456132 - DNA, 796 bp, Homo sapiens
agcgggctcgggccacgtgaggagggtgggcggggcgttaaagttcatatcccagtgtcctttgaatcgacttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaaaaaaaaaaaaaaaaaaaaaaaaaaaaaaaaaaaaaaaaaaaaaaaaaaaaaaaaaaaaaaaaaaaaaaaaaaaactctaggaggggccctttccccaattccccttatagggggtggttaaatttacctggccgcggtttaaaacgtgcgattgggaaacctctgcgttcccaacttgaacgctcttggagaaatcccccttttggcagtgtggcgaataaca

SEQ ID NO: 456133 - DNA, 914 bp, Homo sapiens
  misc_feature (611)..(611): n is a, c, g, or t
  misc_feature (629)..(629): n is a, c, g, or t
  misc_feature (648)..(648): n is a, c, g, or t
  misc_feature (650)..(650): n is a, c, g, or t
  misc_feature (654)..(654): n is a, c, g, or t
  misc_feature (660)..(660): n is a, c, g, or t
  misc_feature (665)..(665): n is a, c, g, or t
  misc_feature (667)..(667): n is a, c, g, or t
  misc_feature (675)..(676): n is a, c, g, or t
  misc_feature (679)..(679): n is a, c, g, or t
  misc_feature (684)..(684): n is a, c, g, or t
  misc_feature (697)..(697): n is a, c, g, or t
  misc_feature (700)..(700): n is a, c, g, or t
agcgggctcgggccacgtgaggagggtgggcggggcgttaaagttcatatcccagtgtcctttgaatcgacttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaaaaaaaaaaaaaaaaaaaaaaaaaaaaaaaaaaaaaaangggggggggggtaaaaantttcccccggggggggccnangttnacgggntaccncnggtttttnnttnacaangggggcccataanggngagcgaggtttattaagagaggacgaggggccgcggtaaaaaagcgtgggtagtgggtacaacgtgctacgttgggcatcttggggaaggaactctacttgggggggtggaccattaggggccacccccaaggaaatttaagggcctagggaatattaacatgacggtatgtggaacacgggatttgtggggaagttggcaggtattttacatt

SEQ ID NO: 456134 - DNA, 863 bp, Homo sapiens
agcgggctcgggccacgtgaggagggtgggcggggcgttaaagttcatatcccagtgtcctttgaatcgacttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaaaaaaaaaacaaaaataatcaaaattaatttaacaccattatttaactatatacttaatattacccttcattattactagactttttagcactaccctgtgctatctttcctcctaaacgacaacaaataaccaaattaattggggggtggcgccgaacccaaattcccttaataagggggtctatatcaaaataagacggccgtgtttaacataccgtttcttgaggaaaacctggagttcaacaaatttatggccagtgggaaaatccacttttgcaatggtgggttat

SEQ ID NO: 456135 - DNA, 1033 bp, Homo sapiens
  misc_feature (583)..(583): n is a, c, g, or t
  misc_feature (587)..(587): n is a, c, g, or t
  misc_feature (591)..(591): n is a, c, g, or t
  misc_feature (597)..(597): n is a, c, g, or t
agcgggctcgggccacgtgaggagggtgggcggggcgttaaagttcatatcccagtgtcctttgaatcgacttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaaaagaaaacanacancaanacacanaaacaccaacaacacacaccaccaccccccccacaccacccacccccccccccctccaccccaccccacacacacccacccccccccccacccaccccccccccaccaccatcaccaccccgacgctccacactccatcccccccacccacactaacacacaaccccacactacccccccacaaccaacacccgcccggccgcgcaacacacccacgtgcgaccaagacaaaccccgctccccctcaaccacacaaaccaccccagcgcacccacagccgcaccgacacgacacccacaccccagcacacaccctcgccctgcgcccagccaataccgcacaatcccacggccccaccaccaccagccgcccgcacccccccaccccacccccaccgacacccccaccaccccccaccccccaccccccgctgcgg

SEQ ID NO: 456136 - DNA, 1226 bp, Homo sapiens
agcgggctcgggccacgtgaggagggtgggcggggcgttaaagttcatatcccagtgtcctttgaatcgacttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaaaaaaacacaaacaaaacaaaaacaaatgtttgggcccccccccgcggcccacaaaacaagacctttaaaaaccacaaatggctttagtgggcccgagcggccccaccatgtgcgggacactaccacaaccagctcggaaccaggcccgcctcgactccacccaaaagaggaaaacccaccgggccgcgcacccaacagcgcgcacgaggacccccaccccacaaaatgaaaacaaccccgccgcggcagagacacccaagacgcaggctccagaaacaaactaaactcccaaatggcaggcacaacagccacggcaccacccagggaaccacaaaccaacccgcgcgcaccacacgcaggccccgcgaatcatccaaataacatcaccgccacggcagggaacacaccacacaaccaccaacgcccccccccacaccggcaccaacgacaaacacaacgccaacacgcccgaagcaggggtaccaacaccgacggggaaccacccgaaaggcaccacaaatccaacgacaccacccccaccacaagacaacaggacgcacagacgcgcaccaaaggcacacactagcgcatccgactacccacataccgaaagaaccaaacgaccagcgcgcacatgcacttgcatagcgtac

SEQ ID NO: 456137 - DNA, 881 bp, Homo sapiens
  misc_feature (27)..(27): n is a, c, g, or t
  misc_feature (31)..(31): n is a, c, g, or t
  misc_feature (33)..(34): n is a, c, g, or t
  misc_feature (38)..(38): n is a, c, g, or t
cgaccacgcgtcgcggacgcgtgggtngacncnngcgnccttccttttttcttttttccggcgttcaagatgtcgaagcgaggtgaggttttgtttctggaggatcctccaccatctgtcgtgcagtggctggcggattcgtcaggagcggtggccctaggcagctggggcgctttgctctccttcaggccggagagagagagccaggccaccgcgagagcactgccagggccctcgaaagtggcagtggggtgctggagagttgagatggcaggatcccgacgtgaatgtagtctggataccgcgagatcgctccgcgaatagggctatcgtaatggggttgaagttagactggattaggccctggtttgcgcgacctctgcggttttatgccttgcaggagtaattgcgttttgcgaaagacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaa

SEQ ID NO: 456138 - DNA, 691 bp, Homo sapiens
  misc_feature (140)..(140): n is a, c, g, or t
accccacctcctccgggcttcctcccggaaactcagcgcctgctgcacttgcctgccctgccttgcttggcacccgctccggcgaccctccccgctcccctgtcatttcatcgcggactgtgcggcctggggttgggggncgggactctcacggtgacatgtttacagctgggtgtgactcagtaaagtggatttttttttctttaaaaaaaaaatcaagatgtcgaagcggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaa

SEQ ID NO: 456139 - DNA, 718 bp, Homo sapiens
agcgggctcgggccacgtgaggagggtgggcggggcgttaaagttcatatcccagtgtcctttgaatcgacttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgctggagtgcagtaacaccactgaagctcactgtaactttgaactgctggacttggaatcctcctgctgtggccttcaaagggctgcaattacaagtgtgagccactgcatcccacctcacattttattctttggagattttttttgacttggattaaaaaactttatatttacacttca

SEQ ID NO: 456140 - DNA, 559 bp, Homo sapiens
  misc_feature (486)..(486): n is a, c, g, or t
  misc_feature (508)..(508): n is a, c, g, or t
  misc_feature (528)..(528): n is a, c, g, or t
ctgtggccatcaccatgtcacccacaccagcagcgggaagtctgttcagccgttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggcacagtcaagaaaggcanaccagagtctcagaaaaaaggnacatccagcagtggtcattngacaacgaaagtatacaatgacgtgcgtgtg

SEQ ID NO: 456141 - DNA, 477 bp, Homo sapiens
ctgtggccatcaccatgtcacccacaccagcagcgggaagtctgttcagccgttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaagtctgccattacaggaccagtagatatagaagagtgcacttttggggtaccgagctc

SEQ ID NO: 456142 - DNA, 2710 bp, Homo sapiens
ctgtggccatcaccatgtcacccacaccagcagcgggaagtctgttcagccgttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaagttctgccattacaggaccagtagcaaaggagtgtgcagacttgtggccccggattgcatccaatgctggcagcattgcatgattctccagtatatttgtaaaaaataaaaaaaaactaaacccattaaaaaaaaagtatttgtttgcagtgcttgtctccctgttcacttccagggttcaagcgattctcctgcctcagcctcctaagtagctgggattacaggcacctgccgtcatgcctggctagtttttgtatttttggtggagacagggtttcaccatgtttgccaaacgactcaaactcctgatctcaagtgatctgcccacccaggcctctgcagtgtttttgacataccctgaccatcacttttctgaaatggaaactctgggcattttttttttaaagcaatccttgcttttttgtgagtttgcagactttcagcatcttccaattgctgtatttacaattttggcctcaaaaagtattatttgggttttgagtcccaaaaataatagtagatactgctcaatgactggctatacatggtagcttctcctggagtgaggaaggcattcaaatggctgggcgcggtagctggcacctgtaatcccaacactttcggaggccaaggcaggcagatcatgaggtcaggagttcaagaccaggctgaccaacgtggtgaaacctcctcttttctaaaaatacaaaaattagctgggcgtggtggcgcaccgcctgtaatctcagctactgagagaatcgcttgaacctgggaggtggagtttgcagcgagtcgagattgcaccattgtactccatccagcctgggcaacggagcaagattccgttcccgcccccgccccaaaaaaaggcattgaagttaagatagactatatagttagatcctggacacacacatggattttgaggaatgatgtgagtttgtttatgtatgtacattttagcagttaacaggtttggagtaaattgaatatttataaaacaacagtaattgccatgtaggtttactgtcatagtggaagatgattaagttgatggtacctacaggtattttgctatgaaaatgttttgacaaacaggatgatcgtgtaatttatgttccaagctctagtttgagaatggaagaatgtggtaaatttttgccaactgaacaggcataaagcgctgataataagggacttggccttaaggtaggaggttgttagcatttctttctaaacgtgtaagagtttatttaggtgacacccagcgttttggaaaaatgggtgtttgtttagaacaataatttggagggaagtggactaaacagggtttttagattaaggtttgtgtttatgtatctgtatctgcaaatactcagccataaatgtttctacctgtaagttgggtataatacaagctccacttggtatcaaaaaggactacccttagtgtcttccatgactagttatggaatgtaccagacctagagaggagttgttctaacctggagcttttgaaaatgtttccggtccataccctagaccaattaagtcagactgcagaataggactcagacatcagaattgtgaagctcccaggagatgtcaaggtatacccaagactgagaaccagtaccctgtctagactgaaccaggcttggttttagaagtattaaatctcacctgggtacggtggctcacacctataatcccagcactttgggaggctgaggtgggtggatcatctgaggtcaggagagtgagaccagcctgtccaacatgttgaaaccccatctctactatacaaaattagccaggcatggtggtgcatgctgtaatcccagctacttgggaggctgaggcaggagaattgcttgaaccccggagatggaggttgcagtgagctgaggtcgcacgattgtgctccagcctgggcaaccagtgaaactctggggggaaagaaaaaaaatgtattaaatctctagttttagagagttacaccataacatccctgagtatggtcaatttcaagtcagctttagtgtgacaagcccctaggcccaccatttatgtctttatatattatggcaatatatgatccttatatattaaccactaatcgctgctgtttttgaatgttatcttttctgaggcagtcttgctctgtcacacaggctggagtgcagtaacaccactgaagctcactgtaactttgaactgctggacttggaatcctcctgctgtggccttcaaagggctgcaattacaagtgtgagccactgcatcccacctcacattttattctttggagattttttttgacttggattaaaaaactttatatttacacttca

SEQ ID NO: 456143 - DNA, 669 bp, Homo sapiens
ctgtggccatcaccatgtcacccacaccagcagcgggaagtctgttcagccgttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaa

SEQ ID NO: 456144 - DNA, 407 bp, Homo sapiens
ctgtggccatcaccatgtcacccacaccagcagcgggaagtctgttcagccgttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggatctaaaggtacggcatgactatatgtgctgttttcttttttgcatagagacttcctaatgatcctgccgtacattgatctcgat

SEQ ID NO: 456145 - DNA, 913 bp, Homo sapiens
  misc_feature (27)..(27): n is a, c, g, or t
  misc_feature (31)..(31): n is a, c, g, or t
  misc_feature (33)..(34): n is a, c, g, or t
  misc_feature (38)..(38): n is a, c, g, or t
cgaccacgcgtcgcggacgcgtgggtngacncnngcgnccttccttttttcttttttccggcgttcaagatgtcgaagcgaggtgaggttttgtttctggaggatcctccaccatctgtcgtgcagtggctggcggattcgtcaggagcggtggccctaggcagctggggcgctttgctctccttcaggccggagagagagagccaggccaccgcgagagcactgccagggccctcgaaagtggcagtggggtgctggagagttgagatggcaggatcccgacgtgaatgtagtctggataccgcgagatcgctccgcgaatagggctatcgtaatggggttgaagttagactggattaggccctggtttgcgcgacctctgcggttttatgccttgcaggagtaattgcgttttgcgaaagttagagcaagggttgagtcgtctaggtttcttaatttcgatgtcagagtgttaatagtaagaaataggctactttccgtgagaatcgggtggcacatggggacggcataagtaaaatccgagcgagctaatctatagcgtacagtctatcaaagcatgtgcggtgaattacagcttgagtatgagggggaactccgaaccatgtctagattgtgatctctttatcctgtttcccttccctttatatccacagacgtggtgggtcctctggtgcgaaattccggatttccttgggtcttccggtaggagctgtaatcaattgtgctgacaacacaggtgaggtctttgcacgttgctatactcccccttttaaaagcactcaatgggcctgtggctaatgacctattgagccgtcaagaaaggggagagtgaaaacatcgcttttgggtgaagtggcaacatgtgttgtttgcttcaatcggtggtgtgaca

SEQ ID NO: 456146 - DNA, 2667 bp, Homo sapiens
agcgcgcgactctctcctgtacctgggcatccagaaaaatggtggtgatggcgcgactctcgcggcccgagcggccggaccttgtcttcgaggaagaggacctcccctatgaggaggaaatcatgcggaaccaattctctgtcaaatgctggcttcgctacatcgagttcaaacagggcgccccgaagcccaggctcaatcagctatacgagcgggcactcaagctgctgccctgcagctacaaactctggtaccgatacctgaaggcgcgtcgggcacaggtgaagcatcgctgtgtgaccgaccctgcctatgaagatgtcaacaactgtcatgagagggcctttgtgttcatgcacaagatgcctcgtctgtggctagattactgccagttcctcatggaccaggggcgcgtcacacacacccgccgcaccttcgaccgtgccctccgggcactgcccatcacgcagcactctcgaatttggcccctgtatctgcgcttcctgcgctcacacccactgcctgagacagctgtgcgaggctatcggcgcttcctcaagctgagtcctgagagtgcagaggagtacattgagtacctcaagtcaagtgaccggctggatgaggccgcccagcgcctggccaccgtggtgaacgacgagcgtttcgtgtctaaggccggcaagtccaactaccagctgtggcacgagctgtgcgacctcatctcccagaatccggacaaggtacagtccctcaatgtggacgccatcatccgcgggggcctcacccgcttcaccgaccagctgggcaagctctggtgttctctcgccgactactacatccgcagcggccatttcgagaaggctcgggacgtgtacgaggaggccatccggacagtgatgaccgtgcgggacttcacacaggtgtttgacagctacgcccagttcgaggagagcatgatcgctgcaaagatggagaccgcctcggagctggggcgcgaggaggaggatgatgtggacctggagctgcgcctggcccgcttcgagcagctcatcagccggcggcccctgctcctcaacagcgtcttgctgcgccaaaacccacaccacgtgcacgagtggcacaagcgtgtcgccctgcaccagggccgcccccgggagatcatcaacacctacacagaggctgtgcagacggtggaccccttcaaggccacaggcaagccccacactctgtgggtggcgtttgccaagttttatgaggacaacggacagctggacgatgcccgtgtcatcctggagaaggccaccaaggtgaacttcaagcaggtggatgacctggcaagcgtgtggtgtcagtgcggagagctggagctccgacacgagaactacgatgaggccttgcggctgctgcgaaaggccacggcgctgcctgcccgccgggccgagtactttgatggttcagagcccgtgcagaaccgcgtgtacaagtcactgaaggtctggtccatgctcgccgacctggaggagagcctcggcaccttccagtccaccaaggccgtgtacgaccgcatcctggacctgcgtatcgcaacaccccagatcgtcatcaactatgccatgttcctggaggagcacaagtacttcgaggagagcttcaaggcgtacgagcgcggcatctcgctgttcaagtggcccaacgtgtccgacatctggagcacctacctgaccaaattcattgcccgctatgggggccgcaagctggagcgggcacgggacctgtttgaacaggctctggacggctgccccccaaaatatgccaagaccttgtacctgctgtacgcacagctggaggaggagtggggcctggcccggcatgccatggccgtgtacgagcgtgccaccagggccgtggagcccgcccagcagtatgacatgttcaacatctacatcaagcgggcggccgagatctatggggtcacccacacccgcggcatctaccagaaggccattgaggtgctgtcggacgagcacgcgcgtgagatgtgcctgcggtttgcagacatggagtgcaagctcggggagattgaccgcgcccgggccatctacagcttctgctcccagatctgtgacccccggacgaccggcgcgttctggcagacgtggaaggactttgaggtccggcatggcaatgaggacaccatcaaggaaatgctgcgtatccggcgcagcgtgcaggccacgtacaacacgcaggtcaacttcatggcctcgcagatgctcaaggtctcgggcagtgccacgggcaccgtgtctgacctggcccctgggcagagtggcatggacgacatgaagctgctggaacagcgggcagagcagctggcggctgaggcggagcgtgaccagcccttgcgcgcccagagcaagatcctgttcgtgaggagtgacgcctcccgggaggagctggcagagctggcacagcaggtcaaccccgaggagatccagctgggcgaggacgaggacgaggacgagatggacctggagcccaacgaggttcggctggagcagcagagcgtgccagccgcagtgtttgggagcctgaaggaagactgacccgtccctcccccatcccccctccccaccccctccccaatacagctacgtttgtacatca

SEQ ID NO: 456147 - DNA, 399 bp, Homo sapiens
  misc_feature (347)..(347): n is a, c, g, or t
  misc_feature (361)..(361): n is a, c, g, or t
tggcacgaggctggaagaattcgctgccgcaggagaccgcctcggagctggggcgcgaggaggaggatgatgtggacctggagctgcgcctggcccgcttcgagcagctcatcagccggcggcccctgctcctcaacagcgtcttgctgcgccaaaacccacaccacgtgcacgagtggcacaagcgtgtcgccctgcaccagggccgcccccgggagatcatcaacacctacacagaggctgtgcagacggtggaccccttcaaggccacaggcaagccccacactctgtgggtggcgtttgccaagttttatgaggacaacggacagctggacgatgcccgtttnattctggggaaggncaccaaaggtgaactttcaagcaggttgatgacctggg

SEQ ID NO: 456148 - DNA, 2698 bp, Homo sapiens
  misc_feature (85)..(85): n is a, c, g, or t
  misc_feature (89)..(89): n is a, c, g, or t
  misc_feature (99)..(99): n is a, c, g, or t
ggttagcgcggcagtctgcagcgggtgcgggcggtgccgggcagcttggtgtccagtcgagcagacgacgggacccgcgcccctnatgnacggcacggntagacagtctatcggggcatagcgagatgtcctcgtgtcaccagtggcgtgggcatcgcgtgacaatccggagagttccaaagctagggatgcaccgagaagtcccaggggtcgaacttgagggtactacgaatcgcgtcactcaagctgtgtgctctgcgggcgtaggactacaaactctggtaccgatacctgaaggcgcgtcgggcacaggtgaagcatcgctgtgtgaccgaccctgcctatgaagatgtcaacaactgtcatgagagggcctttgtgttcatgcacaagatgcctcgtctgtggctagattactgccagttcctcatggaccaggggcgcgtcacacacacccgccgcaccttcgaccgtgccctccgggcactgcccatcacgcagcactctcgaatttggcccctgtatctgcgcttcctgcgctcacacccactgcctgagacagctgtgcgaggctatcggcgcttcctcaagctgagtcctgagagtgcagaggagtacattgagtacctcaagtcaagtgaccggctggatgaggccgcccagcgcctggccaccgtggtgaacgacgagcgtttcgtgtctaaggccggcaagtccaactaccagctgtggcacgagctgtgcgacctcatctcccagaatccggacaaggtacagtccctcaatgtggacgccatcatccgcgggggcctcacccgcttcaccgaccagctgggcaagctctggtgttctctcgccgactactacatccgcagcggccatttcgagaaggctcgggacgtgtacgaggaggccatccggacagtgatgaccgtgcgggacttcacacaggtgtttgacagctacgcccagttcgaggagagcatgatcgctgcaaagatggagaccgcctcggagctggggcgcgaggaggaggatgatgtggacctggagctgcgcctggcccgcttcgagcagctcatcagccggcggcccctgctcctcaacagcgtcttgctgcgccaaaacccacaccacgtgcacgagtggcacaagcgtgtcgccctgcaccagggccgcccccgggagatcatcaacacctacacagaggctgtgcagacggtggaccccttcaaggccacaggcaagccccacactctgtgggtggcgtttgccaagttttatgaggacaacggacagctggacgatgcccgtgtcatcctggagaaggccaccaaggtgaacttcaagcaggtggatgacctggcaagcgtgtggtgtcagtgcggagagctggagctccgacacgagaactacgatgaggccttgcggctgctgcgaaaggccacggcgctgcctgcccgccgggccgagtactttgatggttcagagcccgtgcagaaccgcgtgtacaagtcactgaaggtctggtccatgctcgccgacctggaggagagcctcggcaccttccagtccaccaaggccgtgtacgaccgcatcctggacctgcgtatcgcaacaccccagatcgtcatcaactatgccatgttcctggaggagcacaagtacttcgaggagagcttcaaggcgtacgagcgcggcatctcgctgttcaagtggcccaacgtgtccgacatctggagcacctacctgaccaaattcattgcccgctatgggggccgcaagctggagcgggcacgggacctgtttgaacaggctctggacggctgccccccaaaatatgccaagaccttgtacctgctgtacgcacagctggaggaggagtggggcctggcccggcatgccatggccgtgtacgagcgtgccaccagggccgtggagcccgcccagcagtatgacatgttcaacatctacatcaagcgggcggccgagatctatggggtcacccacacccgcggcatctaccagaaggccattgaggtgctgtcggacgagcacgcgcgtgagatgtgcctgcggtttgcagacatggagtgcaagctcggggagattgaccgcgcccgggccatctacagcttctgctcccagatctgtgacccccggacgaccggcgcgttctggcagacgtggaaggactttgaggtccggcatggcaatgaggacaccatcaaggaaatgctgcgtatccggcgcagcgtgcaggccacgtacaacacgcaggtcaacttcatggcctcgcagatgctcaaggtctcgggcagtgccacgggcaccgtgtctgacctggcccctgggcagagtggcatggacgacatgaagctgctggaacagcgggcagagcagctggcggctgaggcggagcgtgaccagcccttgcgcgcccagagcaagatcctgttcgtgaggagtgacgcctcccgggaggagctggcagagctggcacagcaggtcaaccccgaggagatccagctgggcgaggacgaggacgaggacgagatggacctggagcccaacgaggttcggctggagcagcagagcgtgccagccgcagtgtttgggagcctgaaggaagactgacccgtccctcccccatcccccctccccaccccctccccaatacagctacgtttgtacatca

SEQ ID NO: 456149 - DNA, 2954 bp, Homo sapiens
agcgcgcgactctctcctgtacctgggcatccagaaaaatggtggtgatggcgcgactctcgcggcccgagcggccggaccttgtcttcgaggaagaggacctcccctatgaggaggaaatcatgcggaaccaattctctgtcaaatgctggcttcgctacatcgagttcaaacagggcgccccgaagcccaggctcaatcagctatacgagcgggcactcaagctgctgccctgcagctacaaactctggtaccgatacctgaaggcgcgtcgggcacaggtgaagcatcgctgtgtgaccgaccctgcctatgaagatgtcaacaactgtcatgagagggcctttgtgttcatgcacaaggtttggggctcggcgaggggatgaatcgggaagtggagctcagtccatggtggtgggtggggcggggacaggggctgggctcagcatgttagggatgggggcttggattcctgttgcttctttgcatgggaagttgggctggactcagtcctggagctgggggtttctgggtcccgccgcatttatgtggtggccccaggtgtggctcagccacaggacatcgagtgtctgtggccaggccatggagtccgtggcttagccccagccgcctctccccacacccccagatgcctcgtctgtggctagattactgccagttcctcatggaccaggggcgcgtcacacacacccgccgcaccttcgaccgtgccctccgggcactgcccatcacgcagcactctcgaatttggcccctgtatctgcgcttcctgcgctcacacccactgcctgagacagctgtgcgaggctatcggcgcttcctcaagctgagtcctgagagtgcagaggagtacattgagtacctcaagtcaagtgaccggctggatgaggccgcccagcgcctggccaccgtggtgaacgacgagcgtttcgtgtctaaggccggcaagtccaactaccagctgtggcacgagctgtgcgacctcatctcccagaatccggacaaggtacagtccctcaatgtggacgccatcatccgcgggggcctcacccgcttcaccgaccagctgggcaagctctggtgttctctcgccgactactacatccgcagcggccatttcgagaaggctcgggacgtgtacgaggaggccatccggacagtgatgaccgtgcgggacttcacacaggtgtttgacagctacgcccagttcgaggagagcatgatcgctgcaaagatggagaccgcctcggagctggggcgcgaggaggaggatgatgtggacctggagctgcgcctggcccgcttcgagcagctcatcagccggcggcccctgctcctcaacagcgtcttgctgcgccaaaacccacaccacgtgcacgagtggcacaagcgtgtcgccctgcaccagggccgcccccgggagatcatcaacacctacacagaggctgtgcagacggtggaccccttcaaggccacaggcaagccccacactctgtgggtggcgtttgccaagttttatgaggacaacggacagctggacgatgcccgtgtcatcctggagaaggccaccaaggtgaacttcaagcaggtggatgacctggcaagcgtgtggtgtcagtgcggagagctggagctccgacacgagaactacgatgaggccttgcggctgctgcgaaaggccacggcgctgcctgcccgccgggccgagtactttgatggttcagagcccgtgcagaaccgcgtgtacaagtcactgaaggtctggtccatgctcgccgacctggaggagagcctcggcaccttccagtccaccaaggccgtgtacgaccgcatcctggacctgcgtatcgcaacaccccagatcgtcatcaactatgccatgttcctggaggagcacaagtacttcgaggagagcttcaaggcgtacgagcgcggcatctcgctgttcaagtggcccaacgtgtccgacatctggagcacctacctgaccaaattcattgcccgctatgggggccgcaagctggagcgggcacgggacctgtttgaacaggctctggacggctgccccccaaaatatgccaagaccttgtacctgctgtacgcacagctggaggaggagtggggcctggcccggcatgccatggccgtgtacgagcgtgccaccagggccgtggagcccgcccagcagtatgacatgttcaacatctacatcaagcgggcggccgagatctatggggtcacccacacccgcggcatctaccagaaggccattgaggtgctgtcggacgagcacgcgcgtgagatgtgcctgcggtttgcagacatggagtgcaagctcggggagattgaccgcgcccgggccatctacagcttctgctcccagatctgtgacccccggacgaccggcgcgttctggcagacgtggaaggactttgaggtccggcatggcaatgaggacaccatcaaggaaatgctgcgtatccggcgcagcgtgcaggccacgtacaacacgcaggtcaacttcatggcctcgcagatgctcaaggtctcgggcagtgccacgggcaccgtgtctgacctggcccctgggcagagtggcatggacgacatgaagctgctggaacagcgggcagagcagctggcggctgaggcggagcgtgaccagcccttgcgcgcccagagcaagatcctgttcgtgaggagtgacgcctcccgggaggagctggcagagctggcacagcaggtcaaccccgaggagatccagctgggcgaggacgaggacgaggacgagatggacctggagcccaacgaggttcggctggagcagcagagcgtgccagccgcagtgtttgggagcctgaaggaagactgacccgtccctcccccatcccccctccccaccccctccccaatacagctacgtttgtacatca

SEQ ID NO: 456150 - DNA, 1149 bp, Homo sapiens
agcgcgcgactctctcctgtacctgggcatccagaaaaatggtggtgatggcgcgactctcgcggcccgagcggccggaccttgtcttcgaggaagaggacctcccctatgaggaggaaatcatgcggaaccaattctctgtcaaatgctggcttcgctacatcgagttcaaacagggcgccccgaagcccaggctcaatcagctatacgagcgggcactcaagctgctgccctgcagctacaaactctggtaccgatacctgaaggcgcgtcgggcacaggtgaagcatcgctgtgtgaccgaccctgcctatgaagatgtcaacaactgtcatgagagggcctttgtgttcatgcacaagatgcctcgtctgtggctagattactgccagttcctcatggaccaggggcgcgtcacacacacccgccgcaccttcgaccgtgccctccgggcactgcccatcacgcagcactctcgaatttggcccctgtatctgcgcttcctgcgctcacacccactgcctgagacagctgtgcgaggctatcggcgcttcctcaagctgagtcctgagagtgcagaggagtacattgagtacctcaagtcaagtgaccggctggatgaggccgcccagcgcctggccaccgtggtgaacgacgagcgtttcgtgtctaaggccggcaagtccaactaccagctgtggcacgagctgtgcgacctcatctcccagaatccggacaaggtacagtccctcaatgtggacgccatcatccgcgggggcctcacccgcttcaccgaccagctgggcaagctctggtgttctctcgccgactactacatccgcagcggccatttcgagaaggctcgggacgtgtacgaggaggccatccggacagtgatgaccgtgcgggacttcacacaggtgtttgacagctacgcccagttcgaggagagcatgatcgctgcaaagatggagaccgcctcggagctggggcgcgaggaggaggtggctcccgccttccccacagaggttcggctggagcagcagagcgtgccagccgcagtgtttgggagcctgaaggaagactgacccgtccctcccccatcccccctccccaccccctccccaatacagctacgtttgtacatca

SEQ ID NO: 456151 - DNA, 1569 bp, Homo sapiens
agcagtggtacctcgaattagggatgtggagccttccaggcggtggaagcgctagagctctgctgggatggccgttgccaagtatttatgaggagcacaccggacaggcatggcatcgactgctccgctgtcactcgctggattgaaggctcaccacaaggctgatacttgaagcgagcgctggaattgagccgttggtcggatacgtcgctgctgagctgtcgaagattgcggagagcatggatgctccgcacgagcggatgtacactacggatgaggctccgtctgcaggagtgcctgcgaatgaggcactggggcgatgccttggtcactgtcgggccgagtactttgatggttcagagcccgtgcagaaccgcgtgtacaagtcactgaaggtctggtccatgctcgccgacctggaggagagcctcggcaccttccagtccaccaaggccgtgtacgaccgcatcctggacctgcgtatcgcaacaccccagatcgtcatcaactatgccatgttcctggaggagcacaagtacttcgaggagagcttcaaggcgtacgagcgcggcatctcgctgttcaagtggcccaacgtgtccgacatctggagcacctacctgaccaaattcattgcccgctatgggggccgcaagctggagcgggcacgggacctgtttgaacaggctctggacggctgccccccaaaatatgccaagaccttgtacctgctgtacgcacagctggaggaggagtggggcctggcccggcatgccatggccgtgtacgagcgtgccaccagggccgtggagcccgcccagcagtatgacatgttcaacatctacatcaagcgggcggccgagatctatggggtcacccacacccgcggcatctaccagaaggccattgaggtgctgtcggacgagcacgcgcgtgagatgtgcctgcggtttgcagacatggagtgcaagctcggggagattgaccgcgcccgggccatctacagcttctgctcccagatctgtgacccccggacgaccggcgcgttctggcagacgtggaaggactttgaggtccggcatggcaatgaggacaccatcaaggaaatgctgcgtatccggcgcagcgtgcaggccacgtacaacacgcaggtcaacttcatggcctcgcagatgctcaaggtctcgggcagtgccacgggcaccgtgtctgacctggcccctgggcagagtggcatggacgacatgaagctgctggaacagcgggcagagcagctggcggctgaggcggagcgtgaccagcccttgcgcgcccagagcaagatcctgttcgtgaggagtgacgcctcccgggaggagctggcagagctggcacagcaggtcaaccccgaggagatccagctgggcgaggacgaggacgaggacgagatggacctggagcccaacgaggttcggctggagcagcagagcgtgccagccgcagtgtttgggagcctgaaggaagactgacccgtccctcccccatcccccctccccaccccctccccaatacagctacgtttgtacatca

SEQ ID NO: 456152 - DNA, 1262 bp, Homo sapiens
atgtcacctcctatggggccagactgtgcttagcaggtcccattgcacccctgttcttggggttctcacagagggagacagtgcagaggacagacccccacaactgccattagggacagggaggcgtggacagggaagggccccaagggagttcctggcaggctccctacagacgccacccaaggacatcccgggtgcctggtggtctctatctgcagactctcacatgtgactctccctctggtaacaggcgtacgagcgcggcatctcgctgttcaagtggcccaacgtgtccgacatctggagcacctacctgaccaaattcattgcccgctatgggggccgcaagctggagcgggcacgggacctgtttgaacaggctctggacggctgccccccaaaatatgccaagaccttgtacctgctgtacgcacagctggaggaggagtggggcctggcccggcatgccatggccgtgtacgagcgtgccaccagggccgtggagcccgcccagcagtatgacatgttcaacatctacatcaagcgggcggccgagatctatggggtcacccacacccgcggcatctaccagaaggccattgaggtgctgtcggacgagcacgcgcgtgagatgtgcctgcggtttgcagacatggagtgcaagctcggggagattgaccgcgcccgggccatctacagcttctgctcccagatctgtgacccccggacgaccggcgcgttctggcagacgtggaaggactttgaggtccggcatggcaatgaggacaccatcaaggaaatgctgcgtatccggcgcagcgtgcaggccacgtacaacacgcaggtcaacttcatggcctcgcagatgctcaaggtctcgggcagtgccacgggcaccgtgtctgacctggcccctgggcagagtggcatggacgacatgaagctgctggaacagcgggcagagcagctggcggctgaggcggagcgtgaccagcccttgcgcgcccagagcaagatcctgttcgtgaggagtgacgcctcccgggaggagctggcagagctggcacagcaggtcaaccccgaggagatccagctgggcgaggacgaggacgaggacgagatggacctggagcccaacgaggttcggctggagcagcagagcgtgccagccgcagtgtttgggagcctgaaggaagactgacccgtccctcccccatcccccctccccaccccctccccaatacagctacgtttgtacatca

SEQ ID NO: 456153 - DNA, 1144 bp, Homo sapiens
cccacgcgtccgcggacgcgtggggcttcaaggcgtacgagcgcggcatctcgctgttcaagtggcccaacgtgtccgacatctggagcacctacctgaccaaattcattgcccgctatgggggccgcaagctggagcgggcacgggacctgtttgaacaggctctggacggctgccccccaaaatatgccaagaccttgtacctgctgtacgcacagctggaggaggagtggggcctggcccggcatgccatggccgtgtacgagcgtgccaccagggccgtggagcccgcccagcagtatgacatgttcaacatctacatcaagcgggcggccgagatctatggggtcacccacacccgcggcatctaccagaaggccattgaggtgctgtcggacgagcacgcgcgtgagatgtgcctgcggtttgcagacatggagtgcaagctcggggagattgaccgcgcccgggccatctacagcttctgctcccagatctgtgacccccgggtagggctgtggggagggacgggtatcagggttgggggctgcggcggagtcagccagctcacgggcacacacacccacccctgccctgccccccacgcagacgaccggcgcgttctggcagacgtggaaggactttgaggtccggcatggcaatgaggacaccatcaaggaaatgctgcgtatccggcgcagcgtgcaggccacgtacaacacgcaggtcaacttcatggcctcgcagatgctcaaggtctcgggcagtgccacgggcaccgtgtctgacctggcccctgggcagagtggcatggacgacatgaagctgctggaacagcgggcagagcagctggcggctgaggcggagcgtgaccagcccttgcgcgcccagagcaagatcctgttcgtgaggagtgacgcctcccgggaggagctggcagagctggcacagcaggtcaaccccgaggagatccagctgggcgaggacgaggacgaggacgagatggacctggagcccaacgaggttcggctggagcagcagagcgtgccagccgcagtgtttgggagcctgaaggaagactgacccgtccctcccccatcccccctccccaccccctccccaatacagctacgtttgtacatca

SEQ ID NO: 456154 - DNA, 2734 bp, Homo sapiens
agcgcgcgactctctcctgtacctgggcatccagaaaaatggtggtgatggcgcgactctcgcggcccgagcggccggaccttgtcttcgaggaagaggacctcccctatgaggaggaaatcatgcggaaccaattctctgtcaaatgctggcttcgctacatcgagttcaaacagggcgccccgaagcccaggctcaatcagctatacgagcgggcactcaagctgctgccctgcagctacaaactctggtaccgatacctgaaggcgcgtcgggcacaggtgaagcatcgctgtgtgaccgaccctgcctatgaagatgtcaacaactgtcatgagagggcctttgtgttcatgcacaagatgcctcgtctgtggctagattactgccagttcctcatggaccaggggcgcgtcacacacacccgccgcaccttcgaccgtgccctccgggcactgcccatcacgcagcactctcgaatttggcccctgtatctgcgcttcctgcgctcacacccactgcctgagacagctgtgcgaggctatcggcgcttcctcaagctgagtcctgagagtgcagaggagtacattgagtacctcaagtcaagtgaccggctggatgaggccgcccagcgcctggccaccgtggtgaacgacgagcgtttcgtgtctaaggccggcaagtccaactaccagctgtggcacgagctgtgcgacctcatctcccagaatccggacaaggtacagtccctcaatgtggacgccatcatccgcgggggcctcacccgcttcaccgaccagctgggcaagctctggtgttctctcgccgactactacatccgcagcggccatttcgagaaggctcgggacgtgtacgaggaggccatccggacagtgatgaccgtgcgggacttcacacaggtgtttgacagctacgcccagttcgaggagagcatgatcgctgcaaagatggagaccgcctcggagctggggcgcgaggaggaggatgatgtggacctggagctgcgcctggcccgcttcgagcagctcatcagccggcggcccctgctcctcaacagcgtcttgctgcgccaaaacccacaccacgtgcacgagtggcacaagcgtgtcgccctgcaccagggccgcccccgggagatcatcaacacctacacagaggctgtgcagacggtggaccccttcaaggccacaggcaagccccacactctgtgggtggcgtttgccaagttttatgaggacaacggacagctggacgatgcccgtgtcatcctggagaaggccaccaaggtgaacttcaagcaggtggatgacctggcaagcgtgtggtgtcagtgcggagagctggagctccgacacgagaactacgatgaggccttgcggctgctgcgaaaggccacggcgctgcctgcccgccgggccgagtactttgatggttcagagcccgtgcagaaccgcgtgtacaagtcactgaaggtctggtccatgctcgccgacctggaggagagcctcggcaccttccagtccaccaaggccgtgtacgaccgcatcctggacctgcgtatcgcaacaccccagatcgtcatcaactatgccatgttcctggaggagcacaagtacttcgaggagagcttcaaggcgtacgagcgcggcatctcgctgttcaagtggcccaacgtgtccgacatctggagcacctacctgaccaaattcattgcccgctatgggggccgcaagctggagcgggcacgggacctgtttgaacaggctctggacggctgccccccaaaatatgccaagaccttgtacctgctgtacgcacagctggaggaggagtggggcctggcccggcatgccatggccgtgtacgagcgtgccaccagggccgtggagcccgcccagcagtatgacatgttcaacatctacatcaagcgggcggccgagatctatggggtcacccacacccgcggcatctaccagaaggccattgaggtgctgtcggacgagcacgcgcgtgagatgtgcctgcggtttgcagacatggagtgcaagctcggggagattgaccgcgcccgggccatctacagcttctgctcccagatctgtgacccccggacgaccggcgcgttctggcagacgtggaaggactttgaggtccggcatggcaatgaggacaccatcaaggaaatgctgcgtatccggcgcagcgtgcaggccacgtacaacacgcaggtcaacttcatggcctcgcagatgctcaaggtctcgggcagtgccacgggcaccgtgtctgacctggcccctgggcagagtggcatggacgacatgaagctgctggaacagcgggcagagcagctggcggctgaggcggagcgtgaccagcccttgcgcgcccagagcaagatcctgttcgtgaggagtgacgcctcccgggaggagctggcagagctggcacagcaggtcaaccccgaggagatccagctgggcgaggacgaggacgaggacgagatggacctggagcccaacgaggttcggctggagcagcagagcgtgccagccgcagtgtttgggagcctgaaggaagactgacccgtccctcccccatcccccctccccaccccctccccaatacagctacgtttgtacatcaaaaaaaaaaaataaaaatcctgggggattttattgatggggtggggaaaaagaagaggcaatagagg

SEQ ID NO: 456155 - DNA, 2588 bp, Homo sapiens
  misc_feature (541)..(541): n is a, c, g, or t
  misc_feature (545)..(545): n is a, c, g, or t
  misc_feature (547)..(547): n is a, c, g, or t
agcgcgcgactctctcctgtacctgggcatccagaaaaatggtggtgatggcgcgactctcgcggcccgagcggccggaccttgtcttcgaggaagaggacctcccctatgaggaggaaatcatgcggaaccaattctctgtcaaatgctggcttcgctacatcgagttcaaacagggcgccccgaagcccaggctcaatcagctatacgagcgggcactcaagctgctgccctgcagctacaaactctggtaccgatacctgaaggcgcgtcgggcacaggtgaagcatcgctgtgtgaccgaccctgcctatgaagatgtcaacaactgtcatgagagggcctttgtgttcatgcacaagatgcctcgtctgtggctagattactgccagttcctcatggaccaggggcgcgtcacacacacccgccgcaccttcgaccgtgccctccgggcactgcccatcacgcagcactctcgaatttggcccctgtatctgcgcttcctgcgctcacacccactgcctgagacagctgctgtcantgcnancgcgccgccttcctaaagcctgagctcctgagcagtgcagaggcagtacattgcagtacctcaagctcactgtggcacgagctgtgcgacctcatctcccagaatccggacaaggtacagtccctcaatgtggacgccatcatccgcgggggcctcacccgcttcaccgaccagctgggcaagctctggtgttctctcgccgactactacatccgcagcggccatttcgagaaggctcgggacgtgtacgaggaggccatccggacagtgatgaccgtgcgggacttcacacaggtgtttgacagctacgcccagttcgaggagagcatgatcgctgcaaagatggagaccgcctcggagctggggcgcgaggaggaggatgatgtggacctggagctgcgcctggcccgcttcgagcagctcatcagccggcggcccctgctcctcaacagcgtcttgctgcgccaaaacccacaccacgtgcacgagtggcacaagcgtgtcgccctgcaccagggccgcccccgggagatcatcaacacctacacagaggctgtgcagacggtggaccccttcaaggccacaggcaagccccacactctgtgggtggcgtttgccaagttttatgaggacaacggacagctggacgatgcccgtgtcatcctggagaaggccaccaaggtgaacttcaagcaggtggatgacctggcaagcgtgtggtgtcagtgcggagagctggagctccgacacgagaactacgatgaggccttgcggctgctgcgaaaggccacggcgctgcctgcccgccgggccgagtactttgatggttcagagcccgtgcagaaccgcgtgtacaagtcactgaaggtctggtccatgctcgccgacctggaggagagcctcggcaccttccagtccaccaaggccgtgtacgaccgcatcctggacctgcgtatcgcaacaccccagatcgtcatcaactatgccatgttcctggaggagcacaagtacttcgaggagagcttcaaggcgtacgagcgcggcatctcgctgttcaagtggcccaacgtgtccgacatctggagcacctacctgaccaaattcattgcccgctatgggggccgcaagctggagcgggcacgggacctgtttgaacaggctctggacggctgccccccaaaatatgccaagaccttgtacctgctgtacgcacagctggaggaggagtggggcctggcccggcatgccatggccgtgtacgagcgtgccaccagggccgtggagcccgcccagcagtatgacatgttcaacatctacatcaagcgggcggccgagatctatggggtcacccacacccgcggcatctaccagaaggccattgaggtgctgtcggacgagcacgcgcgtgagatgtgcctgcggtttgcagacatggagtgcaagctcggggagattgaccgcgcccgggccatctacagcttctgctcccagatctgtgacccccggacgaccggcgcgttctggcagacgtggaaggactttgaggtccggcatggcaatgaggacaccatcaaggaaatgctgcgtatccggcgcagcgtgcaggccacgtacaacacgcaggtcaacttcatggcctcgcagatgctcaaggtctcgggcagtgccacgggcaccgtgtctgacctggcccctgggcagagtggcatggacgacatgaagctgctggaacagcgggcagagcagctggcggctgaggcggagcgtgaccagcccttgcgcgcccagagcaagatcctgttcgtgaggagtgacgcctcccgggaggagctggcagagctggcacagcaggtcaaccccgaggagatccagctgggcgaggacgaggacgaggacgagatggacctggagcccaacgaggttcggctggagcagcagagcgtgccagccgcagtgtttgggagcctgaaggaagactgacccgtccctcccccatcccccctccccaccccctccccaatacagctacgtttgtacatca

SEQ ID NO: 456156 - DNA, 1062 bp, Homo sapiens
agcgcgcgactctctcctgtacctgggcatccagaaaaatggtggtgatggcgcgactctcgcggcccgagcggccggaccttgtcttcgaggaagaggacctcccctatgaggaggaaatcatgcggaaccaattctctgtcaaatgctggcttcgctacatcgagttcaaacagggcgccccgaagcccaggctcaatcagctatacgagcgggcactcaagctgctgccctgcagctacaaactctggtaccgatacctgaaggcgcgtcgggcacaggtgaagcatcgctgtgtgaccgaccctgcctatgaagatgtcaacaactgtcatgagagggcctttgtgttcatgcacaagatgcctcgtctgtggctagattactgccagttcctcatggaccaggggcgcgtcacacacacccgccgcaccttcgaccgtgccctccgggcactgcccatcacgcagcactctcgaatttggcccctgtatctgcgcttcctgcgctcacacccactgcctgagacagctgtgcgaggctatcggcgcttcctcaagctgagtcctgagagtgcagaggagtacattgagtacctcaagtcaagtgaccggctggatgaggccgcccagcgcctggccaccgtggtgaacgacgagcgtttcgtgtctaaggccggcaagtccaactaccagctgtggcacgagctgtgcgacctcatctcccagaatccggacaaggtacagtccctcaatgtggacgccatcatccgcgggggcctcacccgcttcaccgaccagctgggcaagctctggtgttctctcgccgactactacatccgcagcggccatttcgagaaggctcgggacgtgtacgaggaggccatccggacagtgatgaccgtgcgggacttcacacaggtgtttgacagctacgcccagttcgaggagagcatgatcgctgcaaagatggagaccgcctcggagctggggcgcgaggaggaggtgtggacctggagctgcgcctggcccgctgaagatgatgtggggatcctatagagtg

SEQ ID NO: 456157 - DNA, 941 bp, Homo sapiens
  misc_feature (11)..(11): n is a, c, g, or t
  misc_feature (22)..(22): n is a, c, g, or t
gacggcagtantctcgggttanggtagcgaggctgggtggcgggacctgtttgaacaggctctggacggctgccccccaaaatatgccaagaccttgtacctgctgtacgcacagctggaggaggagtggggcctggcccggcatgccatggccgtgtacgagcgtgccaccagggccgtggagcccgcccagcagtatgacatgttcaacatctacatcaagcgggcggccgagatctatggggtcacccacacccgcggcatctaccagaaggccattgaggtgctgtcggacgagcacgcgcgtgagatgtgcctgcggtttgcagacatggagtgcaagctcggggagattgaccgcgcccgggccatctacagcttctgctcccagatctgtgacccccggacgaccggcgcgttctggcagacgtggaaggactttgaggtccggcatggcaatgaggacaccatcaaggaaatgctgcgtatccggcgcagcgtgcaggccacgtacaacacgcaggtcaacttcatggcctcgcagatgctcaaggtctcgggcagtgccacgggcaccgtgtctgacctggcccctgggcagagtggcatggacgacatgaagctgctggaacagcgggcagagcagctggcggctgaggcggagcgtgaccagcccttgcgcgcccagagcaagatcctgttcgtgaggagtgacgcctcccgggaggagctggcagagctggcacagcaggtcaaccccgaggagatccagctgggcgaggacgaggacgaggacgagatggacctggagcccaacgaggttcggctggagcagcagagcgtgccagccgcagtgtttgggagcctgaaggaagactgacccgtccctcccccatcccccctccccaccccctccccaatacagctacgtttgtacatca

SEQ ID NO: 456158 - DNA, 736 bp, Homo sapiens
  misc_feature (46)..(46): n is a, c, g, or t
gctccccaaagggtacctgcttctgctggcttaatgcctcagaacnttggtgtcattggtctcagacaccactttgccatccactatccggcgggtggtggtctttgggatggtttgcatggagttgctgctgtccaaggcatcaccaagattaaagtcctcgccatctacagcttctgctcccagatctgtgacccccggacgaccggcgcgttctggcagacgtggaaggactttgaggtccggcatggcaatgaggacaccatcaaggaaatgctgcgtatccggcgcagcgtgcaggccacgtacaacacgcaggtcaacttcatggcctcgcagatgctcaaggtctcgggcagtgccacgggcaccgtgtctgacctggcccctgggcagagtggcatggacgacatgaagctgctggaacagcgggcagagcagctggcggctgaggcggagcgtgaccagcccttgcgcgcccagagcaagatcctgttcgtgaggagtgacgcctcccgggaggagctggcagagctggcacagcaggtcaaccccgaggagatccagctgggcgaggacgaggacgaggacgagatggacctggagcccaacgaggttcggctggagcagcagagcgtgccagccgcagtgtttgggagcctgaaggaagactgacccgtccctcccccatcccccctccccaccccctccccaatacagctacgtttgtacatca

SEQ ID NO: 456159 - DNA, 2370 bp, Homo sapiens
agtcatcttcccagttccccaactcacctctggcatggcttgcacagggtggaccagcccccttcctctatgtgtgtgtctgctgctgacctgtggctttgccgaggcagggaagctactggtagtgcccatggatgggagccactggttcaccatgaggtcggtggtggagaaactcattctcagggggcatgaggtggttgtagtcatgccagaggtgagttggcaactgggaagatcactgaattgcacagtgaagacttattcaacttcatatactctggaggatctggaccgggagttcaaggcttttgcccatgctcaatggaaagcacaagtacgaagtatatattctctattaatgggttcatacaatgacatttttgacttatttttttcaaattgcaggagtttgtttaatgaccgaaaattagtagaatacttaaaggagagttcttttgatgcagtgtttctggatccttttgatacctgtggcttaattgttgccaaatatttctccctcccctctgtggtcttcgccaggggaatattttgccactatcttgaagaaggtgcacagtgccctgctcctctttcctatgtccccagaatgatctcttagggttctcagatgccatgactttcaaggagagagtacggaaccacatcatgcacttggaggaacatttattatgccacgttttttcagaaatgccctagaaatagcctctgaaattctccaaacacctgttacggcagtatgatctctacagccacacatcaatttggttgttgcgaacggactttgttttggactatcccaaacccgtgatgcccaacatgatcttcattggtggtatcaactgccatcagggaaagccgttgcctatggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctccggtgtctttgatcaggatgacatgtgccatttttcagaggacgtgcagacaggctggcattctagattacttttcttactctgaaacatggcctgtttgggagtgcgggattcaaaggtggtcccaccgctgcccctactgcaaatggcagttttaatcttatcttttggcttctgcagatggttgcaattgatccttaaccaataatggtcagtcctcatctctgtcctgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattcta

SEQ ID NO: 456160 - DNA, 2426 bp, Homo sapiens
taaagtaacaacggtaataaagagttttcactctccaaatcacagggctcctaggtattttccctaaactaaccactctttccaggatggcctgcctccttcgctcatttcagagaatttctgcaggggttttcttcttagcactttggggcatggttgtaggtgacaagctgctggtggtccctcaggacggaagccactggcttagtatgaaggatatagttgaggttctcagtgaccggggtcatgagattgtagtggtggtgcctgaagttaatttgcttttgaaagaatccaaatactacacaagaaaaatctatccagtgccgtatgaccaagaagagctgaagaaccgttaccaatcatttggaaacaatcactttgctgagcgatcattcctaactgctcctcagacagagtacaggaataacatgattgttattggcctgtacttcatcaactgccagagcctcctgcaggacagggacaccctgaacttctttaaggagagcaagtttgatgctcttttcacagacccagccttaccctgtggggtgatcctggctgagtatttgggcctaccatctgtgtacctcttcaggggttttccgtgttccctggagcatacattcagcagaagcccagaccctgtgtcctacattcccaggtgctacacaaagttttcagaccacatgactttttcccaacgagtggccaacttccttgttaatttgttggagccctatctattttattgtctgttttcaaagtatgaagaactcgcatcagctgtcctcaagagagatgtggatataatcaccttatatcagaaggtctctgtttggctgttaagatatgactttgtgcttgaatatcctaggccggtcatgcccaacatggtcttcattggaggtatcaactgtaagaagaggaaagacttgtctcaggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctccggtgtctttgatcaggatgacatgtgccatttttcagaggacgtgcagacaggctggcattctagattacttttcttactctgaaacatggcctgtttgggagtgcgggattcaaaggtggtcccaccgctgcccctactgcaaatggcagttttaatcttatcttttggcttctgcagatggttgcaattgatccttaaccaataatggtcagtcctcatctctgtcctgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattcta

SEQ ID NO: 456161 - DNA, 2358 bp, Homo sapiens
aggagcaaaggcgccatggctgtggagtcccagggcggacgcccacttgtcctgggcctgctgctgtgtgtgctgggcccagtggtgtcccatgctgggaagatactgttgatcccagtggatggcagccactggctgagcatgcttggggccatccagcagctgcagcagaggggacatgaaatagttgtcctagcacctgacgcctcgttgtacatcagagacggagcattttacaccttgaagacgtaccctgtgccattccaaagggaggatgtgaaagagtcttttgttagtctcgggcataatgtttttgagaatgattctttcctgcagcgtgtgatcaaaacatacaagaaaataaaaaaggactctgctatgcttttgtctggctgttcccacttactgcacaacaaggagctcatggcctccctggcagaaagcagctttgatgtcatgctgacggaccctttccttccttgcagccccatcgtggcccagtacctgtctctgcccactgtattcttcttgcatgcactgccatgcagcctggaatttgaggctacccagtgccccaacccattctcctacgtgcccaggcctctctcctctcattcagatcacatgaccttcctgcagcgggtgaagaacatgctcattgccttttcacagaactttctgtgcgacgtggtttattccccgtatgcaacccttgcctcagaattccttcagagagaggtgactgtccaggacctattgagctctgcatctgtctggctgtttagaagtgactttgtgaaggattaccctaggcccatcatgcccaatatggtttttgttggtggaatcaactgccttcaccaaaatccactatcccaggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctccggtgtctttgatcaggatgacatgtgccatttttcagaggacgtgcagacaggctggcattctagattacttttcttactctgaaacatggcctgtttgggagtgcgggattcaaaggtggtcccaccgctgcccctactgcaaatggcagttttaatcttatcttttggcttctgcagatggttgcaattgatccttaaccaataatggtcagtcctcatctctgtcctgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattcta

SEQ ID NO: 456162 - DNA, 1017 bp, Homo sapiens
  misc_feature (718)..(718): n is a, c, g, or t
  misc_feature (1012)..(1012): n is a, c, g, or t
ggttttgtgctggtatttctcccacctactgtatcatagcagcttagattcccagctgctggctctgggctgcagttctctcatggctcgcgcagggtggaccagccccgttcctttatgtgtgtgtctactgctgacctgtggctttgccgaggcagggaagctgctggtagtgcccatggatgggagtcactggttcaccatgcagtcggtggtggagaaacttatcctcagggggcatgaggtggttgtagtcatgccagaggtgagttggcaactggaaagatcactgaattgcacagtgaagacttactcaacctcgtacactctggaagatcagaaccgggaattcatggttttcgcccatgctcaatggaaagcacaggcacaaagtatattttctctattaatgagttcatccagtggttttcttgacttatttttttcgcattgcaggagtttgtttaatgaccgaaaattagtagaatacttaaaggagagttcttttgatgcagtgtttctggatccttttgatacctgtggcttaattgttgctaaatatttctccctcccctctgtggtcttcaccaggggaatactttgccaccatcttgaagaaggtgcacagtgccctgctcctctttcctatgtccccagaatgatctcttagggttctcagatgccatgactttcaaggagagagtacggaaccacatcntgcacttggaggaacatttattatgccagtatcttttcaaaaatgccctagaaatagctctgaaattctccaaacacctgttcacggcatatgatctctacagtcacacatcaatttggttgttgcgaacggactttgttttggactatcccaaacccgtgatgcccaacatgatcttcattggtggtatcaactgccatcagggaaagccattgcctatggtaagtcacctctcctttagcacattaagaataatcttggctttggaaattaaaaaaggattccttactgaantgtga

SEQ ID NO: 456163 - DNA, 1220 bp, Homo sapiens
tcccagctgctggctcgggctgcagttctctcatggctcgcacagggtggaccagccccattcccctatgtgtttctctgctgctgacctgtggctttgctgaggcagggaagctgctggtagtgcccatggatgggagtcactggttcaccatgcagtcggtggtggagaaacttatcctcagggggcatgaggtggttgtagtcatgccagaggtgagttggcaactgggaaaatcactgaattgcacagtgaagacttactcaacctcatacactctggaggatctggaccgggaattcatggatttcgccgatgctcaatggaaagcacaagtacgaagtttgttttctctatttctgagttcatccaatggtttttttaacttatttttttcgcattgcaggagtttgtttaatgaccgaaaattagtagaatacttaaaggagagttcttttgatgcggtgtttcttgatccttttgatgcctgtggcttaattgttgccaaatatttctccctcccctctgtggtcttcgccaggggaatagtttgccactatcttgaagaaggtgcacagtgccctgctcctctttcctatgtccccagaattctcttagggttctcagatgccatgactttcaaggagagagtacggaaccacatcatgcacttggaggaacatttattttgccagtatttttccaaaaatgtcctagaaatagcctctgaaattctccaaacccctgtcacggcatatgatctctacagccacacatcaatttggttgttgcgaactgactttgttttggagtatcccaaacccgtgatgcccaatatgatcttcattggtggtatcaactgtcatcagggaaagccagtgcctatggccaggatctacttctttcaccccactggaatatgtcccaagcctgagtcattcagcctgcagcaatccctgagaaaaaaaaaaaaatcggccttggcctgggaacactcaaagtgatcacctgaggacacctgtgactacctacagaaccaaaccaggtcaggccgggggtctccagacggaggcatacctctaggggatcgcatcatgaacgaacagacatgccagaatccctcggctagatgtcccagggcagaaataacaaacaaacaaatatacacacacacacaaagaccaaccccattcttaacagacaagcccaggaaagaaacg

SEQ ID NO: 456164 - DNA, 2452 bp, Homo sapiens
agtcatcttcccagttccccaactcacctctggcatggcttgcacagggtggaccagcccccttcctctatgtgtgtgtctgctgctgacctgtggctttgccgaggcagggaagctactggtagtgcccatggatgggagccactggttcaccatgaggtcggtggtggagaaactcattctcagggggcatgaggtggttgtagtcatgccagaggtgagttggcaactgggaagatcactgaattgcacagtgaagacttattcaacttcatatactctggaggatctggaccgggagttcaaggcttttgcccatgctcaatggaaagcacaagtacgaagtatatattctctattaatgggttcatacaatgacatttttgacttatttttttcaaattgcaggagtttgtttaatgaccgaaaattagtagaatacttaaaggagagttcttttgatgcagtgtttctggatccttttgatacctgtggcttaattgttgccaaatatttctccctcccctctgtggtcttcgccaggggaatattttgccactatcttgaagaaggtgcacagtgccctgctcctctttcctatgtccccagaatgatctcttagggttctcagatgccatgactttcaaggagagagtacggaaccacatcatgcacttggaggaacatttattatgccacgttttttcagaaatgccctagaaatagcctctgaaattctccaaacacctgttacggcagtatgatctctacagccacacatcaatttggttgttgcgaacggactttgttttggactatcccaaacccgtgatgcccaacatgatcttcattggtggtatcaactgccatcagggaaagccgttgcctatggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctccggtgtctttgatcaggatgacatgtgccatttttcagaggacgtgcagacaggctggcattctagattacttttcttactctgaaacatggcctgtttgggagtgcgggattcaaaggtggtcccaccgctgcccctactgcaaatggcagttttaatcttatcttttggcttctgcagatggttgcaattgatccttaaccaataatggtcagtcctcatctctgtcctgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattctactctcatttcttttcaacaaacaaaaagggggggggctaaaataccgggggcaattcaccgaccttgttaagggccataagg

SEQ ID NO: 456165 - DNA, 2316 bp, Homo sapiens
agtcatcttcccagttccccaactcacctctggcatggcttgcacagggtggaccagcccccttcctctatgtgtgtgtctgctgctgacctgtggctttgccgaggcagggaagctactggtagtgcccatggatgggagccactggttcaccatgaggtcggtggtggagaaactcattctcagggggcatgaggtggttgtagtcatgccagaggtgagttggcaactgggaagatcactgaattgcacagtgaagacttattcaacttcatatactctggaggatctggaccgggagttcaaggcttttgcccatgctcaatggaaagcacaagtacgaagtatatattctctattaatgggttcatacaatgacatttttgacttatttttttcaaattgcaggagtttgtttaatgaccgaaaattagtagaatacttaaaggagagttcttttgatgcagtgtttctggatccttttgatacctgtggcttaattgttgccaaatatttctccctcccctctgtggtcttcgccaggggaatattttgccactatcttgaagaaggtgcacagtgccctgctcctctttcctatgtccccagaatgatctcttagggttctcagatgccatgactttcaaggagagagtacggaaccacatcatgcacttggaggaacatttattatgccacgttttttcagaaatgccctagaaatagcctctgaaattctccaaacacctgttacggcagtatgatctctacagccacacatcaatttggttgttgcgaacggactttgttttggactatcccaaacccgtgatgcccaacatgatcttcattggtggtatcaactgccatcagggaaagccgttgcctatggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataccggtgtctttgatcaggatgacatgtgccatttttcagaggacgtgcagacaggctggcattctagattacttttcttactctgaaacatggcctgtttgggagtgcgggattcaaaggtggtcccaccgctgcccctactgcaaatggcagttttaatcttatcttttggcttctgcagatggttgcaattgatccttaaccaataatggtcagtcctcatctctgtcctgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattcta

SEQ ID NO: 456166 - DNA, 1690 bp, Homo sapiens
aaacctgaagctcaggagaggagtcactcccctggcagatgggtggctgggccagaagcagataccaggctttctgactcctgctctaggattctcaccacgtactggctagacttatacttctcaaatcttaatttcctaaaggccgatcatgcccaacatggtcttcattgggggcatcaactgtgccaacaggaagccactatctcaggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctccggtgtctttgatcaggatgacatgtgccatttttcagaggacgtgcagacaggctggcattctagattacttttcttactctgaaacatggcctgtttgggagtgcgggattcaaaggtggtcccaccgctgcccctactgcaaatggcagttttaatcttatcttttggcttctgcagatggttgcaattgatccttaaccaataatggtcagtcctcatctctgtcctgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattcta

SEQ ID NO: 456167 - DNA, 1231 bp, Homo sapiens
  misc_feature (1226)..(1226): n is a, c, g, or t
aaagggtaaaattcagagcaagggagaggtagacaggacctgtgaaaagcagtggttagtttagggaaaatacctaggagccctgtgatttggagagtgaaaactctttattaccgttgttactttaactctttccaggatggcctgcctccttcgctcatttcagagaatttctgcaggggttttcttcttagcactttggggcatggttgtaggtgacaagctgctggtggtccctcaggacggaagccactggcttagtatgaaggatatagttgaggttctcagtgaccggggtcatgagattgtagtggtggtgcctgaagttaatttgcttttgaaagaatccaaatactacacaagaaaaatctatccagtgccgtatgaccaagaagagctgaagaaccgttaccaatcatttggaaacaatcactttgctgagcgatcattcctaactgctcctcagacagagtacaggaataacatgattgttattggcctgtacttcatcaactgccagagcctcctgcaggacagggacaccctgaacttctttaaggagagcaagtttgatgctcttttcacagacccagccttaccctgtggggtgatcctggctgagtatttgggcctaccatctgtgtacctcttcaggggttttccgtgttccctggagcatacattcagcagaagcccagaccctgtgtcctacattcccaggtgctacacaaagttttcagaccacatgactttttcccaacgagtggccaacttccttgttaatttgttggagccctatctattttattgtctgttttcaaagtatgaagaactcgcatcagctgtcctcaagagagatgtggatataatcaccttatatcagaaggtctctgtttggctgttaagatatgactttgtgcttgaatatcctaggccggtcatgcccaacatggtcttcattggaggtatcaacttctgcatttaatagaattgatgcaactggctgagcgtggtggctcatgcttataatcccagcactttgcggggccgaagcaggaggatagcttgagcccaggagtttgagaccagcctaggcagcatagtgagattccttcactacagaaagtaaaaacctagctggacatggtagcgtgtgcctgtagacctaactactcggaaggctgaggtgggaggattatttgagcccaggagttcaaggttccagnccgct

SEQ ID NO: 456168 - DNA, 890 bp, Homo sapiens
aaagggtaaaattcagagcaagggagaggtagacaggacctgtgaaaagcagtggttagtttagggaaaatacctaggagccctgtgatttggagagtgaaaactctttattaccgttgttactttaactctttccaggatggcctgcctccttcgctcatttcagagaatttctgcaggggttttcttcttagcactttggggcatggttgtaggtgacaagctgctggtggtccctcaggacggaagccactggcttagtatgaaggatatagttgaggttctcagtgaccggggtcatgagattgtagtggtggtgcctgaagttaatttgcttttgaaagaatccaaatactacacaagaaaaatctatccagtgccgtatgaccaagaagagctgaagaaccgttaccaatcatttggaaacaatcactttgctgagcgatcattcctaactgctcctcagacagagtacaggaataacatgattgttattggcctgtacttcatcaactgccagagcctcctgcaggacagggacaccctgaacttctttaaggagagcaagtttgatgctcttttcacagacccagccttaccctgtggggtgatcctggctgagtatttgggcctaccatctgtgtacctcttcaggggttttccgtgttccctggagcatacattcagcagaagcccagaccctgtgtcctacatacgcccaggtatgcacatacgcccaggtacgcatgcttacctgggcgtatggcgtacggtcagagaagccatcacctcagatggcagcttttaaaagattttttgtttatctctcaacaccatgattcctttaacaacatgtttccagaatacgcccaggtacgcaggggatcctc

SEQ ID NO: 456169 - DNA, 2375 bp, Homo sapiens
acagtcagctgtcggtggcttctgctgagatggccagaggactccaggttcccctgccgcggctggccacaggactgctgctcctcctcagtgtccagccctgggctgagagtggaaaggtgttggtggtgcccactgatggcagcccctggctcagcatgcgggaggccttgcgggagctccatgccagaggccaccaggcggtggtcctcaccccagaggtgaatatgcacatcaaagaagagaaatttttcaccctgacagcctatgctgttccatggacccagaaggaatttgatcgcgttacgctgggctacactcaagggttctttgaaacagaacatcttctgaagagatattctagaagtatggcaattatgaacaatgtatctttggcccttcataggtgttgtgtggagctactgcataatgaggccctgatcaggcacctgaatgctacttcctttgatgtggttttaacagaccccgttaacctctgcggggcggtgctggctaagtacctgtcgattcctgctgtgtttttttggaggtacattccatgtgacttagactttaagggcacacagtgtccaaatccttcctcctatattcctaagttactaacgaccaattcagaccacatgacattcctgcaaagggtcaagaacatgctctaccctctggccctgtcctacatttgccatactttttctgccccttatgcaagtcttgcctctgagctttttcagagagaggtgtcagtggtggatcttgtcagctatgcatccgtgtggctgttccgaggggactttgtgatggactaccccaggccgatcatgcccaacatggtcttcattgggggcatcaactgtgccaacaggaagccactatctcaggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctccggtgtctttgatcaggatgacatgtgccatttttcagaggacgtgcagacaggctggcattctagattacttttcttactctgaaacatggcctgtttgggagtgcgggattcaaaggtggtcccaccgctgcccctactgcaaatggcagttttaatcttatcttttggcttctgcagatggttgcaattgatccttaaccaataatggtcagtcctcatctctgtcctgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattcta

SEQ ID NO: 456170 - DNA, 2479 bp, Homo sapiens
aaagggtaaaattcagagcaagggagaggtagacaggacctgtgaaaagcagtggttagtttagggaaaatacctaggagccctgtgatttggagagtgaaaactctttattaccgttgttactttaactctttccaggatggcctgcctccttcgctcatttcagagaatttctgcaggggttttcttcttagcactttggggcatggttgtaggtgacaagctgctggtggtccctcaggacggaagccactggcttagtatgaaggatatagttgaggttctcagtgaccggggtcatgagattgtagtggtggtgcctgaagttaatttgcttttgaaagaatccaaatactacacaagaaaaatctatccagtgccgtatgaccaagaagagctgaagaaccgttaccaatcatttggaaacaatcactttgctgagcgatcattcctaactgctcctcagacagagtacaggaataacatgattgttattggcctgtacttcatcaactgccagagcctcctgcaggacagggacaccctgaacttctttaaggagagcaagtttgatgctcttttcacagacccagccttaccctgtggggtgatcctggctgagtatttgggcctaccatctgtgtacctcttcaggggttttccgtgttccctggagcatacattcagcagaagcccagaccctgtgtcctacattcccaggtgctacacaaagttttcagaccacatgactttttcccaacgagtggccaacttccttgttaatttgttggagccctatctattttattgtctgttttcaaagtatgaagaactcgcatcagctgtcctcaagagagatgtggatataatcaccttatatcagaaggtctctgtttggctgttaagatatgactttgtgcttgaatatcctaggccggtcatgcccaacatggtcttcattggaggtatcaactgtaagaagaggaaagacttgtctcaggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctccggtgtctttgatcaggatgacatgtgccatttttcagaggacgtgcagacaggctggcattctagattacttttcttactctgaaacatggcctgtttgggagtgcgggattcaaaggtggtcccaccgctgcccctactgcaaatggcagttttaatcttatcttttggcttctgcagatggttgcaattgatccttaaccaataatggtcagtcctcatctctgtcctgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattcta

SEQ ID NO: 456171 - DNA, 532 bp, Homo sapiens
ggctcggtacctgcttactgggcgtatgaccaagaagagctgaagaaccgttaccaatcatttggaaacaatcactttgctgagcgatcattcctaactgctcctcagacagagtacaggaataacatgattgttattggcctgtacttcatcaactgccagagcctcctgcaggacagggacaccctgaacttctttaaggagagcaagtttgatgctcttttcacagacccagccttaccctgtggggtgatcctggctgagtatttgggcctaccatctgtgtacctcttcaggggttttccgtgttccctggagcatacattcagcagaagcccagaccctgtgtcctacatacgcccaggtatgcacatacgcccaggtacgcatgcttacctgggcgtatggcgtacggtcagagaagccatcacctcagatggcagcttttaaaagattttttgtttatctctcaacaccatgattcctttaacaacatgtttccagaatacgcccaggtacgcaggggatcctc

SEQ ID NO: 456172 - DNA, 856 bp, Homo sapiens
  misc_feature (661)..(661): n is a, c, g, or t
aaacctgaagctcaggagaggagtcactcccctggcagatgggtggctgggccagaagcagataccaggctttctgactcctgctctaggattctcaccacgtactggctagacttatacttctcaaatcttaatttcctaaaggccgatcatgcccaacatggtcttcattgggggcatcaactgtgccaacaggaagccactatctcaggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaaggttcaggggnactttctgcgccctccagccttacaggacgccggggggcgtggacggcggtcttgcggggttggcagcgccacgggcccacactggcggacacgactcccggccgcacaccgcggcgggcctgagccgacagccacaccaaggtcgcccgaagggacgcgggaccacaccccaggggggaggaactcgcaccgac

SEQ ID NO: 456173 - DNA, 2366 bp, Homo sapiens
tcccagctgctggctcgggctgcagttctctcatggctcgcacagggtggaccagccccattcccctatgtgtttctctgctgctgacctgtggctttgctgaggcagggaagctgctggtagtgcccatggatgggagtcactggttcaccatgcagtcggtggtggagaaacttatcctcagggggcatgaggtggttgtagtcatgccagaggtgagttggcaactgggaaaatcactgaattgcacagtgaagacttactcaacctcatacactctggaggatctggaccgggaattcatggatttcgccgatgctcaatggaaagcacaagtacgaagtttgttttctctatttctgagttcatccaatggtttttttaacttatttttttcgcattgcaggagtttgtttaatgaccgaaaattagtagaatacttaaaggagagttcttttgatgcggtgtttcttgatccttttgatgcctgtggcttaattgttgccaaatatttctccctcccctctgtggtcttcgccaggggaatagtttgccactatcttgaagaaggtgcacagtgccctgctcctctttcctatgtccccagaattctcttagggttctcagatgccatgactttcaaggagagagtacggaaccacatcatgcacttggaggaacatttattttgccagtatttttccaaaaatgtcctagaaatagcctctgaaattctccaaacccctgtcacggcatatgatctctacagccacacatcaatttggttgttgcgaactgactttgttttggagtatcccaaacccgtgatgcccaatatgatcttcattggtggtatcaactgtcatcagggaaagccagtgcctatggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctccggtgtctttgatcaggatgacatgtgccatttttcagaggacgtgcagacaggctggcattctagattacttttcttactctgaaacatggcctgtttgggagtgcgggattcaaaggtggtcccaccgctgcccctactgcaaatggcagttttaatcttatcttttggcttctgcagatggttgcaattgatccttaaccaataatggtcagtcctcatctctgtcctgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattcta

SEQ ID NO: 456174 - DNA, 2189 bp, Homo sapiens
aaagggtaaaattcagagcaagggagaggtagacaggacctgtgaaaagcagtggttagtttagggaaaatacctaggagccctgtgatttggagagtgaaaactctttattaccgttgttactttaactctttccaggatggcctgcctccttcgctcatttcagagaatttctgcaggggttttcttcttagcactttggggcatggttgtaggtgacaagctgctggtggtccctcaggacggaagccactggcttagtatgaaggatatagttgaggttctcagtgaccggggtcatgagattgtagtggtggtgcctgaagttaatttgcttttgaaagaatccaaatactacacaagaaaaatctatccagtgccgtatgaccaagaagagctgaagaaccgttaccaatcatttggaaacaatcactttgctgagcgatcattcctaactgctcctcagacagagtacaggaataacatgattgttattggcctgtacttcatcaactgccagagcctcctgcaggacagggacaccctgaacttctttaaggagagcaagtttgatgctcttttcacagacccagccttaccctgtggggtgatcctggctgagtatttgggcctaccatctgtgtacctcttcaggggttttccgtgttccctggagcatacattcagcagaagcccagaccctgtgtcctacattcccaggtgctacacaaagttttcagaccacatgactttttcccaacgagtggccaacttccttgttaatttgttggagccctatctattttattgtctgttttcaaagtatgaagaactcgcatcagctgtcctcaagagagatgtggatataatcaccttatatcagaaggtctctgtttggctgttaagatatgactttgtgcttgaatatcctaggccggtcatgcccaacatggtcttcattggaggtatcaactgtaagaagaggaaagacttgtctcaggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagaaagaagcagcagtcaggaagacagatgtgaagagctggagcatgttcagatgagaggagacggaacacggggacacaccagcttgagcaagggacaacaggggaggactgatgactgacttcccacctttgaggtgctaatgtgtgtgtggtggcactggataaaagatcaatgttggctaggcaccatggcacacgcctgtagtcccagccactctggaggctaaggcgggaggattgcttgagcccagaagttggaggctgctatgagccgtgatcatgccactgcactccagcaacctgggcaacagagtgagaccctgtctcaaaaaaaaaaaaaaaaatgaaaagtccacataacctgagcatcatgtgcccagagcgttgggtggtgtggtcccattccttccttccagcggcttcttctggccacctcaatgtcaggatgtcctgctcacatatcaataccattaaaacctgacttctttccctgcactgttgaagctccttcttgaggctcacattatggatataattttgattctttcttcagtggtatagataactacttgtaacctaagaacaacttggtgaaagtcctctaatacattattttttaaaaaaacacaaatcaatgagctcaacttattaactaactttcatctattcatttttgagccatccctgtctgattgtgaatctccatgattccaacactctgagctggggatagtgcctacacaaaataa

SEQ ID NO: 456175 - DNA, 1462 bp, Homo sapiens
aaagggtaaaattcagagcaagggagaggtagacaggacctgtgaaaagcagtggttagtttagggaaaatacctaggagccctgtgatttggagagtgaaaactctttattaccgttgttactttaactctttccaggatggcctgcctccttcgctcatttcagagaatttctgcaggggttttcttcttagcactttggggcatggttgtaggtgacaagctgctggtggtccctcaggacggaagccactggcttagtatgaaggatatagttgaggttctcagtgaccggggtcatgagattgtagtggtggtgcctgaagttaatttgcttttgaaagaatccaaatactacacaagaaaaatctatccagtgccgtatgaccaagaagagctgaagaaccgttaccaatcatttggaaacaatcactttgctgagcgatcattcctaactgctcctcagacagagtacaggaataacatgattgttattggcctgtacttcatcaactgccagagcctcctgcaggacagggacaccctgaacttctttaaggagagcaagtttgatgctcttttcacagacccagccttaccctgtggggtgatcctggctgagtatttgggcctaccatctgtgtacctcttcaggggttttccgtgttccctggagcatacattcagcagaagcccagaccctgtgtcctacattcccaggtgctacacaaagttttcagaccacatgactttttcccaacgagtggccaacttccttgttaatttgttggagccctatctattttattgtctgttttcaaagtatgaagaactcgcatcagctgtcctcaagagagatgtggatataatcaccttatatcagaaggtctctgtttggctgttaagatatgactttgtgcttgaatatcctaggccggtcatgcccaacatggtcttcattggaggtatcaactgtaagaagaggaaagacttgtctcaggtcttgtgtggagctactacataatgaggccctgatcaggcacctgaatgctacttcctttgatgtggttttaacagaccccgttaacctctgcgcggcagtgctggctaagtacctgtcgattcctactgtgttttttttgaggaacattccatgtgatttagactttaagggcacacagtgtccaaacccttcctcctatattcctagattactaacaacccaattcagaccacatgacattcatgcaaagggtcaagaacatgctctaccctctggccctgtcctacatttgccatgctttttctgctccttatgcaagccttgcctctgagctttttcagagagaggtgtcagtggtggatattctcagtcatgcatctgtgtggctgttccgaggggactttgtgatggactaccccaggccaatcatgcccaacatggtcttcattgggggcatca

SEQ ID NO: 456176 - DNA, 1136 bp, Homo sapiens
ggatcttaatgagaagcactaaagagatttaaatagagaatgacaacatgtaatttggcttttaaacaaagttatgttttttaatgcagaaaataaattggaatgaagcccatgtgaatgcatggagacaaggtgaaaaggtagatgagaaaaaagttggaaatatttgcaggtacatttgacaggaccaggagatgtcttgggcattcatgatgatggaagagtggtcaataatgactctattttctagcttgtatcatgagatgaatggagacccgtagaagaataagttttgtgagtgactgggtcatgtaatatattttggatttgttaaatgtgaactacttttaagaaactgtggggaaaaacttcgttttgtttacatccatgaatcatttgaagcacgaaaaataattctcagctgaagatacaaatatgagggccctgggtgtataactgaaggcacgagtataaatgggattatttagggagggcttaaaagtggatagagagtaaattcacagactataggtacaaaataatcaccaatgacaatatattatgcagcttaagaccaattgtatgtattttcctgacaatgtcttttagagcctgtgactagttttctcctgaagatgtggtgatcttcttatcaatttttaagagtacttaaatgttttaacaattatatttaactcaaaattagtttccaacttgttttcctttaattataatttaaagtgtatattttatgtgtacgaatattaaaaatttatgaagtcatatctattgcctttgtctcttattactttaccaatgcttacaaaaactttcctcattaatgcttatataaattttttttttttttgcaaatttttccattcttctggtttgtaaaatgcctaaagtaaaatgtgtatctgaattaattaatcgttaaatatcttttcaattttctcaacccaatatattggacaattcacctcttactcccagagttttatctctacatattattcctatgaagcttttacacatgctgagactaaatggtctgttctatgtcattgattctatttgcctagttgtctatttaccttgtagttttgaggtaataaatggtcctttaaactgtg

SEQ ID NO: 456177 - DNA, 958 bp, Homo sapiens
  misc_feature (883)..(883): n is a, c, g, or t
  misc_feature (887)..(887): n is a, c, g, or t
  misc_feature (910)..(910): n is a, c, g, or t
  misc_feature (919)..(919): n is a, c, g, or t
  misc_feature (934)..(934): n is a, c, g, or t
  misc_feature (950)..(950): n is a, c, g, or t
cacgagggcaaaagatgcctgcctgaaggaagctgttgcccatgaaaataatagggctctttttcatgctgccaaagcttatgagcaagctggaatgatgttgaaggagatgcagaaactaccagaggccgttcagctaattgagaaggccagcatgatgtatctagaaaacggcaccccagacacagcagccatggctttggagcgagctggaaagcttatagaaaatgttgatccagagaaggctgtacagttatatcaacagacagctaatgtgtttgaaaatgaagaacgcttacgacaggcagttgaattactaggaaaagcctccagactactagtacgaggacgtaggtttgatgaggcggcactctctattcagaaagaaaaaaatatttataaggaaattgagaattatccaacttgttataagaaaacaattgctcaagtcttagttcatctacacagaaatgactatgtagctgcagaaagatgtgtccgggagagctatagcatccctgggttcaatggcagtgaagactgtgctgccctggaacagcttcttgaaggttatgaccagcaagaccaagatcaggtgtcagatgtctgcaactcaccgcttttcaagtacatggacaatgattatgctaagctgggcctgagtttggtggttccaggagggggaatcaagaagaaatcacctgcaacaccacaggccaagcctgatggtgtcactgccacggctgctgatgaagaggaagatgaatactcaggaggactatgctagtattttgcttgctgaaaagaaaagggaaacaaaggtaaaatcctgacatgccatttcaaggacttgggaatagattagggatatcctgattcattntaancctatttatcaacacctcccagntttgtgtgngggagttccccttanaactaaacacagctangttgtacg

SEQ ID NO: 456178 - DNA, 3344 bp, Homo sapiens
cacgagggcaaaagatgcctgcctgaaggaagctgttgcccatgaaaataatagggctctttttcatgctgccaaagcttatgagcaagctggaatgatgttgaaggagatgcagaaactaccagaggccgttcagctaattgagaaggccagcatgatgtatctagaaaacggcaccccagacacagcagccatggctttggagcgagctggaaagcttatagaaaatgttgatccagagaaggctgtacagttatatcaacagacagctaatgtgtttgaaaatgaagaacgcttacgacaggcagttgaattactaggaaaagcctccagactactagtacgaggacgtaggtttgatgaggcggcactctctattcagaaagaaaaaaatatttataaggaaattgagaattatccaacttgttataagaaaacaattgctcaagtcttagttcatctacacagaaatgactatgtagctgcagaaagatgtgtccgggagagctatagcatccctgggttcaatggcagtgaagactgtgctgccctggaacagcttcttgaaggttatgaccagcaagaccaagatcaggtgtcagatgtctgcaactcaccgcttttcaagtacatggacaatgattatgctaagctgggcctgagtttggtggttccaggagggggaatcaagaagaaatcacctgcaacaccacaggccaagcctgatggtgtcactgccacggctgctgatgaagaggaagatgaatactcaggaggactatgctagtattttgcttgctgaaaagaaaagggaaacaaaggtaaaatcctgacatgccatttcaaggacttgggaatagattagggatatccgtacttcattacagtcatgattttggatcctaataaagactagtttttagttaccatcttcccaaatcactcattgtatccattacctgtgaagcatatctttttctttccataagagcttttctaagacaccagcaggaattaacagaaaatgtactgtcatgttttaatacattgattaaaaaatttgcaagccaaattatacataaattatgttctaaacaaaaggggtaataagcataggtattctctcttggacacttgtaagttactgttagtgaattgttttttacgtttcatttaataattgctgctaaaggtgatgtttactgataaatcattttaaaatttttttgttttgaaaagtaaatttatcccccatgatgttagatacatttaaattattaagtcttttcagagatgagatggggacaggaagttattttgagccttacaatattatttagcccaataaaagatgcattgaagctcttatatattatgagtttgaaaaattttgaaggtagcatattgaagtgatctataaatatcttcagtcctctctgaagtgtgggtatttcttctatctaaaaaatacatacagtgactgtcttcaaatctacttggttcttgaccaaataggagctaatgggtaatgaatacctttttgtttgtttgtttgtttgttttgttttttgtttttttttttaagggtctcactcttttgcccaggctggagtgcagtggcacaatcacggctcccaggctaatgtttttatttttaatttgtaatttttttttttattttttttgttgagatggagttgctccatgttgcacaggctgttctcaaactcctaagctcaagccatctgcctgccttggcctcccaaagtgctgggattgtagacataagccacctcacccagcctatgaatatctttctaacattgtaagaatgaggtaatgtttccatcagtctaatacagatatatttcttccctccaaaacagtttattttgattgtttattttattttgattgtaactccgtcataacttgacatggaaaatgctatatactatgaaaacttagctgaaagggaagaattgttttagaaagacaatatttaaaacaccgcactgccaatatattgatcctttatagttatttcctaaaatgctgttttcgaaacattcctttttcaccctgttgtgtggcttagacccatctcgtaatctgttaattggaaagaggctacagacaccagcagtgtgcgttctgcaggtacacgctgccaaagtaattcctgctcatccatgccctgtctctgtctcttttagagtcataccttatttgagtataggttgcttaattttgctagacttcctgaaaacactaaggtggagtatcagaagtgattttagtcacagttctgcgggagagcttagaataacatcctcctttgggaggtggtctcgggtgcgtggatgttggtatacagtctttattgtaagtctgatacaaaatgctaataaatttaatgtttttcttccttaatttattggcatagttcttcaggtagcacctcatttttattaatgatattgggattaactatgaacaagctatatgtagacatttgcatttaaggacattgcagtgtttcaaagatcccatcattgcagcttgtatcctttagatccaatcggaaacttctggagtcttacattaatgctcatttgagctaattagtaatctgtttaaacagatttggcaatactttaaagatactgtagactatttatgtatagatagatcatattacccattaaagtctgggggaaaaaattttttaattttactcttcttatgtactgaaaactttttttaaaaaaggtgatgatgaagtgcattctgtagcagcagcgcagctatgctttaaaccacacaaaaggctgtgtccaggtgcagcctccttcacccttcctgcccacggtgaggattgaataaccaggacttggggatattgtttgttgtcagggttattctgtgtggtaaggaatatttgtttcacatttatacattttctttttccactcacgtaagtttctatcttgagagcatagtccaaagtgcaaaacttggtgtttacaaggaaaattgtcttccagaactccactgtcatcactttcaccaaagtggaagtttgcatgaatatgctcagaatctaatattcaatgttctgttacattgtaagtgaagtccagctacaaaatagatttaatatattgaatttatttgtacatatgcagagtacggtatttctgtatggaatctgctttattcctatttttcccaactctgatgagtagaatattaaatgtgttgttatggaaatacagattattgcttctataggaagataattatgaaaataaaacctgaaactatataaatataattgttct

SEQ ID NO: 456179 - DNA, 3479 bp, Homo sapiens
ctcccctctgctgcccttttaggcacctcagagcttgctagggccactggggcagcagcggagtatgtgatggagggacacagtcgggggaaggcaccgagtgccttgggtgtctggatgttctttcagtcgggaggaaagaaatcttgggtgatttaatcgaagatcgtctcaagtacgtatcacgaagaagtcgtgacactcgctattggacagtccttactaagcttaaaactccccgtttgacctaacccatccttgagttcttttgctttttctgtcagcgtgcagcctgaaagtggggagtcagacatttgaaaggtaagccagatgagcagagcatgtggaaacctgggtcctggggcagctgctaataatacctgtcctcctggtgtctctacaatctatgatgtcaagtacatttcacaggggacctctgctatagatcatttagacctgctttttttacatttctgtgttttgttttaggtttgatgaggcggcactctctattcagaaagaaaaaaatatttataaggaaattgagaattatccaacttgttataagaaaacaattgctcaagtcttagttcatctacacagaaatgactatgtagctgcagaaagatgtgtccgggagagctatagcatccctgggttcaatggcagtgaagactgtgctgccctggaacagcttcttgaaggttatgaccagcaagaccaagatcaggtgtcagatgtctgcaactcaccgcttttcaagtacatggacaatgattatgctaagctgggcctgagtttggtggttccaggagggggaatcaagaagaaatcacctgcaacaccacaggccaagcctgatggtgtcactgccacggctgctgatgaagaggaagatgaatactcaggaggactatgctagtattttgcttgctgaaaagaaaagggaaacaaaggtaaaatcctgacatgccatttcaaggacttgggaatagattagggatatccgtacttcattacagtcatgattttggatcctaataaagactagtttttagttaccatcttcccaaatcactcattgtatccattacctgtgaagcatatctttttctttccataagagcttttctaagacaccagcaggaattaacagaaaatgtactgtcatgttttaatacattgattaaaaaatttgcaagccaaattatacataaattatgttctaaacaaaaggggtaataagcataggtattctctcttggacacttgtaagttactgttagtgaattgttttttacgtttcatttaataattgctgctaaaggtgatgtttactgataaatcattttaaaatttttttgttttgaaaagtaaatttatcccccatgatgttagatacatttaaattattaagtcttttcagagatgagatggggacaggaagttattttgagccttacaatattatttagcccaataaaagatgcattgaagctcttatatattatgagtttgaaaaattttgaaggtagcatattgaagtgatctataaatatcttcagtcctctctgaagtgtgggtatttcttctatctaaaaaatacatacagtgactgtcttcaaatctacttggttcttgaccaaataggagctaatgggtaatgaatacctttttgtttgtttgtttgtttgttttgttttttgtttttttttttaagggtctcactcttttgcccaggctggagtgcagtggcacaatcacggctcccaggctaatgtttttatttttaatttgtaatttttttttttattttttttgttgagatggagttgctccatgttgcacaggctgttctcaaactcctaagctcaagccatctgcctgccttggcctcccaaagtgctgggattgtagacataagccacctcacccagcctatgaatatctttctaacattgtaagaatgaggtaatgtttccatcagtctaatacagatatatttcttccctccaaaacagtttattttgattgtttattttattttgattgtaactccgtcataacttgacatggaaaatgctatatactatgaaaacttagctgaaagggaagaattgttttagaaagacaatatttaaaacaccgcactgccaatatattgatcctttatagttatttcctaaaatgctgttttcgaaacattcctttttcaccctgttgtgtggcttagacccatctcgtaatctgttaattggaaagaggctacagacaccagcagtgtgcgttctgcaggtacacgctgccaaagtaattcctgctcatccatgccctgtctctgtctcttttagagtcataccttatttgagtataggttgcttaattttgctagacttcctgaaaacactaaggtggagtatcagaagtgattttagtcacagttctgcgggagagcttagaataacatcctcctttgggaggtggtctcgggtgcgtggatgttggtatacagtctttattgtaagtctgatacaaaatgctaataaatttaatgtttttcttccttaatttattggcatagttcttcaggtagcacctcatttttattaatgatattgggattaactatgaacaagctatatgtagacatttgcatttaaggacattgcagtgtttcaaagatcccatcattgcagcttgtatcctttagatccaatcggaaacttctggagtcttacattaatgctcatttgagctaattagtaatctgtttaaacagatttggcaatactttaaagatactgtagactatttatgtatagatagatcatattacccattaaagtctgggggaaaaaattttttaattttactcttcttatgtactgaaaactttttttaaaaaaggtgatgatgaagtgcattctgtagcagcagcgcagctatgctttaaaccacacaaaaggctgtgtccaggtgcagcctccttcacccttcctgcccacggtgaggattgaataaccaggacttggggatattgtttgttgtcagggttattctgtgtggtaaggaatatttgtttcacatttatacattttctttttccactcacgtaagtttctatcttgagagcatagtccaaagtgcaaaacttggtgtttacaaggaaaattgtcttccagaactccactgtcatcactttcaccaaagtggaagtttgcatgaatatgctcagaatctaatattcaatgttctgttacattgtaagtgaagtccagctacaaaatagatttaatatattgaatttatttgtacatatgcagagtacggtatttctgtatggaatctgctttattcctatttttcccaactctgatgagtagaatattaaatgtgttgttatggaaatacagattattgcttctataggaagataattatgaaaataaaacctgaaactatataaatataattgttct

SEQ ID NO: 456180 - DNA, 3416 bp, Homo sapiens
  misc_feature (2334)..(2334): n is a, c, g, or t
cacgagggcaaaagatgcctgcctgaaggaagctgttgcccatgaaaataatagggctctttttcatgctgccaaagcttatgagcaagctggaatgatgttgaaggagatgcagaaactaccagaggccgttcagctaattgagaaggccagcatgatgtatctagaaaacggcaccccagacacagcagccatggctttggagcgagctggaaagcttatagaaaatgttgatccagagaaggctgtacagttatatcaacagacagctaatgtgtttgaaaatgaagaacgcttacgacaggcagttgaattactaggaaaagcctccagactactagtacgaggacgtaggtttgatgaggcggcactctctattcagaaagaaaaaaatatttataaggaaattgagaattatccaacttgttataagaaaacaattgctcaagtcttagttcatctacacagaaatgactatgtagctgcagaaagatgtgtccgggagagctatagcatccctgggttcaatggcagtgaagactgtgctgccctggaacagcttcttgaaggttatgaccagcaagaccaagatcaggtgtcagatgtctgcaactcaccgcttttcaagtacatggacaatgattatgctaagctgggcctgagtttggtggttccaggagggggaatcaagaagaaatcacctgcaacaccacaggccaagcctgatggtgtcactgccacggctgctgatgaagaggaagatgaatactcaggaggactatgctagtattttgcttgctgaaaagaaaagggaaacaaaggtaaaatcctgacatgccatttcaaggacttgggaatagattagggatatccgtacttcattacagtcatgattttggatcctaataaagactagtttttagttaccatcttcccaaatcactcattgtatccattacctgtgaagcatatctttttctttccataagagcttttctaagacaccagcaggaattaacagaaaatgtactgtcatgttttaatacattgattaaaaaatttgcaagccaaattatacataaattatgttctaaacaaaaggggtaataagcataggtattctctcttggacacttgtaagttactgttagtgaattgttttttacgtttcatttaataattgctgctaaaggtgatgtttactgataaatcattttaaaatttttttgttttgaaaagtaaatttatcccccatgatgttagatacatttaaattattaagtcttttcagagatgagatggggacaggaagttattttgagccttacaatattatttagcccaataaaagatgcattgaagctcttatatattatgagtttgaaaaattttgaaggtagcatattgaagtgatctataaatatcttcagtcctctctgaagtgtgggtatttcttctatctaaaaaatacatacagtgactgtcttcaaatctacttggttcttgaccaaataggagctaatgggtaatgaatacctttttgtttgtttgtttgtttgttttgttttttgtttttttttttaagggtctcactcttttgcccaggctggagtgcagtggcacaatcacggctcccaggctaatgtttttatttttaatttgtaatttttttttttattttttttgttgagatggagttgctccatgttgcacaggctgttctcaaactcctaagctcaagccatctgcctgccttggcctcccaaagtgctgggattgtagacataagccacctcacccagcctatgaatatctttctaacattgtaagaatgaggtaatgtttccatcagtctaatacagatatatttcttccctccaaaacagtttattttgattgtttattttattttgattgtaactccgtcataacttgacatggaaaatgctatatactatgaaaacttagctgaaagggaagaattgttttagaaagacaatatttaaaacaccgcactgccaatatattgatcctttatagttatttcctaaaatgctgttttcgaaacattcctttttcaccctgttgtgtggcttagacccatctcgtaatctgttaattggaaagaggctacagacaccagcagtgtgcgttctgcaggtacacgctgccaaagtaattcctgctcatccatgccctgtctctgtctcttttagagtcataccttatttgagtataggttgcttaattttgctagacttcctgaaaacactaaggtggagtatcagaagtgattttagtcacagttctgcgggagagcttagaataacatcntcctttgggaggtggtctcgggtgcgtggatgttggtatacagtctttattgtaagtctgataccaacatcctcctttgggaggtggtctcgggtgcgtggatgttggtatacagtctttattgtaagtctgatacaaaatgctaataaatttaatgtttttcttccttaatttattggcatagttcttcaggtagcacctcatttttattaatgatattgggattaactatgaacaagctatatgtagacatttgcatttaaggacattgcagtgtttcaaagatcccatcattgcagcttgtatcctttagatccaatcggaaacttctggagtcttacattaatgctcatttgagctaattagtaatctgtttaaacagatttggcaatactttaaagatactgtagactatttatgtatagatagatcatattacccattaaagtctgggggaaaaaattttttaattttactcttcttatgtactgaaaactttttttaaaaaaggtgatgatgaagtgcattctgtagcagcagcgcagctatgctttaaaccacacaaaaggctgtgtccaggtgcagcctccttcacccttcctgcccacggtgaggattgaataaccaggacttggggatattgtttgttgtcagggttattctgtgtggtaaggaatatttgtttcacatttatacattttctttttccactcacgtaagtttctatcttgagagcatagtccaaagtgcaaaacttggtgtttacaaggaaaattgtcttccagaactccactgtcatcactttcaccaaagtggaagtttgcatgaatatgctcagaatctaatattcaatgttctgttacattgtaagtgaagtccagctacaaaatagatttaatatattgaatttatttgtacatatgcagagtacggtatttctgtatggaatctgctttattcctatttttcccaactctgatgagtagaatattaaatgtgttgttatggaaatacagattattgcttctataggaagataattatgaaaataaaacctgaaactatataaatataattgttct

SEQ ID NO: 456181 - DNA, 1469 bp, Homo sapiens
cacgagggcaaaagatgcctgcctgaaggaagctgttgcccatgaaaataatagggctctttttcatgctgccaaagcttatgagcaagctggaatgatgttgaaggagatgcagaaactaccagaggccgttcagctaattgagaaggccagcatgatgtatctagaaaacggcaccccagacacagcagccatggctttggagcgagctggaaagcttatagaaaatgttgatccagagaaggctgtacagttatatcaacagacagctaatgtgtttgaaaatgaagaacgcttacgacaggcagttgaattactaggaaaagcctccagactactagtacgaggacgtaggtttgatgaggcggcactctctattcagaaagaaaaaaatatttataaggaaattgagaattatccaacttgttataagaaaacaattgctcaagtcttagttcatctacacagaaatgactatgtagctgcagaaagatgtgtccgggagagctatagcatccctgggttcaatggcagtgaagactgtgctgccctggaacagcttcttgaaggttatgaccagcaagaccaagatcaggtgtcagatgtctgcaactcaccgcttttcaagtacatggacaatgattatgctaagctgggcctgagtttggtggttccaggagggggaatcaagaagaaatcacctgcaacaccacaggccaagcctgatggtgtcactgccacggctgctgatgaagaggaagatgaatactcaggaggactatgctagtattttgcttgctgaaaagaaaagggaaacaaaggtaaaatcctgacatgccatttcaaggacttgggaatagattagggatatccgtacttcattacagtcatgattttggatcctaataaagactagtttttagttaccatcttcccaaatcactcattgtatccattacctgtgaagcatatctttttctttccataagagcttttctaagacaccagcaggaattaacagaaaatgtactgtcatgttttaatacattgattaaaaaatttgcaagccaaattatacataaattatgttctaaacaaaaggggtaataagcataggtattctctcttggacacttgtaagttactgttagtgaattgttttttacgtttcatttaataattgctgctaaaggtgatgtttactgataaatcattttaaaatttttttgttttgaaaagtaaatttatcccccatgatgttagatacatttaaattattaagtcttttcagagatgagatggggacaggaagttattttgagccttacaatattatttagcccaataaaagatgcattgaagctcttatatattatgagtttgaaaaattttgaaggtagcatattgaagtgatctataaatatcttcagtcctctctgaagtgtagccaaatgaccgggatcctctag

SEQ ID NO: 456182 - DNA, 1479 bp, Homo sapiens
cacgagggcaaaagatgcctgcctgaaggaagctgttgcccatgaaaataatagggctctttttcatgctgccaaagcttatgagcaagctggaatgatgttgaaggagatgcagaaactaccagaggccgttcagctaattgagaaggccagcatgatgtatctagaaaacggcaccccagacacagcagccatggctttggagcgagctggaaagcttatagaaaatgttgatccagagaaggctgtacagttatatcaacagacagctaatgtgtttgaaaatgaagaacgcttacgacaggcagttgaattactaggaaaagcctccagactactagtacgaggacgtaggtttgatgaggcggcactctctattcagaaagaaaaaaatatttataaggaaattgagaattatccaacttgttataagaaaacaattgctcaagtcttagttcatctacacagaaatgactatgtagctgcagaaagatgtgtccgggagagctatagcatccctgggttcaatggcagtgaagactgtgctgccctggaacagcttcttgaaggttatgaccagcaagaccaagatcaggtgtcagatgtctgcaactcaccgcttttcaagtacatggacaatgattatgctaagctgggcctgagtttggtggttccaggagggggaatcaagaagaaatcacctgcaacaccacaggccaagcctgatggtgtcactgccacggctgctgatgaagaggaagatgaatactcaggaggactatgctagtattttgcttgctgaaaagaaaagggaaacaaaggtaaaatcctgacatgccatttcaaggacttgggaatagattagggatatccgtacttcattacagtcatgattttggatcctaataaagactagtttttagttaccatcttcccaaatcactcattgtatccattacctgtgaagcatatctttttctttccataagagcttttctaagacaccagcaggaattaacagaaaatgtactgtcatgttttaatacattgattaaaaaatttgcaagccaaaaaaaaaaaaaaaaaaaaaaaaaaaaaaaaaaaaaaaaaaaaaaaaaaaaaaaaaaaaaaaaaaaaaaaaaaaaaaaagaaaggaaagaaacagaacactgatatcgaccaacgatacgaacacataagagtagagtgcgccggttgcctataattatctacagacgcgccgcgacatactagatttcctaatacctgtgtttaagaggctactgatcataggagattagacattaaaaaagcaacgggcaaggcggatagactacgaatgacggaatacaacatattcgcgtgttgagtagaaaagaaccatctgtgtgggataaatagaaaaacagaactaagatagcacacgaaatctcacttattgttgtgacaagaaacactgatggaaacgcctgattgtaa

SEQ ID NO: 456183 - DNA, 461 bp, Homo sapiens
ccaagaattcggcacgagggcagaaagatgtgtccgggagagctatagcatccctgggttcaatggcagtgaagactgtgctgccctggaacagcttcttgaaggttatgaccagcaagaccaagatcaggtgtcagatgtctgcaactcaccgcttttcaagtacatggacaatgattatgctaagctgggcctgagtttggtggttccaggagggggaatcaagaagaaatcacctgcaacaccacaggccaagcctgatggtgtcactgccacggctgctgatgaagaggaagatgaatactcaggaggactatgctagtattttgcttgctgaaaagaaaagggaaacaaaggtaaaatcctgacatgccatttcaaggacttgggaatagattagggatatccgtacttcattacagtcatgattttggatcctaataaagactagtttttagtta

SEQ ID NO: 456184 - DNA, 3512 bp, Homo sapiens
cacgagggcaaaagatgcctgcctgaaggaagctgttgcccatgaaaataatagggctctttttcatgctgccaaagcttatgagcaagctggaatgatgttgattccttgtagaaaaagaagacatacagccaagaaacatgaaaaacagctcatcatcattgatcattagagaaatgcaaatcaaaaccacaatgagatctcacgccagtcagaatggtgatgattaagaagtcaggaaacaatagatgctggccaggctgtggagaaataggagatgcagaaactaccagaggccgttcagctaattgagaaggccagcatgatgtatctagaaaacggcaccccagacacagcagccatggctttggagcgagctggaaagcttatagaaaatgttgatccagagaaggctgtacagttatatcaacagacagctaatgtgtttgaaaatgaagaacgcttacgacaggcagttgaattactaggaaaagcctccagactactagtacgaggacgtaggtttgatgaggcggcactctctattcagaaagaaaaaaatatttataaggaaattgagaattatccaacttgttataagaaaacaattgctcaagtcttagttcatctacacagaaatgactatgtagctgcagaaagatgtgtccgggagagctatagcatccctgggttcaatggcagtgaagactgtgctgccctggaacagcttcttgaaggttatgaccagcaagaccaagatcaggtgtcagatgtctgcaactcaccgcttttcaagtacatggacaatgattatgctaagctgggcctgagtttggtggttccaggagggggaatcaagaagaaatcacctgcaacaccacaggccaagcctgatggtgtcactgccacggctgctgatgaagaggaagatgaatactcaggaggactatgctagtattttgcttgctgaaaagaaaagggaaacaaaggtaaaatcctgacatgccatttcaaggacttgggaatagattagggatatccgtacttcattacagtcatgattttggatcctaataaagactagtttttagttaccatcttcccaaatcactcattgtatccattacctgtgaagcatatctttttctttccataagagcttttctaagacaccagcaggaattaacagaaaatgtactgtcatgttttaatacattgattaaaaaatttgcaagccaaattatacataaattatgttctaaacaaaaggggtaataagcataggtattctctcttggacacttgtaagttactgttagtgaattgttttttacgtttcatttaataattgctgctaaaggtgatgtttactgataaatcattttaaaatttttttgttttgaaaagtaaatttatcccccatgatgttagatacatttaaattattaagtcttttcagagatgagatggggacaggaagttattttgagccttacaatattatttagcccaataaaagatgcattgaagctcttatatattatgagtttgaaaaattttgaaggtagcatattgaagtgatctataaatatcttcagtcctctctgaagtgtgggtatttcttctatctaaaaaatacatacagtgactgtcttcaaatctacttggttcttgaccaaataggagctaatgggtaatgaatacctttttgtttgtttgtttgtttgttttgttttttgtttttttttttaagggtctcactcttttgcccaggctggagtgcagtggcacaatcacggctcccaggctaatgtttttatttttaatttgtaatttttttttttattttttttgttgagatggagttgctccatgttgcacaggctgttctcaaactcctaagctcaagccatctgcctgccttggcctcccaaagtgctgggattgtagacataagccacctcacccagcctatgaatatctttctaacattgtaagaatgaggtaatgtttccatcagtctaatacagatatatttcttccctccaaaacagtttattttgattgtttattttattttgattgtaactccgtcataacttgacatggaaaatgctatatactatgaaaacttagctgaaagggaagaattgttttagaaagacaatatttaaaacaccgcactgccaatatattgatcctttatagttatttcctaaaatgctgttttcgaaacattcctttttcaccctgttgtgtggcttagacccatctcgtaatctgttaattggaaagaggctacagacaccagcagtgtgcgttctgcaggtacacgctgccaaagtaattcctgctcatccatgccctgtctctgtctcttttagagtcataccttatttgagtataggttgcttaattttgctagacttcctgaaaacactaaggtggagtatcagaagtgattttagtcacagttctgcgggagagcttagaataacatcctcctttgggaggtggtctcgggtgcgtggatgttggtatacagtctttattgtaagtctgatacaaaatgctaataaatttaatgtttttcttccttaatttattggcatagttcttcaggtagcacctcatttttattaatgatattgggattaactatgaacaagctatatgtagacatttgcatttaaggacattgcagtgtttcaaagatcccatcattgcagcttgtatcctttagatccaatcggaaacttctggagtcttacattaatgctcatttgagctaattagtaatctgtttaaacagatttggcaatactttaaagatactgtagactatttatgtatagatagatcatattacccattaaagtctgggggaaaaaattttttaattttactcttcttatgtactgaaaactttttttaaaaaaggtgatgatgaagtgcattctgtagcagcagcgcagctatgctttaaaccacacaaaaggctgtgtccaggtgcagcctccttcacccttcctgcccacggtgaggattgaataaccaggacttggggatattgtttgttgtcagggttattctgtgtggtaaggaatatttgtttcacatttatacattttctttttccactcacgtaagtttctatcttgagagcatagtccaaagtgcaaaacttggtgtttacaaggaaaattgtcttccagaactccactgtcatcactttcaccaaagtggaagtttgcatgaatatgctcagaatctaatattcaatgttctgttacattgtaagtgaagtccagctacaaaatagatttaatatattgaatttatttgtacatatgcagagtacggtatttctgtatggaatctgctttattcctatttttcccaactctgatgagtagaatattaaatgtgttgttatggaaatacagattattgcttctataggaagataattatgaaaataaaacctgaaactatataaatataattgttct

SEQ ID NO: 456185 - DNA, 2431 bp, Homo sapiens
cacgagggcaaaagatgcctgcctgaaggaagctgttgcccatgaaaataatagggctctttttcatgctgccaaagcttatgagcaagctggaatgatgttgaaggagatgcagaaactaccagaggccgttcagctaattgagaaggccagcatgatgtatctagaaaacggcaccccagacacagcagccatggctttggagcgagctggaaagcttatagaaaatgttgatccagagaaggctgtacagttatatcaacagacagctaatgtgtttgaaaatgaagaacgcttacgacaggcagttgaattactaggaaaagcctccagactactagtacgaggacgtaggtttgatgaggcggcactctctattcagaaagaaaaaaatatttataaggaaattgagaattatccaacttgttataagaaaacaattgctcaagtcttagttcatctacacagaaatgactatgtagctgcagaaagatgtgtccgggagagctatagcatccctgggttcaatggcagtgaagactgtgctgccctggaacagcttcttgaaggttatgaccagcaagaccaagatcaggtgtcagatgtctgcaactcaccgcttttcaagtacatggacaatgattatgctaagctgggcctgagtttggtggttccaggagggggaatcaagaagaaatcacctgcaacaccacaggccaagcctgatggtgtcactgccacggctgctgatgaagaggaagatgaatactcaggaggactatgctagtattttgcttgctgaaaagaaaagggaaacaaaggtaaaatcctgacatgccatttcaaggacttgggaatagattagggatatccgtacttcattacagtcatgattttggatcctaataaagactagtttttagttaccatcttcccaaatcactcattgtatccattacctgtgaagcatatctttttctttccataagagcttttctaagacaccagcaggaattaacagaaaatgtactgtcatgttttaatacattgattaaaaaatttgcaagccaaattatacataaattatgttctaaacaaaaggggtaataagcataggtattctctcttggacacttgtaagttactgttagtgaattgttttttacgtttcatttaataattgctgctaaaggtgatgtttactgataaatcattttaaaatttttttgttttgaaaagtaaatttatcccccatgatgttagatacatttaaattattaagtcttttcagagatgagatggggacaggaagttattttgagccttacaatattatttagcccaataaaagatgcattgaagctcttatatattatgagtttgaaaaattttgaaggtagcatattgaagtgatctataaatatcttcagtcctctctgaagtgtgggtatttcttctatctaaaaaatacatacagtgactgtcttcaaatctacttggttcttgaccaaataggagctaatgggtaatgaatacctttttgtttgtttgtttgtttgttttgttttttgtttttttttttaagggtctcactcttttgcccaggctggagtgcagtggcacaatcacggctcccaggctaatgtttttatttttaatttgtaatttttttttttattttttttgttgagatggagttgctccatgttgcacaggctgttctcaaactcctaagctcaagccatctgcctgccttggcctcccaaagtgctgggattgtagacataagccacctcacccagcctatgaatatctttctaacattgtaagaatgaggtaatgtttccatcagtctaatacagatatatttcttccctccaaaacagtttattttgattgtttattttattttgattgtaactccgtcataacttgacatggaaaatgctatatactatgaaaacttagctgaaagggaagaattgttttagaaagacaatatttaaaacaccgcactgccaatatattgatcctttatagttatttcctaaaatgctgttttcgaaacattcctttttcaccctgttgtgtggcttagacccatctcgtaatctgttaattggaaagaggctacagacaccagcagtgtgcgttctgcaggtacacgctgccaaagtaattcctgctcatccatgccctgtctctgtctcttttagagtcataccttatttgagtataggttgcttaattttgctagacttcctgaaaacactaaggtggagtatcagaagtgattttagtcacagttctgcgggagagcttagaataacatcctcctttgggaggtggtctcgggtgcgtggatgttggtatacagtctttattgtaagtctgatacaaaatgctaataaatttaatgtttttcttcctt

SEQ ID NO: 456186 - DNA, 926 bp, Homo sapiens
cacgagggcaaaagatgcctgcctgaaggaagctgttgcccatgaaaataatagggctctttttcatgctgccaaagcttatgagcaagctggaatgatgttgaaggagatgcagaaactaccagaggccgttcagctaattgagaaggccagcatgatgtatctagaaaacggcaccccagacacagcagccatggctttggagcgagctggaaagcttatagaaaatgttgatccagagaaggctgtacagttatatcaacagacagctaatgtgtttgaaaatgaagaacgcttacgacaggcagttgaattactaggaaaagcctccagactactagtacgaggacgtaggtttgatgaggcggcactctctattcagaaagaaaaaaatatttataaggaaattgagaattatccaacttgttataagaaaacaattgctcaagtcttagttcatctacacagaaatgactatgtagctgcagaaagatgtgtccgggagagctatagcatccctgggttcaatggcagtgaagactgtgctgccctggaacagcttcttgaaggttatgaccagcaagaccaagatcaggtgtcagatgtctgcaactcaccgcttttcaagtacatggacaatgattatgctaagctgggcctgagtttggtggttccaggagggggaatcaagaagaaatcacctgcaacaccacaggccaagcctgatggtgtcactgccacggctgctgatgaagaggaagatgaatactcaggaggactatgctagtattttgcttgctgaaaagaaaagggaaacaaaggtaaaatcctgacatgccatttcaaggacttgggaatagattagggatatccgtacttcattacagtcatgattttggatcctaataaagactagtttttagtta

SEQ ID NO: 456187 - DNA, 1491 bp, Homo sapiens
tttttttttccagccaagcagcagctttattagtggtgctgggttcttcccataccctacagcgtgctcggaagcattccgcgccgggcctgccagacacctgcgcccttctgcagccgcccgccgcatccgccgccgcagcccccagcatgtcgggcccagacgtcgagacgccgtccgccatccagatctgccggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgga

SEQ ID NO: 456188 - DNA, 2436 bp, Homo sapiens
tttttttcggagttgcgtgggttttaatttaaagatgtaagtacaaatctatgtgcattgtagaaaattcggaaaaggtccaactgcctagcaagtaaaaagctgtcattccagcacgtggggggtgaccgcttctcccttcttgggtgttttttggtggattttttttggtgaccccgactggcctagactccattcaagggcacatcttgtgcagtaaaacacgcatgtttcagggctcctcactgcaacacgtgcacctccaggctggcgctcagcgctcccagtaaaagctgcaggcggcggtgtagatagtcgccggcctttcctcctccccacctcgtgacgctttgtgctgcggaagcaaaggcccgttccattccccgtgtcttcccagcagccgccaccaatgctcctttctaggaaacagccttccattctctcttagggccgatcttagcgagagccgcgatgcgggcgactggtgccggggtgggttgggggcgggggtgggaatcaggccccactgccaggagcccgggccgcgccttccgctctgacctcatccggccgcccaggcactgggcgcggcagcgaatcggcggcgcgggcggccgggaacgcccagcacaaatatttaccgccgcgcggagagtgagggcccaagtccgccctgctccgccacttaggccgccccagacgcttccctcggggctgccaccgggtcgggcgcggctgccgcggctagcgggccttccccgcaccggcgcggcccaaccgccaccgaaccttctggaagcggcggctgcctgggcccccacgccgccagaatcgtacgcccgcgcgagctctctgcagccttggcggcctgggaggcggggctcggggtggggccggcgcgggggcggggtcggcgcggggaggccgcgttcgattcgcccccggcgcgcaggccccgcctcaccagccccatcgctccacctctgccctccccctttatggcgcggcccgggctcattcattccgcgccgggcctgccagacacctgcgcccttctgcagccgcccgccgcatccgccgccgcagcccccagcatgtcgggcccagacgtcgagacgccgtccgccatccagatctgccggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgga

SEQ ID NO: 456189 - DNA, 2651 bp, Homo sapiens
tttttttcggagttgcgtgggttttaatttaaagatgtaagtacaaatctatgtgcattgtagaaaattcggaaaaggtccaactgcctagcaagtaaaaagctgtcattccagcacgtggggggtgaccgcttctcccttcttgggtgttttttggtggattttttttggtgaccccgactggcctagactccattcaagggcacatcttgtgcagtaaaacacgcatgtttcagggctcctcactgcaacacgtgcacctccaggctggcgctcagcgctcccagtaaaagctgcaggcggcggtgtagatagtcgccggcctttcctcctccccacctcgtgacgctttgtgctgcggaagcaaaggcccgttccattccccgtgtcttcccagcagccgccaccaatgctcctttctaggaaacagccttccattctctcttagggccgatcttagcgagagccgcgatgcgggcgactggtgccggggtgggttgggggcgggggtgggaatcaggccccactgccaggagcccgggccgcgccttccgctctgacctcatccggccgcccaggcactgggcgcggcagcgaatcggcggcgcgggcggccgggaacgcccagcacaaatatttaccgccgcgcggagagtgagggcccaagtccgccctgctccgccacttaggccgccccagacgcttccctcggggctgccaccgggtcgggcgcggctgccgcggctagcgggccttccccgcaccggcgcggcccaaccgccaccgaaccttctggaagcggcggctgcctgggcccccacgccgccagaatcgtacgcccgcgcgagctctctgcagccttggcggcctgggaggcggggctcggggtggggccggcgcgggggcggggtcggcgcggggaggccgcgttcgattcgcccccggcgcgcaggccccgcctcaccagccccatcgctccacctctgccctccccctttatggcgcggcccgggctcattcattccgcgccgggcctgccagacacctgcgcccttctgcagccgcccgccgcatccgccgccgcagcccccagcatgtcgggcccagacgtcgagacgccgtccgccatccagatctgccggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctggaaaagcggtgaatatataattagaaccatatacacacaaaaaatacagtggagaccgtttcccttaaattgtagcggattaatatacgagaactgggattaaaattaacggcgaagtttccgctaagtatatttgtttagtagatagcgaagtgtgttagcgaaaataatttggggcactttgagggaaaacgccatctgggttgaatcgatttgg

SEQ ID NO: 456190 - DNA, 2323 bp, Homo sapiens
tttttttcggagttgcgtgggttttaatttaaagatgtaagtacaaatctatgtgcattgtagaaaattcggaaaaggtccaactgcctagcaagtaaaaagctgtcattccagcacgtggggggtgaccgcttctcccttcttgggtgttttttggtggattttttttggtgaccccgactggcctagactccattcaagggcacatcttgtgcagtaaaacacgcatgtttcagggctcctcactgcaacacgtgcacctccaggctggcgctcagcgctcccagtaaaagctgcaggcggcggtgtagatagtcgccggcctttcctcctccccacctcgtgacgctttgtgctgcggaagcaaaggcccgttccattccccgtgtcttcccagcagccgccaccaatgctcctttctaggaaacagccttccattctctcttagggccgatcttagcgagagccgcgatgcgggcgactggtgccggggtgggttgggggcgggggtgggaatcaggccccactgccaggagcccgggccgcgccttccgctctgacctcatccggccgcccaggcactgggcgcggcagcgaatcggcggcgcgggcggccgggaacgcccagcacaaatatttaccgccgcgcggagagtgagggcccaagtccgccctgctccgccacttaggccgccccagacgcttccctcggggctgccaccgggtcgggcgcggctgccgcggctagcgggccttccccgcaccggcgcggcccaaccgccaccgaaccttctggaagcggcggctgcctgggcccccacgccgccagaatcgtacgcccgcgcgagctctctgcagccttggcggcctgggaggcggggctcggggtggggccggcgcgggggcggggtcggcgcggggaggccgcgttcgattcgcccccggcgcgcaggccccgcctcaccagccccatcgctccacctctgccctccccctttatggcgcggcccgggctcattcattccgcgccgggcctgccagacacctgcgcccttctgcagccgcccgccgcatccgccgccgcagcccccagcatgtcgggcccagacgtcgagacgccgtccgccatccagatctgccggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgga

SEQ ID NO: 456191 - DNA, 1320 bp, Homo sapiens
tctgatttggggaaagggagaaggggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgga

SEQ ID NO: 456192 - DNA, 1429 bp, Homo sapiens
tacaatgctgtttgttatcctcagtggaagaggcacaaaggggtcaccattccctttttcactatgtatcgaattatagcttcccttaaaaaaggcaatactttccaaaattgtggagcctgcattactggaaggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgga

SEQ ID NO: 456193 - DNA, 1392 bp, Homo sapiens
gacgtggggagacgatgctcctgcttcggagaagcttgtcactaaacgtcctcagaaaggaagtcgacagggcctgttttggggagaaggccaaacagatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgga

SEQ ID NO: 456194 - DNA, 2402 bp, Homo sapiens
tttttttcggagttgcgtgggttttaatttaaagatgtaagtacaaatctatgtgcattgtagaaaattcggaaaaggtccaactgcctagcaagtaaaaagctgtcattccagcacgtggggggtgaccgcttctcccttcttgggtgttttttggtggattttttttggtgaccccgactggcctagactccattcaagggcacatcttgtgcagtaaaacacgcatgtttcagggctcctcactgcaacacgtgcacctccaggctggcgctcagcgctcccagtaaaagctgcaggcggcggtgtagatagtcgccggcctttcctcctccccacctcgtgacgctttgtgctgcggaagcaaaggcccgttccattccccgtgtcttcccagcagccgccaccaatgctcctttctaggaaacagccttccattctctcttagggccgatcttagcgagagccgcgatgcgggcgactggtgccggggtgggttgggggcgggggtgggaatcaggccccactgccaggagcccgggccgcgccttccgctctgacctcatccggccgcccaggcactgggcgcggcagcgaatcggcggcgcgggcggccgggaacgcccagcacaaatatttaccgccgcgcggagagtgagggcccaagtccgccctgctccgccacttaggccgccccagacgcttccctcggggctgccaccgggtcgggcgcggctgccgcggctagcgggccttccccgcaccggcgcggcccaaccgccaccgaaccttctggaagcggcggctgcctgggcccccacgccgccagaatcgtacgcccgcgcgagctctctgcagccttggcggcctgggaggcggggctcggggtggggccggcgcgggggcggggtcggcgcggggaggccgcgttcgattcgcccccggcgcgcaggccccgcctcaccagccccatcgctccacctctgccctccccctttatggcgcggcccgggctcattcattccgcgccgggcctgccagacacctgcgcccttctgcagccgcccgccgcatccgccgccgcagcccccagcatgtcgggcccagacgtcgagacgccgtccgccatccagatctgccggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcggccattaattttcatgacaagatcagaaaaggctgcgtcatcaccatctcgggacgcatgaccttcacgagcaataagtccatggagagccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgga

SEQ ID NO: 456195 - DNA, 1099 bp, Homo sapiens
  misc_feature (66)..(66): n is a, c, g, or t
gaatcgagctcgtacccctgactctgaacttaggctgtggcagtgtgcgggtcaacgtgatgtcgnaaacatctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgga

SEQ ID NO: 456196 - DNA, 1250 bp, Homo sapiens
gctctgtacaagtttctgttgaacatgtatttcttctgggtatctgcctaggagtggaattgctaggttatacggtccctctgtgtttatcctcttgcgaaacttcaaactgtttccaaagtacctgcacctttggctcccactggcagtggaggagggttccagtttcccccacatcctcgccagcacgtgctgttctgtgacttcaggattgcagccatcccagttgatattgtaacaaaacttgcccagcagggtgagatatctgtagaggacaggaaaagggctgttttgttagtggcttggcatatcagccatggtcgtttttttcaaaatctcctgaggaagccccatgtagcgcgtgagccacagcacgtgcggccgagcaccctgcacccctgctggctgcggcccttgctggtggctagtgggaggggagggctcgagttgtaacttgtttccagggtgtgaaataatctcctctgcctccgtgtctcatctgccgcatgtccctttctccgcaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgga

SEQ ID NO: 456197 - DNA, 1323 bp, Homo sapiens
gctctgtacaagtttctgttgaacatgtatttcttctgggtatctgcctaggagtggaattgctaggttatacggtccctctgtgtttatcctcttgcgaaacttcaaactgtttccaaagtacctgcacctttggctcccactggcagtggaggagggttccagtttcccccacatcctcgccagcacgtgctgttctgtgacttcaggattgcagccatcccagttgatattgtaacaaaacttgcccagcagggtgagatatctgtagaggacaggaaaagggctgttttgttagtggcttggcatatcagccatggtcgtttttttcaaaatctcctgaggaagccccatgtagcgcgtgagccacagcacgtgcggccgagcaccctgcacccctgctggctgcggcccttgctggtggctagtgggaggggagggctcgagttgtaacttgtttccagggtgtgaaataatctcctctgcctccgtgtctcatctgccgcatgtccctttctccgcaggtgtgaccatgaagctcatggatgaggtcgccgggatcgtggctgcacgccactgcaagaccaacatcgtcacagcttccgtggacgccattaattttcatgacaagatcagaaaagctcacgtaatgcctgctggcgctgaccacacagctccttcctcctctcccagcactggcacgaagtgctccctgctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgga

SEQ ID NO: 456198 - DNA, 1819 bp, Homo sapiens
tttttttcggagttgcgtgggttttaatttaaagatgtaagtacaaatctatgtgcattgtagaaaattcggaaaaggtccaactgcctagcaagtaaaaagctgtcattccagcacgtggggggtgaccgcttctcccttcttgggtgttttttggtggattttttttggtgaccccgactggcctagactccattcaagggcacatcttgtgcagtaaaacacgcatgtttcagggctcctcactgcaacacgtgcacctccaggctggcgctcagcgctcccagtaaaagctgcaggcggcggtgtagatagtcgccggcctttcctcctccccacctcgtgacgctttgtgctgcggaagcaaaggcccgttccattccccgtgtcttcccagcagccgccaccaatgctcctttctaggaaacagccttccattctctcttagggccgatcttagcgagagccgcgatgcgggcgactggtgccggggtgggttgggggcgggggtgggaatcaggccccactgccaggagcccgggccgcgccttccgctctgacctcatccggccgcccaggcactgggcgcggcagcgaatcggcggcgcgggcggccgggaacgcccagcacaaatatttaccgccgcgcggagagtgagggcccaagtccgccctgctccgccacttaggccgccccagacgcttccctcggggctgccaccgggtcgggcgcggctgccgcggctagcgggccttccccgcaccggcgcggcccaaccgccaccgaaccttctggaagcggcggctgcctgggcccccacgccgccagaatcgtacgcccgcgcgagctctctgcagccttggcggcctgggaggcggggctcggggtggggccggcgcgggggcggggtcggcgcggggaggccgcgttcgattcgcccccggcgcgcaggccccgcctcaccagccccatcgctccacctctgccctccccctttatggcgcggcccgggctcattcattccgcgccgggcctgccagacacctgcgcccttctgcagccgcccgccgcatccgccgccgcagcccccagcatgtcgggcccagacgtcgagacgccgtccgccatccagatctgccggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgga

SEQ ID NO: 456199 - DNA, 446 bp, Homo sapiens
tgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctggacccacgtgtcctgggtggtcatttgtcttgggggggctgctttcccagggggtgtgggacattggggctcccgtggacagtctcagccctcccagcaccagcacctgcatgtaccctagaacctcaggcacagccacaccgattggtgtccggctggtgacttgctggctatgaatgcccatttcccgtgggtccctggtttggtgtcctggccccagacaccctggctccctggacctcataggcagcccagatgctgggaggatgtgggctcagg

SEQ ID NO: 456200 - DNA, 2558 bp, Homo sapiens
  misc_feature (2450)..(2450): n is a, c, g, or t
tttttttcggagttgcgtgggttttaatttaaagatgtaagtacaaatctatgtgcattgtagaaaattcggaaaaggtccaactgcctagcaagtaaaaagctgtcattccagcacgtggggggtgaccgcttctcccttcttgggtgttttttggtggattttttttggtgaccccgactggcctagactccattcaagggcacatcttgtgcagtaaaacacgcatgtttcagggctcctcactgcaacacgtgcacctccaggctggcgctcagcgctcccagtaaaagctgcaggcggcggtgtagatagtcgccggcctttcctcctccccacctcgtgacgctttgtgctgcggaagcaaaggcccgttccattccccgtgtcttcccagcagccgccaccaatgctcctttctaggaaacagccttccattctctcttagggccgatcttagcgagagccgcgatgcgggcgactggtgccggggtgggttgggggcgggggtgggaatcaggccccactgccaggagcccgggccgcgccttccgctctgacctcatccggccgcccaggcactgggcgcggcagcgaatcggcggcgcgggcggccgggaacgcccagcacaaatatttaccgccgcgcggagagtgagggcccaagtccgccctgctccgccacttaggccgccccagacgcttccctcggggctgccaccgggtcgggcgcggctgccgcggctagcgggccttccccgcaccggcgcggcccaaccgccaccgaaccttctggaagcggcggctgcctgggcccccacgccgccagaatcgtacgcccgcgcgagctctctgcagccttggcggcctgggaggcggggctcggggtggggccggcgcgggggcggggtcggcgcggggaggccgcgttcgattcgcccccggcgcgcaggccccgcctcaccagccccatcgctccacctctgccctccccctttatggcgcggcccgggctcattcattccgcgccgggcctgccagacacctgcgcccttctgcagccgcccgccgcatccgccgccgcagcccccagcatgtcgggcccagacgtcgagacgccgtccgccatccagatctgccggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctggaaacaacaaaaaaanaaaaactcggggtctttttggggggggaaaggtttaaaggccggctctctggttccgccccgctttggaaagggaatgcggcccatagggtatcgacgtgctcacaag

SEQ ID NO: 456201 - DNA, 1616 bp, Homo sapiens
gcggtcctaggaggagcaggagcctggtgctttctatcagggagggatcacaccggctcactgctgagccggccaggcagacacaggcttgggctctgctgggcatcatacttgtcactgggtaaacagtttgcccacttaccgcaggatgaagctgcttgccagggctctccggctctgtgagtttgggaggcaggcatcttccaggaggctggtggctggccagggatgtgtggggccccggcgagggtgctgcgctcccgtccaggtggttgggcccagggctgatctcccaccctgtggagcctgcattactggaaggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgga

SEQ ID NO: 456202 - DNA, 1414 bp, Homo sapiens
gcagggagctgggacagtcctgggtcaggcaaggactctgtgatgcttccctgctccctcgcctttctctgcatctgatcctgggatgtcctagccaccatggctttccagctgagcaggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgga

SEQ ID NO: 456203 - DNA, 1685 bp, Homo sapiens
gcggtcctaggaggagcaggagcctggtgctttctatcagggagggatcacaccggctcactgctgagccggccaggcagacacaggcttgggctctgctgggcatcatacttgtcactgggtaaacagtttgcccacttaccgcaggatgaagctgcttgccagggctctccggctctgtgagtttgggaggcaggcatcttccaggaggctggtggctggccagggatgtgtggggccccggcgagggtgctgcgctcccgtccaggtggttgggtgcccgagggtcgtgtatcttcgaccacttcctagtcggaagcctcttcagtgtactcggtaacgcgagtcactgtctggccagaactgcagtgccatatgcgtggtgccggccaagtgctgccatcgtgcggtggaccatccgtgaagactgattgcgacggagtgccgggtcgcccatcactcagcctgcccggcatttgtcaaggcagtgcctgacacggcggtacgtgagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgga

SEQ ID NO: 456204 - DNA, 2251 bp, Homo sapiens
tttttttcggagttgcgtgggttttaatttaaagatgtaagtacaaatctatgtgcattgtagaaaattcggaaaaggtccaactgcctagcaagtaaaaagctgtcattccagcacgtggggggtgaccgcttctcccttcttgggtgttttttggtggattttttttggtgaccccgactggcctagactccattcaagggcacatcttgtgcagtaaaacacgcatgtttcagggctcctcactgcaacacgtgcacctccaggctggcgctcagcgctcccagtaaaagctgcaggcggcggtgtagatagtcgccggcctttcctcctccccacctcgtgacgctttgtgctgcggaagcaaaggcccgttccattccccgtgtcttcccagcagccgccaccaatgctcctttctaggaaacagccttccattctctcttagggccgatcttagcgagagccgcgatgcgggcgactggtgccggggtgggttgggggcgggggtgggaatcaggccccactgccaggagcccgggccgcgccttccgctctgacctcatccggccgcccaggcactgggcgcggcagcgaatcggcggcgcgggcggccgggaacgcccagcacaaatatttaccgccgcgcggagagtgagggcccaagtccgccctgctccgccacttaggccgccccagacgcttccctcggggctgccaccgggtcgggcgcggctgccgcggctagcgggccttccccgcaccggcgcggcccaaccgccaccgaaccttctggaagcggcggctgcctgggcccccacgccgccagaatcgtacgcccgcgcgagctctctgcagccttggcggcctgggaggcggggctcggggtggggccggcgcgggggcggggtcggcgcggggaggccgcgttcgattcgcccccggcgcgcaggccccgcctcaccagccccatcgctccacctctgccctccccctttatggcgcggcccgggctcattcattccgcgccgggcctgccagacacctgcgcccttctgcagccgcccgccgcatccgccgccgcagcccccagcatgtcgggcccagacgtcgagacgccgtccgccatccagatctgccggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaagcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgga

SEQ ID NO: 456205 - DNA, 1996 bp, Homo sapiens
  misc_feature (1746)..(1746): n is a, c, g, or t
  misc_feature (1758)..(1758): n is a, c, g, or t
  misc_feature (1827)..(1827): n is a, c, g, or t
  misc_feature (1924)..(1924): n is a, c, g, or t
tttttttcggagttgcgtgggttttaatttaaagatgtaagtacaaatctatgtgcattgtagaaaattcggaaaaggtccaactgcctagcaagtaaaaagctgtcattccagcacgtggggggtgaccgcttctcccttcttgggtgttttttggtggattttttttggtgaccccgactggcctagactccattcaagggcacatcttgtgcagtaaaacacgcatgtttcagggctcctcactgcaacacgtgcacctccaggctggcgctcagcgctcccagtaaaagctgcaggcggcggtgtagatagtcgccggcctttcctcctccccacctcgtgacgctttgtgctgcggaagcaaaggcccgttccattccccgtgtcttcccagcagccgccaccaatgctcctttctaggaaacagccttccattctctcttagggccgatcttagcgagagccgcgatgcgggcgactggtgccggggtgggttgggggcgggggtgggaatcaggccccactgccaggagcccgggccgcgccttccgctctgacctcatccggccgcccaggcactgggcgcggcagcgaatcggcggcgcgggcggccgggaacgcccagcacaaatatttaccgccgcgcggagagtgagggcccaagtccgccctgctccgccacttaggccgccccagacgcttccctcggggctgccaccgggtcgggcgcggctgccgcggctagcgggccttccccgcaccggcgcggcccaaccgccaccgaaccttctggaagcggcggctgcctgggcccccacgccgccagaatcgtacgcccgcgcgagctctctgcagccttggcggcctgggaggcggggctcggggtggggccggcgcgggggcggggtcggcgcggggaggccgcgttcgattcgcccccggcgcgcaggccccgcctcaccagccccatcgctccacctctgccctccccctttatggcgcggcccgggctcattcattccgcgccgggcctgccagacacctgcgcccttctgcagccgcccgccgcatccgccgccgcagcccccagcatgtcgggcccagacgtcgagacgccgtccgccatccagatctgccggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcataccacaggtgccaaaangctgaacgcggngtcagatctgtggtttttctacttgaaggacacaatgttttccaaactagcacatttgcagaggtttgntgtacttagtcgcggagttcattcttcagaggcttctgctacatctgttggaactaaaaaaacagtccaagggcctccaacctctgatgacattttnggaaagggaatattaagtatggtggacacaactaccatcccttttacctggtaggccctgggagaggaggga

SEQ ID NO: 456206 - DNA, 1934 bp, Homo sapiens
tttttttcggagttgcgtgggttttaatttaaagatgtaagtacaaatctatgtgcattgtagaaaattcggaaaaggtccaactgcctagcaagtaaaaagctgtcattccagcacgtggggggtgaccgcttctcccttcttgggtgttttttggtggattttttttggtgaccccgactggcctagactccattcaagggcacatcttgtgcagtaaaacacgcatgtttcagggctcctcactgcaacacgtgcacctccaggctggcgctcagcgctcccagtaaaagctgcaggcggcggtgtagatagtcgccggcctttcctcctccccacctcgtgacgctttgtgctgcggaagcaaaggcccgttccattccccgtgtcttcccagcagccgccaccaatgctcctttctaggaaacagccttccattctctcttagggccgatcttagcgagagccgcgatgcgggcgactggtgccggggtgggttgggggcgggggtgggaatcaggccccactgccaggagcccgggccgcgccttccgctctgacctcatccggccgcccaggcactgggcgcggcagcgaatcggcggcgcgggcggccgggaacgcccagcacaaatatttaccgccgcgcggagagtgagggcccaagtccgccctgctccgccacttaggccgccccagacgcttccctcggggctgccaccgggtcgggcgcggctgccgcggctagcgggccttccccgcaccggcgcggcccaaccgccaccgaaccttctggaagcggcggctgcctgggcccccacgccgccagaatcgtacgcccgcgcgagctctctgcagccttggcggcctgggaggcggggctcggggtggggccggcgcgggggcggggtcggcgcggggaggccgcgttcgattcgcccccggcgcgcaggccccgcctcaccagccccatcgctccacctctgccctccccctttatggcgcggcccgggctcattcattccgcgccgggcctgccagacacctgcgcccttctgcagccgcccgccgcatccgccgccgcagcccccagcatgtcgggcccagacgtcgagacgccgtccgccatccagatctgccggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgga

SEQ ID NO: 456207 - DNA, 1637 bp, Homo sapiens
  misc_feature (454)..(454): n is a, c, g, or t
gcctttcttattggaatgaagctagttgggataggaatgaaaggttaaatcatagaactcagtccctgcatttctgctgggatcttggcttttcagtcggaggaaaattctccaaaaacattctccatgtgaggatgagcaaatatgaagggatagcattgttgccacgttcattttctgtctgggcaaggccatggggtggaaagagccaaagctaagctgaagctccacagagctcacaccatgttatctacttgagggagtgggaggtgtttgaagactaaagccaactctttttggctaagaatcttttctttggtagaacttctgtctcctcccctctaggaggatcaccatctcacattttaaaagttaggtgctctttgtatgcgaggattgggattgttaggggcctgtgttcgtgatgatcactatcatggagtcatttcttgtngggaatagttagagggtaagatcagagataggtacttagttcaagaagactctctgaagctcccaaactgtagatatgtcctgtgtgcgaactggctggctttacagaagtcctgatggaagtgggtttattgttttttgactcgttaccaaccctctgcttactccttcccctcaaaaaagggaagctgacttctcaggttagccagcagctcactcatacttttttctctctctattccattggctgatctgctgacttggggctctgaatctggatactctccatcaccggttggctgctgtcaccatttccttcctcgttgatggcactactagtggtcaagcagaggatgcagatgtacaactcaccataccaccgggtgacagactgtgtacgggcagtgtggcaaaatgaaggggccggggccttttaccgcagctacaccacccagctgaccatgaacgttcctttccaagccattcacttcatgacctatgaattcctgcaggagcactttaacccccagagacggtacaacccaagctcccacgtcctctctggagcttgcgcaggagctgtagctgccgcagccacaaccccactggacgtttgcaaaacactgctcaacacccaggagtccttggctttgaactcacacattacaggacatatcacaggcatggctagtgccttcaggacggtatatcaagtaggtggggtgaccgcctatttccgaggggtgcaggccagagtaatttaccagatcccctccacagccatcgcatggtctgtgtatgagttcttcaaatacctaatcactaaaaggcaagaagagtggagggctggcaagtgaagtagcactgaacgaagccaggggttcagatgacactgctgcatcctggtcacattctctgtctcctggaatgctcccacctcaagtggagttagaaggaaggtagaggggctctcccccaggattttggtgttttgactaacaccagttcctgccaacctctgttgccaccacctttccttccaggccctaagcacgtgcagcaaagcacaccacagcacctttgataacctctctccatcctgggcctgatgacctgctctagactgttatagagggataagcagctcattcccctggttcctaataaaaagcctttaaattaaa

SEQ ID NO: 456208 - DNA, 1547 bp, Homo sapiens
caagcgggagccggaggccccgggctctctgggccgcgcctgaggcggacactacggggccggggggcggcggcggcagtggtggcagcggcggcgggggtgggcgccgcagctggcccgggtggatggagttggaggggcggggtgctggcggtgtggcgggggggccggcggcagggcccgggcggagccccggggagtcggcgctgctggacgggtggctgcagcggggcgtgggccggggggccggcggcggggaggccggggcctgcaggcccccggtacgacaagatccggactccggcccggactacgaggcgctgccggctggagccactgtcaccacgcacatggtggcaggcgccgtggcagggatcctggagcactgcgtgatgtaccccatcgactgcgtcaagacccggatgcagagtctacagcctgacccagctgcccgctatcgcaatgtgttggaggccctctggaggattataagaacggagggcctatggaggcccatgagggggctgaacgtcacagcaacaggcgcagggcctgcccacgccctttattttgcctgctacgaaaagttaaaaaagacattgagtgatgtaatccaccctgggggcaatagccatattgccaatggtgcggccgggtgtgtggcaacattacttcatgatgcagccatgaaccctgcggaagtggtcaagcagaggatgcagatgtacaactcaccataccaccgggtgacagactgtgtacgggcagtgtggcaaaatgaaggggccggggccttttaccgcagctacaccacccagctgaccatgaacgttcctttccaagccattcacttcatgacctatgaattcctgcaggagcactttaacccccagagacggtacaacccaagctcccacgtcctctctggagcttgcgcaggagctgtagctgccgcagccacaaccccactggacgtttgcaaaacactgctcaacacccaggagtccttggctttgaactcacacattacaggacatatcacaggcatggctagtgccttcaggacggtatatcaagtaggtggggtgaccgcctatttccgaggggtgcaggccagagtaatttaccagatcccctccacagccatcgcatggtctgtgtatgagttcttcaaatacctaatcactaaaaggcaagaagagtggagggctggcaagtgaagtagcactgaacgaagccaggggttcagatgacactgctgcatcctggtcacattctctgtctcctggaatgctcccacctcaagtggagttagaaggaaggtagaggggctctcccccaggattttggtgttttgactaacaccagttcctgccaacctctgttgccaccacctttccttccaggccctaagcacgtgcagcaaagcacaccacagcacctttgataacctctctccatcctgggcctgatgacctgctctagactgttatagagggataagcagctcattcccctggttcctaataaaaagcctttaaattaaa

SEQ ID NO: 456209 - DNA, 2423 bp, Homo sapiens
cgacgtggtgcgggccaatggccgcggtcaaagtatcaagagtggttgagcctatcaaagttcagccttaagtttctcccgcccttctaaaagtcagaggcgggttgatcgcacatgtcggccaatcagtgaccaataaacaagaagcttctaagatcaaaggggaaaaggtgggatgtaggcgctagcaacgcctcagggcggaggaatgacaggcgacttcgctaatactaccggctgatttttcgtacgtaaacccggatgcagagtctacagcctgacccagctgcccgctatcgcaatgtgttggaggccctctggaggattataagaacggagggcctatggaggcccatgagggggctgaacgtcacagcaacaggcgcagggcctgcccacgccctttattttgcctgctacgaaaagtattgagccttcctgtgctggttcccccactttcccaactctttgggctttgctgctgtcagtgctttccagtctcagcatggtttggagctgaagctttgggctgggataggccagattataagggagggacttccaaacctgatgttctcagacaacgggccgcttcaaccctgccttttcctttggggcacctcaacaaagggttacagtatcctcccttacctaccagcttgacttgttcctctcatctccctggcatcaacttctaatgccctggtaatgtggagacacactgaactacccccagtctatgtttgacagttgggtggtgtcctgctccttagggcaggattggaggcgacccagccagccacccaaggaagatactaatgaagcccctgctttttgcctcaccttttcaggatcccaactcaccagaggcagtttgtgttgagaacatgacaaagcctcatgacaaaatgaatgggggtggggccaaggaactgcatgaagaaaccagaaggttgtgtggaagtaagagaaaggatagcagcctagggctttaggaccggctggaaaccaagttgagtgtggagaggatgaggggtagagtagttcaggacctgaacgaaagatctttgtagacaaatgttaggctctgcaaatgggttctgcggcaggactgaggtgggattctgtggtgaggttctgtgagatctgaccacctggcccccgtatctccctccactggtggcaggtgatgtgctggcatccctaggcagcagtgtatctgcttcctgtctggggtgtgagctgcatttattctcagaatgatctttattgataagacttgagctggccttcctatcatggatgtggaatacattagtgaccttacaaagttggtgggaacagatactttaccttcttaaacaggagtttaggagcagtgggtccccatcttttggactagctcttaacgttacttttccccgctgtagtgtagcacagccactccccttcactgggggacctcaatgagttggtcagctctcttggccttacatgtggcagttgttttcttgtttgcaggtgcggccgggtgtgtggcaacattacttcatgatgcagccatgaaccctgcggaagtggtcaagcagaggatgcagatgtacaactcaccataccaccgggtgacagactgtgtacgggcagtgtggcaaaatgaaggggccggggccttttaccgcagctacaccacccagctgaccatgaacgttcctttccaagccattcacttcatgacctatgaattcctgcaggagcactttaacccccagagacggtacaacccaagctcccacgtcctctctggagcttgcgcaggagctgtagctgccgcagccacaaccccactggacgtttgcaaaacactgctcaacacccaggagtccttggctttgaactcacacattacaggacatatcacaggcatggctagtgccttcaggacggtatatcaagtaggtggggtgaccgcctatttccgaggggtgcaggccagagtaatttaccagatcccctccacagccatcgcatggtctgtgtatgagttcttcaaatacctaatcactaaaaggcaagaagagtggagggctggcaagtgaagtagcactgaacgaagccaggggttcagatgacactgctgcatcctggtcacattctctgtctcctggaatgctcccacctcaagtggagttagaaggaaggtagaggggctctcccccaggattttggtgttttgactaacaccagttcctgccaacctctgttgccaccacctttccttccaggccctaagcacgtgcagcaaagcacaccacagcacctttgataacctctctccatcctgggcctgatgacctgctctagactgttatagagggataagcagctcattcccctggttcctaataaaaagcctttaaattaaa

SEQ ID NO: 456210 - DNA, 2516 bp, Homo sapiens
cgacgtggtgcgggccaatggccgcggtcaaagtatcaagagtggttgagcctatcaaagttcagccttaagtttctcccgcccttctaaaagtcagaggcgggttgatcgcacatgtcggccaatcagtgaccaataaacaagaagcttctaagatcaaaggggaaaaggtgggatgtaggcgctagcaacgcctcagggcggaggaatgacaggcgacttcgctaatactaccggctgatttttcgtacgtaaacccggatgcagagtctacagcctgacccagctgcccgctatcgcaatgtgttggaggccctctggaggattataagaacggagggcctatggaggcccatgagggggctgaacgtcacagcaacaggcgcagggcctgcccacgccctttattttgcctgctacgaaaagtattgagccttcctgtgctggttcccccactttcccaactctttgggctttgctgctgtcagtgctttccagtctcagcatggtttggagctgaagctttgggctgggataggccagattataagggagggacttccaaacctgatgttctcagacaacgggccgcttcaaccctgccttttcctttggggcacctcaacaaagggttacagtatcctcccttacctaccagcttgacttgttcctctcatctccctggcatcaacttctaatgccctggtaatgtggagacacactgaactacccccagtctatgtttgacagttgggtggtgtcctgctccttagggcaggattggaggcgacccagccagccacccaaggaagatactaatgaagcccctgctttttgcctcaccttttcaggatcccaactcaccagaggcagtttgtgttgagaacatgacaaagcctcatgacaaaatgaatgggggtggggccaaggaactgcatgaagaaaccagaaggttgtgtggaagtaagagaaaggatagcagcctagggctttaggaccggctggaaaccaagttgagtgtggagaggatgaggggtagagtagttcaggacctgaacgaaagatctttgtagacaaatgttaggctctgcaaatgggttctgcggcaggactgaggtgggattctgtggtgaggttctgtgagatctgaccacctggcccccgtatctccctccactggtggcaggtgatgtgctggcatccctaggcagcagtgtatctgcttcctgtctggggtgtgagctgcatttattctcagaatgatctttattgataagacttgagctggccttcctatcatggatgtggaatacattagtgaccttacaaagttggtgggaacagatactttaccttcttaaacaggagtttaggagcagtgggtccccatcttttggactagctcttaacgttacttttccccgctgtagtgtagcacagccactccccttcactgggggacctcaatgagttggtcagctctcttggccttacatgtggcagttgttttcttgtttgcaggtgcggccgggtgtgtggcaacattacttcatgatgcagccatgaaccctgcggaaggctgatctgctgacttggggctctgaatctggatactctccatcaccggttggctgctgtcaccatttccttcctcgttgatggcactactagtggtcaagcagaggatgcagatgtacaactcaccataccaccgggtgacagactgtgtacgggcagtgtggcaaaatgaaggggccggggccttttaccgcagctacaccacccagctgaccatgaacgttcctttccaagccattcacttcatgacctatgaattcctgcaggagcactttaacccccagagacggtacaacccaagctcccacgtcctctctggagcttgcgcaggagctgtagctgccgcagccacaaccccactggacgtttgcaaaacactgctcaacacccaggagtccttggctttgaactcacacattacaggacatatcacaggcatggctagtgccttcaggacggtatatcaagtaggtggggtgaccgcctatttccgaggggtgcaggccagagtaatttaccagatcccctccacagccatcgcatggtctgtgtatgagttcttcaaatacctaatcactaaaaggcaagaagagtggagggctggcaagtgaagtagcactgaacgaagccaggggttcagatgacactgctgcatcctggtcacattctctgtctcctggaatgctcccacctcaagtggagttagaaggaaggtagaggggctctcccccaggattttggtgttttgactaacaccagttcctgccaacctctgttgccaccacctttccttccaggccctaagcacgtgcagcaaagcacaccacagcacctttgataacctctctccatcctgggcctgatgacctgctctagactgttatagagggataagcagctcattcccctggttcctaataaaaagcctttaaattaaa

SEQ ID NO: 456211 - DNA, 1422 bp, Homo sapiens
cgacgtggtgcgggccaatggccgcggtcaaagtatcaagagtggttgagcctatcaaagttcagccttaagtttctcccgcccttctaaaagtcagaggcgggttgatcgcacatgtcggccaatcagtgaccaataaacaagaagcttctaagatcaaaggggaaaaggtgggatgtaggcgctagcaacgcctcagggcggaggaatgacaggcgacttcgctaatactaccggctgatttttcgtacgtaaacccggatgcagagtctacagcctgacccagctgcccgctatcgcaatgtgttggaggccctctggaggattataagaacggagggcctatggaggcccatgagggggctgaacgtcacagcaacaggcgcagggcctgcccacgccctttattttgcctgctacgaaaagttaaaaaagacattgagtgatgtaatccaccctgggggcaatagccatattgccaatggctgatctgctgacttggggctctgaatctggatactctccatcaccggttggctgctgtcaccatttccttcctcgttgatggcactactagtggtcaagcagaggatgcagatgtacaactcaccataccaccgggtgacagactgtgtacgggcagtgtggcaaaatgaaggggccggggccttttaccgcagctacaccacccagctgaccatgaacgttcctttccaagccattcacttcatgacctatgaattcctgcaggagcactttaacccccagagacggtacaacccaagctcccacgtcctctctggagcttgcgcaggagctgtagctgccgcagccacaaccccactggacgtttgcaaaacactgctcaacacccaggagtccttggctttgaactcacacattacaggacatatcacaggcatggctagtgccttcaggacggtatatcaagtaggtggggtgaccgcctatttccgaggggtgcaggccagagtaatttaccagatcccctccacagccatcgcatggtctgtgtatgagttcttcaaatacctaatcactaaaaggcaagaagagtggagggctggcaagtgaagtagcactgaacgaagccaggggttcagatgacactgctgcatcctggtcacattctctgtctcctggaatgctcccacctcaagtggagttagaaggaaggtagaggggctctcccccaggattttggtgttttgactaacaccagttcctgccaacctctgttgccaccacctttccttccaggccctaagcacgtgcagcaaagcacaccacagcacctttgataacctctctccatcctgggcctgatgacctgctctagactgttatagagggataagcagctcattcccctggttcctaataaaaagcctttaaattaaa

SEQ ID NO: 456212 - DNA, 1488 bp, Homo sapiens
caagcgggagccggaggccccgggctctctgggccgcgcctgaggcggacactacggggccggggggcggcggcggcagtggtggcagcggcggcgggggtgggcgccgcagctggcccgggtggatggagttggaggggcggggtgctggcggtgtggcgggggggccggcggcagggcccgggcggagccccggggagtcggcgctgctggacgggtggctgcagcggggcgtgggccggggggccggcggcggggaggccggggcctgcaggcccccggtacgacaagatccggactccggcccggactacgaggcgctgccggctggagccactgtcaccacgcacatggtggcaggcgccgtggcagggatcctggagcactgcgtgatgtaccccatcgactgcgtcaagacccggatgcagagtctacagcctgacccagctgcccgctatcgcaatgtgttggaggccctctggaggattataagaacggagggcctatggaggcccatgagggggctgaacgtcacagcaacaggcgcagggcctgcccacgccctttattttgcctgctacgaaaagtgcggccgggtgtgtggcaacattacttcatgatgcagccatgaaccctgcggaagtggtcaagcagaggatgcagatgtacaactcaccataccaccgggtgacagactgtgtacgggcagtgtggcaaaatgaaggggccggggccttttaccgcagctacaccacccagctgaccatgaacgttcctttccaagccattcacttcatgacctatgaattcctgcaggagcactttaacccccagagacggtacaacccaagctcccacgtcctctctggagcttgcgcaggagctgtagctgccgcagccacaaccccactggacgtttgcaaaacactgctcaacacccaggagtccttggctttgaactcacacattacaggacatatcacaggcatggctagtgccttcaggacggtatatcaagtaggtggggtgaccgcctatttccgaggggtgcaggccagagtaatttaccagatcccctccacagccatcgcatggtctgtgtatgagttcttcaaatacctaatcactaaaaggcaagaagagtggagggctggcaagtgaagtagcactgaacgaagccaggggttcagatgacactgctgcatcctggtcacattctctgtctcctggaatgctcccacctcaagtggagttagaaggaaggtagaggggctctcccccaggattttggtgttttgactaacaccagttcctgccaacctctgttgccaccacctttccttccaggccctaagcacgtgcagcaaagcacaccacagcacctttgataacctctctccatcctgggcctgatgacctgctctagactgttatagagggataagcagctcattcccctggttcctaataaaaagcctttaaattaaa

SEQ ID NO: 456213 - DNA, 2750 bp, Homo sapiens
cgacgtggtgcgggccaatggccgcggtcaaagtatcaagagtggttgagcctatcaaagttcagccttaagtttctcccgcccttctaaaagtcagaggcgggttgatcgcacatgtcggccaatcagtgaccaataaacaagaagcttctaagatcaaaggggaaaaggtgggatgtaggcgctagcaacgcctcagggcggaggaatgacaggcgacttcgctaatactaccggctgatttttcgtacgtaaacccggatgcagagtctacagcctgacccagctgcccgctatcgcaatgtgttggaggccctctggaggattataagaacggagggcctatggaggcccatgagggggctgaacgtcacagcaacaggcgcagggcctgcccacgccctttattttgcctgctacgaaaagtattgagccttcctgtgctggttcccccactttcccaactctttgggctttgctgctgtcagtgctttccagtctcagcatggtttggagctgaagctttgggctgggataggccagattataagggagggacttccaaacctgatgttctcagacaacgggccgcttcaaccctgccttttcctttggggcacctcaacaaagggttacagtatcctcccttacctaccagcttgacttgttcctctcatctccctggcatcaacttctaatgccctggtaatgtggagacacactgaactacccccagtctatgtttgacagttgggtggtgtcctgctccttagggcaggattggaggcgacccagccagccacccaaggaagatactaatgaagcccctgctttttgcctcaccttttcaggatcccaactcaccagaggcagtttgtgttgagaacatgacaaagcctcatgacaaaatgaatgggggtggggccaaggaactgcatgaagaaaccagaaggttgtgtggaagtaagagaaaggatagcagcctagggctttaggaccggctggaaaccaagttgagtgtggagaggatgaggggtagagtagttcaggacctgaacgaaagatctttgtagacaaatgttaggctctgcaaatgggttctgcggcaggactgaggtgggattctgtggtgaggttctgtgagatctgaccacctggcccccgtatctccctccactggtggcaggtgatgtgctggcatccctaggcagcagtgtatctgcttcctgtctggggtgtgagctgcatttattctcagaatgatctttattgataagacttgagctggccttcctatcatggatgtggaatacattagtgaccttacaaagttggtgggaacagatactttaccttcttaaacaggagtttaggagcagtgggtccccatcttttggactagctcttaacgttacttttccccgctgtagtgtagcacagccactccccttcactgggggacctcaatgagttggtcagctctcttggccttacatgtggcagttgttttcttgtttgcaggtgcggccgggtgtgtggcaacattacttcatgatgcagccatgaaccctgcggaagtggtcaagcagaggatgcagatgtacaactcaccataccaccgggtgacagactgtgtacgggcagtgtggcaaaatgaaggggccggggccttttaccgcagctacaccacccagctgaccatgaacgttcctttccaagccattcacttcatgacctatgaattcctgcaggagcactttaacccccagagacggtacaacccaagctcccacgtcctctctggagcttgcgcaggagctgtagctgccgcagccacaaccccactggacgtttgcaaaacactgctcaacacccaggagtccttggctttgaactcacacattacaggacatatcacaggcatggctagtgccttcaggacggtatatcaagtaggtggggtgaccgcctatttccgaggggtgcaggccagagtaatttaccagatcccctccacagccatcgcatggtctgtgtatgagttcttcaaatacctaatcactaaaaggcaagaagagtggagggctggcaagtgaagtagcactgaacgaagccaggggttcagatgacactgctgcatcctggtcacattctctgtctcctggaatgctcccacctcaagtggagttagaaggaaggtagaggggctctcccccaggattttggtgttttgactaacaccagttcctgccaacctctgttgccaccacctttccttccaggccctaagcacgtgcagcaaagcacaccacagcacctttgataacctctctccatcctgggcctgatgacctgctctagactgttatagagggataagcagctcattcccctggttcctaataaaaagcctttaaattaaacaaacaaaacaaaaaaaaaaaaaaaaaaaaaaaaaagggggggggcggcccaaaaattcccccgggggggcccaaagttgtaggcggtaccccagttttctgtgtgtcccagaggggggccccatatagggagcgcgtaattaataggcatgggcaaggggccgggacgttttacacaacggcggggaagggggaaaacggtggcacccgcggggaaactgggggaagggaaccctaaactcggggggggggacacaagtggggccaatctccacaaggaagatttagaggccaaaggggacactagacactcaacgggtaaacggg

SEQ ID NO: 456214 - DNA, 1464 bp, Homo sapiens
  misc_feature (454)..(454): n is a, c, g, or t
gcctttcttattggaatgaagctagttgggataggaatgaaaggttaaatcatagaactcagtccctgcatttctgctgggatcttggcttttcagtcggaggaaaattctccaaaaacattctccatgtgaggatgagcaaatatgaagggatagcattgttgccacgttcattttctgtctgggcaaggccatggggtggaaagagccaaagctaagctgaagctccacagagctcacaccatgttatctacttgagggagtgggaggtgtttgaagactaaagccaactctttttggctaagaatcttttctttggtagaacttctgtctcctcccctctaggaggatcaccatctcacattttaaaagttaggtgctctttgtatgcgaggattgggattgttaggggcctgtgttcgtgatgatcactatcatggagtcatttcttgtngggaatagttagagggtaagatcagagataggtacttagttcaagaagactctctgaagctcccaaactgtagatatgtcctgtgtgcgaactggctggctttacagaagtcctgatggaagtgggtttattgttttttgactcgttaccaaccctctgcttactccttcccctcaaaaaagggaagctgacttctcaggttagccagcagctcactcatacttttttctctctctattccattggctgatctgctgacttggggctctgaatctggatactctccatcaccggttggctgctgtcaccatttccttcctcgttgatggcactactagtggtcaagcagaggatgcagatgtacaactcaccataccaccgggtgacagactgtgtacgggcagtgtggcaaaatgaaggggccggggccttttaccgcagctacaccacccagctgaccatgaacgttcctttccaagccattcacttcatgacctatgaattcctgcaggagcactttaacccccagagacggtacaacccaagctcccacgtcctctctggagcttgcgcaggagctgtagctgccgcagccacaaccccactggacgtttgcaaaacactgctcaacacccaggagtccttggctttgaactcacacattacaggacatatcacaggcatggctagtgccttcaggacggtatatcaagtaggtggggtgaccgcctatttccgaggggtgcaggccagagtaatttaccagatcccctccacagccatcgcatggtctgtgtatgagttcttcaaatacctaatcactaaaaggcaagaagagtggagggctggcaagtgaagtagcactgaacgaagccaggggttcagatgacactgctgcatcctggtcacattctctctctccatcctgggcctgatgacctgctctagactgttatagagggataagcagctcattcccctggttcctaataaaaagcctttaaattaaa

SEQ ID NO: 456215 - DNA, 2207 bp, Homo sapiens
cgacgtggtgcgggccaatggccgcggtcaaagtatcaagagtggttgagcctatcaaagttcagccttaagtttctcccgcccttctaaaagtcagaggcgggttgatcgcacatgtcggccaatcagtgaccaataaacaagaagcttctaagatcaaaggggaaaaggtgggatgtaggcgctagcaacgcctcagggcggaggaatgacaggcgacttcgctaatactaccggctgatttttcgtacgtaaacccggatgcagagtctacagcctgacccagctgcccgctatcgcaatgtgttggaggccctctggaggattataagaacggagggcctatggaggcccatgagggggctgaacgtcacagcaacaggcgcagggcctgcccacgccctttattttgcctgctacgaaaagtattgagccttcctgtgctggttcccccactttcccaactctttgggctttgctgctgtcagtgctttccagtctcagcatggtttggagctgaagctttgggctgggataggccagattataagggagggacttccaaacctgatgttctcagacaacgggccgcttcaaccctgccttttcctttggggcacctcaacaaagggttacagtatcctcccttacctaccagcttgacttgttcctctcatctccctggcatcaacttctaatgccctggtaatgtggagacacactgaactacccccagtctatgtttgacagttgggtggtgtcctgctccttagggcaggattggaggcgacccagccagccacccaaggaagatactaatgaagcccctgctttttgcctcaccttttcaggatcccaactcaccagaggcagtttgtgttgagaacatgacaaagcctcatgacaaaatgaatgggggtggggccaaggaactgcatgaagaaaccagaaggttgtgtggaagtaagagaaaggatagcagcctagggctttaggaccggctggaaaccaagttgagtgtggagaggatgaggggtagagtagttcaggacctgaacgaaagatctttgtagacaaatgttaggctctgcaaatgggttctgcggcaggactgaggtgggattctgtggtgaggttctgtgagatctgaccacctggcccccgtatctccctccactggtggcaggtgatgtgctggcatccctaggcagcagtgtatctgcttcctgtctggggtgtgagctgcatttattctcagaatgatctttattgataagacttgagctggccttcctatcatggatgtggaatacattagtgaccttacaaagttggtgggaacagatactttaccttcttaaacaggagtttaggagcagtgggtccccatcttttggactagctcttaacgttacttttccccgctgtagtgtagcacagccactccccttcactgggggacctcaatgagttggtcagctctcttggccttacatgtggcagttgttttcttgtttgcaggtgcggccgggtgtgtggcaacattacttcatgatgcagccatgaaccctgcggaagtggtcaagcagaggatgcagatgtacaactcaccataccaccgggtgacagactgtgtacgggcagtgtggcaaaatgaaggggccggggccttttaccgcagctacaccacccagctgaccatgaacgttcctttccaagccattcacttcatgacctatgaattcctgcaggagcactttaacccccagagacggtacaacccaagctcccacgtcctctctggagcttgcgcaggagctgtagctgccgcagccacaaccccactggacgtttgcaaaacactgctcaacacccaggagtccttggctttgaactcacacattacaggacatatcacaggcatggctagtgccttcaggacggtatatcaagtaggtggggtgaccgcctatttccgaggggtgcaggccagagtaatttaccagatcccctccacagccatcgcatggtctgtgtatgagttcttcaaatacctttccttccaggccctaagcacgtgcagcaaagcacaccacagcacctttgataacctctctccatcctgggcctgatgacctgctctagactgttatagagggataagcagctcattcccctggttcctaataaaaagcctttaaattaaa

SEQ ID NO: 456216 - DNA, 2009 bp, Homo sapiens
caagcgggagccggaggccccgggctctctgggccgcgcctgaggcggacactacggggccggggggcggcggcggcagtggtggcagcggcggcgggggtgggcgccgcagctggcccgggtggatggagttggaggggcggggtgctggcggtgtggcgggggggccggcggcagggcccgggcggagccccggggagtcggcgctgctggacgggtggctgcagcggggcgtgggccggggggccggcggcggggaggccggggcctgcaggcccccggtacgacaagatccggactccggcccggactacgaggcgctgccggctggagccactgtcaccacgcacatggtggcaggcgccgtggcagggatcctggagcactgcgtgatgtaccccatcgactgcgtcaagacccggatgcagagtctacagcctgacccagctgcccgctatcgcaatgtgttggaggccctctggaggattataagaacggagggcctatggaggcccatgagggggctgaacgtcacagcaacaggcgcagggcctgcccacgccctttattttgcctgctacgaaaagttaaaaaagacattgagtgatgtaatccaccctgggggcaatagccatattgccaatggtattgagccttcctgtgctggttcccccactttcccaactctttgggctttgctgctgtcagtgctttccagtctcagcatggtttggagctgaagctttgggctgggataggccagtggtggcaggtgatgtgctggcatccctaggcagcagtgtatctgcttcctgtctggggtgtgagctgcatttattctcagaatgatctttattgataagacttgagctggccttcctatcatggatgtggaatacattagtgaccttacaaagttggtgggaacagatactttaccttcttaaacaggagtttaggagcagtgggtccccatcttttggactagctcttaacgttacttttccccgctgtagtgtagcacagccactccccttcactgggggacctcaatgagttggtcagctctcttggccttacatgtggcagttgttttcttgtttgcaggtgcggccgggtgtgtggcaacattacttcatgatgcagccatgaaccctgcggaagtggtcaagcagaggatgcagatgtacaactcaccataccaccgggtgacagactgtgtacgggcagtgtggcaaaatgaaggggccggggccttttaccgcagctacaccacccagctgaccatgaacgttcctttccaagccattcacttcatgacctatgaattcctgcaggagcactttaacccccagagacggtacaacccaagctcccacgtcctctctggagcttgcgcaggagctgtagctgccgcagccacaaccccactggacgtttgcaaaacactgctcaacacccaggagtccttggctttgaactcacacattacaggacatatcacaggcatggctagtgccttcaggacggtatatcaagtaggtggggtgaccgcctatttccgaggggtgcaggccagagtaatttaccagatcccctccacagccatcgcatggtctgtgtatgagttcttcaaatacctaatcactaaaaggcaagaagagtggagggctggcaagtgaagtagcactgaacgaagccaggggttcagatgacactgctgcatcctggtcacattctctgtctcctggaatgctcccacctcaagtggagttagaaggaaggtagaggggctctcccccaggattttggtgttttgactaacaccagttcctgccaacctctgttgccaccacctttccttccaggccctaagcacgtgcagcaaagcacaccacagcacctttgataacctctctccatcctgggcctgatgacctgctctagactgttatagagggataagcagctcattcccctggttcctaataaaaagcctttaaattaaa

SEQ ID NO: 456217 - DNA, 1089 bp, Homo sapiens
caagcgggagccggaggccccgggctctctgggccgcgcctgaggcggacactacggggccggggggcggcggcggcagtggtggcagcggcggcgggggtgggcgccgcagctggcccgggtggatggagttggaggggcggggtgctggcggtgtggcgggggggccggcggcagggcccgggcggagccccggggagtcggcgctgctggacgggtggctgcagcggggcgtgggccggggggccggcggcggggaggccggggcctgcaggcccccggtacgacaagatccggactccggcccggactacgaggcgctgccggctggagccactgtcaccacgcacatggtggcaggcgccgtggcagggatcctggagcactgcgtgatgtaccccatcgactgcgtcaaggtgagacctgcacccggcttcgaacccgacctggggctgacccgacccctgggtcttgtccggagccaggatcccggctgagagccggagccgacatgggttccttcctggctcctgccactaccacatgattcgaaccgacactccattcaagcaaggtcctcagctgggagttgatcccagtcaggaaccaggacctatttctaaccgtcagtgaaatctgaatcgggactcaggatcgaaaatctgtcagccaaagccctggaccccacctgggactaaacaggaatagggtgggatggggtatcccgaagctcaggtaagtgctactaactcgattaaggtgaagccaactggcgtgaaccagaccctgaaatggatctaacggcttgagatgttttctgggctagtgcttttacaaactccttgctgtatcttcccttactgacggggcaggaacccgaatctgggatctctcagctagataaaggacttacatgttaaatcttaacacatgagtgactggaaatcattgtgcagtgagaatgcagaattccagactggaagtaatgtgggaaagatcgtattcaggaataggtttcagtttctctgtgaagcaagcatgataccccacctatttcctgaacatgaaattgagctgggattaggactg

SEQ ID NO: 456218 - DNA, 1386 bp, Homo sapiens
cgacgtggtgcgggccaatggccgcggtcaaagtatcaagagtggttgagcctatcaaagttcagccttaagtttctcccgcccttctaaaagtcagaggcgggttgatcgcacatgtcggccaatcagtgaccaataaacaagaagcttctaagatcaaaggggaaaaggtgggatgtaggcgctagcaacgcctcagggcggaggaatgacaggcgacttcgctaatactaccggctgatttttcgtacgtaaacccggatgcagagtctacagcctgacccagctgcccgctatcgcaatgtgttggaggccctctggaggattataagaacggagggcctatggaggcccatgagggggctgaacgtcacagcaacaggcgcagggcctgcccacgccctttattttgcctgctacgaaaagttaaaaaagacattgagtgatgtaatccaccctgggggcaatagccatattgccaatggtgcggccgggtgtgtggcaacattacttcatgatgcagccatgaaccctgcggaagtggtcaagcagaggatgcagatgtacaactcaccataccaccgggtgacagactgtgtacgggcagtgtggcaaaatgaaggggccggggccttttaccgcagctacaccacccagctgaccatgaacgttcctttccaagccattcacttcatgacctatgaattcctgcaggagcactttaacccccagagacggtacaacccaagctcccacgtcctctctggagcttgcgcaggagctgtagctgccgcagccacaaccccactggacgtttgcaaaacactgctcaacacccaggagtccttggctttgaactcacacattacaggacatatcacaggcatggctagtgccttcaggacggtatatcaagtaggtggggtgaccgcctatttccgaggggtgcaggccagagtaatttaccagatcccctccacagccatcgcatggtctgtgtatgagttcttcaaatacctaatcactaaaaggcaagaagagtggagggctggcaagtgaagtagcactgaacgaagccaggggttcagatgacactgctgcatcctggtcacattctctgtctcctggaatgctcccacctcaagtggagttagaaggaaggtagaggggctctcccccaggattttggtgttttgactaacaccagttcctgccaacctctgttgccaccacctttccttccaggccctaagcacgtgcagcaaagcacaccacagcacctttgataacctctctccatcctgggcctgatgacctgctctagactgttatagagggataagcagctcattcccctggttcctaataaaaagcctttaaattaaa

SEQ ID NO: 456219 - DNA, 1034 bp, Homo sapiens
tgaacgaagccaggtgttcagatgacactgctgcatcctggtcacattctactgtcttctggaatgctcccacctcaatgagttggtcagctctcttggccttacatgtggcagttgttttcttgtttgcaggtgcggccgggtgtgtggcaacattacttcatgatgcagccatgaaccctgcggaagtggtcaagcagaggatgcagatgtacaactcaccataccaccgggtgacagactgtgtacgggcagtgtggcaaaatgaaggggccggggccttttaccgcagctacaccacccagctgaccatgaacgttcctttccaagccattcacttcatgacctatgaattcctgcaggagcactttaacccccagagacggtacaacccaagctcccacgtcctctctggagcttgcgcaggagctgtagctgccgcagccacaaccccactggacgtttgcaaaacactgctcaacacccaggagtccttggctttgaactcacacattacaggacatatcacaggcatggctagtgccttcaggacggtatatcaagtaggtggggtgaccgcctatttccgaggggtgcaggccagagtaatttaccagatcccctccacagccatcgcatggtctgtgtatgagttcttcaaatacctaatcactaaaaggcaagaagagtggagggctggcaagtgaagtagcactgaacgaagccaggggttcagatgacactgctgcatcctggtcacattctctgtctcctggaatgctcccacctcaagtggagttagaaggaaggtagaggggctctcccccaggattttggtgttttgactaacaccagttcctgccaacctctgttgccaccacctttccttccaggccctaagcacgtgcagcaaagcacaccacagcacctttgataacctctctccatcctgggcctgatgacctgctctagactgttatagagggataagcagctcattcccctggttcctaataaaaagcctttaaattaaa

SEQ ID NO: 456220 - DNA, 2585 bp, Homo sapiens
  misc_feature (2520)..(2520): n is a, c, g, or t
cgacgtggtgcgggccaatggccgcggtcaaagtatcaagagtggttgagcctatcaaagttcagccttaagtttctcccgcccttctaaaagtcagaggcgggttgatcgcacatgtcggccaatcagtgaccaataaacaagaagcttctaagatcaaaggggaaaaggtgggatgtaggcgctagcaacgcctcagggcggaggaatgacaggcgacttcgctaatactaccggctgatttttcgtacgtaaacccggatgcagagtctacagcctgacccagctgcccgctatcgcaatgtgttggaggccctctggaggattataagaacggagggcctatggaggcccatgagggggctgaacgtcacagcaacaggcgcagggcctgcccacgccctttattttgcctgctacgaaaagtattgagccttcctgtgctggttcccccactttcccaactctttgggctttgctgctgtcagtgctttccagtctcagcatggtttggagctgaagctttgggctgggataggccagattataagggagggacttccaaacctgatgttctcagacaacgggccgcttcaaccctgccttttcctttggggcacctcaacaaagggttacagtatcctcccttacctaccagcttgacttgttcctctcatctccctggcatcaacttctaatgccctggtaatgtggagacacactgaactacccccagtctatgtttgacagttgggtggtgtcctgctccttagggcaggattggaggcgacccagccagccacccaaggaagatactaatgaagcccctgctttttgcctcaccttttcaggatcccaactcaccagaggcagtttgtgttgagaacatgacaaagcctcatgacaaaatgaatgggggtggggccaaggaactgcatgaagaaaccagaaggttgtgtggaagtaagagaaaggatagcagcctagggctttaggaccggctggaaaccaagttgagtgtggagaggatgaggggtagagtagttcaggacctgaacgaaagatctttgtagacaaatgttaggctctgcaaatgggttctgcggcaggactgaggtgggattctgtggtgaggttctgtgagatctgaccacctggcccccgtatctccctccactggtggcaggtgatgtgctggcatccctaggcagcagtgtatctgcttcctgtctggggtgtgagctgcatttattctcagaatgatctttattgataagacttgagctggccttcctatcatggatgtggaatacattagtgaccttacaaagttggtgggaacagatactttaccttcttaaacaggagtttaggagcagtgggtccccatcttttggactagctcttaacgttacttttccccgctgtagtgtagcacagccactccccttcactgggggacctcaatgagttggtcagctctcttggccttacatgtggcagttgttttcttgtttgcaggtgcggccgggtgtgtggcaacattacttcatgatgcagccatgaaccctgcggaagtggtcaagcagaggatgcagatgtacaactcaccataccaccgggtgacagactgtgtacgggcagtgtggcaaaatgaaggggccggggccttttaccgcagctacaccacccagctgaccatgaacgttcctttccaagccattcacttcatgacctatgaattcctgcaggagcactttaacccccagagacggtacaacccaagctcccacgtcctctctggagcttgcgcaggagctgtagctgccgcagccacaaccccactggacgtttgcaaaacactgctcaacacccaggagtccttggctttgaactcacacattacaggacatatcacaggcatggctagtgccttcaggacggtatatcaagtaggtggggtgaccgcctatttccgaggggtgcaggccagagtaatttaccagatcccctccacagccatcgcatggtctgtgtatgagttcttcaaatacctaatcactaaaaggcaagaagagtggagggctggcaagtgaagtagcactgaacgaagccaggggttcagatgacactgctgcatcctggtcacattctctgtctcctggaatgctcccacctcaagtggagttagaaggaaggtagaggggctctcccccaggattttggtgttttgactaacaccagttcctgccaacctctgttgccaccacctttccttccaggccctaagcacgtgcagcaaagcacaccacagcacctttgataacctctctccatcctgggcctgatgacctgctctagactgttatagagggataagcagctcattcccctggttcctaataaaaagcctttaaattaaaaaaaaaaaaaaaaaaaaaactcgagactagctcgtgccgaattcggcacgagattctgcacaccgagctgaacctgcatgagcttgaaagcgatganagagagcccacagagtctacccaacagcttaacaagcctgaggtcttggaggtgaccctgaaccc

SEQ ID NO: 456221 - DNA, 2403 bp, Homo sapiens
cgacgtggtgcgggccaatggccgcggtcaaagtatcaagagtggttgagcctatcaaagttcagccttaagtttctcccgcccttctaaaagtcagaggcgggttgatcgcacatgtcggccaatcagtgaccaataaacaagaagcttctaagatcaaaggggaaaaggtgggatgtaggcgctagcaacgcctcagggcggaggaatgacaggcgacttcgctaatactaccggctgatttttcgtacgtaaacccggatgcagagtctacagcctgacccagctgcccgctatcgcaatgtgttggaggccctctggaggattataagaacggagggcctatggaggcccatgagggggctgaacgtcacagcaacaggcgcagggcctgcccacgccctttattttgcctgctacgaaaagtattgagccttcctgtgctggttcccccactttcccaactctttgggctttgctgctgtcagtgctttccagtctcagcatggtttggagctgaagctttgggctgggataggccagattataagggagggacttccaaacctgatgttctcagacaacgggccgcttcaaccctgccttttcctttggggcacctcaacaaagggttacagtatcctcccttacctaccagcttgacttgttcctctcatctccctggcatcaacttctaatgccctggtaatgtggagacacactgaactacccccagtctatgtttgacagttgggtggtgtcctgctccttagggcaggattggaggcgacccagccagccacccaaggaagatactaatgaagcccctgctttttgcctcaccttttcaggatcccaactcaccagaggcagtttgtgttgagaacatgacaaagcctcatgacaaaatgaatgggggtggggccaaggaactgcatgaagaaaccagaaggttgtgtggaagtaagagaaaggatagcagcctagggctttaggaccggctggaaaccaagttgagtgtggagaggatgaggggtagagtagttcaggacctgaacgaaagatctttgtagacaaatgttaggctctgcaaatgggttctgcggcaggactgaggtgggattctgtggtgaggttctgtgagatctgaccacctggcccccgtatctccctccactggtggcaggtgatgtgctggcatccctaggcagcagtgtatctgcttcctgtctggggtgtgagctgcatttattctcagaatgatctttattgataagacttgagctggccttcctatcatggatgtggaatacattagtgaccttacaaagttggtgggaacagatactttaccttcttaaacaggagtttaggagcagtgggtccccatcttttggactagctcttaacgttacttttccccgctgtagtgtagcacagccactccccttcactgggggacctcaatgagttggtcagctctcttggccttacatgtggcagttgttttcttgtttgcaggtgcggccgggtgtgtggcaacattacttcatgatgcagccatgaaccctgcggaagtggtcaagcagaggatgcagatgtacaactcaccataccaccgggtgacagactgtgtacgggcagtgtggcaaaatgaaggggccggggccttttaccgcagctacaccacccagctgaccatgaacgttcctttccaagccattcacttcatgacctatgaattcctgcaggagcactttaacccccagagacggtacaacccaagctcccacgtcctctctggagcttgcgcaggagctgtagctgccgcagccacaaccccactggacgtttgcaaaacactgctcaacacccaggagtccttggctttgaactcacacattacaggacatatcacaggcatggctagtgccttcaggacggtatatcaagtaggtggggtgaccgcctatttccgaggggtgcaggccagagtaatttaccagatcccctccacagccatcgcatggtctgtgtatgagttcttcaaatacctaatcactaaaaggcaagaagagtggagggctggcaagtgaagtagcactgaacgaagccaggggttcagatgacactgctgcatcctggtcacattctctgtctcctggaatgctcccacctcaagtgcctagaaggcatgatagaagggttttgtgtgagcattcaggcagtttcgagcctcgcagatcttgtcagccttggaagacaccgcctgtcttttcgggccgtcaggtcgcgcagcggagcaggccaaggccagtgcgatagcctatgtccataagggggctcgtgcggtcatctagcagtggtatagaggaataagcggctcggtactctcgttccaga

SEQ ID NO: 456222 - DNA, 1416 bp, Homo sapiens
  misc_feature (454)..(454): n is a, c, g, or t
gcctttcttattggaatgaagctagttgggataggaatgaaaggttaaatcatagaactcagtccctgcatttctgctgggatcttggcttttcagtcggaggaaaattctccaaaaacattctccatgtgaggatgagcaaatatgaagggatagcattgttgccacgttcattttctgtctgggcaaggccatggggtggaaagagccaaagctaagctgaagctccacagagctcacaccatgttatctacttgagggagtgggaggtgtttgaagactaaagccaactctttttggctaagaatcttttctttggtagaacttctgtctcctcccctctaggaggatcaccatctcacattttaaaagttaggtgctctttgtatgcgaggattgggattgttaggggcctgtgttcgtgatgatcactatcatggagtcatttcttgtngggaatagttagagggtaagatcagagataggtacttagttcaagaagactctctgaagctcccaaactgtagatatgtcctgtgtgcgaactggctggctttacagaagtcctgatggaagtgggtttattgttttttgactcgttaccaaccctctgcttactccttcccctcaaaaaagggaagctgacttctcaggttagccagcagctcactcatacttttttctctctctattccattggctgatctgctgacttggggctctgaatctggatactctccatcaccggttggctgctgtcaccatttccttcctcgttgatggcactactagtggtcaagcagaggatgcagatgtacaactcaccataccaccgggtgacagactgtgtacgggcagtgtggcaaaatgaaggggccggggccttttaccgcagctacaccacccagctgaccatgaacgttcctttccaagccattcacttcatgacctatgaattcctgcaggagcactttaacccccagagacggtacaacccaagctcccacgtcctctctggagcttgcgcaggagctgtagctgccgcagccacaaccccactggacgtttgcaaaacactgctcaacacccaggagtccttggctttgaactcacacattacaggacatatcacaggcatggctagtgccttcaggacggtatatcaagtaggtggggtgaccgcctatttccgaggggtgcaggccagagtaatttaccagatcccctccacagccatcgcatggtctgtgtatgagttcttcaaatacctaatcactaaaaggcaagaagagtggagggctggcaagtgaagtagcactgaacgaagccaggggttcagatgacactgctctagactgttatagagggataagcagctcattcccctggttcctaataaaaagcctttaaattaaa

SEQ ID NO: 456223 - DNA, 4136 bp, Homo sapiens
cagagcacagaacattttttcagactgaacagactgttggaccagcctgtcatgatatgttttagataaagtttgagtgagttcattgggataaatggtccacaatcttaaacagaatactgtgagccaatgccttttggaagtaatggtggaggataatatgattaaagggaacatgcttgtgtttatttttgttggtagtatatgattagaaaaactagataattcccataagatgaagatcttccatgaacaaactaccatcaatcatccatcagattgattttttttttttttataagtaacactaaagaagctgtaaagaacattgaaggtggtcattccttcaaaactgtgttttgaccacacaaggtgggcattaacaaaccaaatttcaacttaagtctgtttgtattatattgggggtgctgcgagactggagattttataaaagcaagcatttttatttccatttataatttctattcaatattgctagatatattaacatgaaggaatggggaagcttatttcaatcaaagctaaaattttcagaagtctgtaaaaatggaaaaacaccattgaaagaggcagaaacaggtaagggggatagtatcttagaaaacctgttggttaaggcagctgcatgtgataaaagtggtacttgaacttggtagtgtttccttagaacctcctccaaaaatatgcatttaccaggcttgttacaattttttgacagtttttcatcaactgtcaaaaacttcaacccttttaaaacctagatataaatgcttacatgtaaagaaaggaagctaagcagtgggtacctgggatctctctgaactatttttataacttcttgtgagtcttaagtatttcaaaataaaagtggttttaaagtaaattcatagattaaatgtatcattatctatatataaaccatgatttaaaactttaattttctaaacatagtattcaacttagttgaataaatatatgatagaagttaaatagaatttttatttcattcttaagaaaaactcatgtttgtaacaaatgatatctaaagatctattttgccttaccagaaaagaaaaaaaaaaccctaaaaccaaaaactccttttccctaggaagtcaaaaatgctgtgatttaaaatatctaattatatttttttctttctatggtagtggggtttacttctgaggataaaatattttgaaaaagctctgtcccttgacatggtagttctcccgtgccttgtacttgttctctctccatatgcacagtgtgacaagatgctcacctttaatgaagaaggtgtagcttttcgttttaagctgtaattgtctttgtcttgatttggctatttttataactgaaatcctgagcaacagagataatttgggtggtaatgatcatcttttgtatatgttcttgatgttaagaaatattttttgctgccattcagctttgtggaatttatgtttacttttcaatattttcatatttcttaaccagattttaaagaaatttgttgttagttacgtgaaatcaaaggtcaggtcagtaagcccattatcctcaaacttgaagtttcgttggatgttcaaaatgctaatttttgcagagatataaggataaattagttttagtttgtgttcttaagggtttgcaaaataatttggctcccaaactcttgttggggtgtagtgtttgctaggagcccaggatacctgccctggacttaaattgtgattgaagtggagaggtactctaggaatttaaaaagacacaaaattatttttttccagactagtgtgccatggatttctgataagaattaacattcttgaacaaaggtatcagaaagggtaactcgagttgaaggtttgtgaatagaaggggaaatgtgatagaagattattcagaacaaaataagtagacaaaataacaaaagacaggaaaataagtctctttgtatccttattaatcatttgaaattatgctataatattttttaaaactcacctgtttggttctgggtgaagcagttcctgaaggagtgtttgtcagaatatattgttaggagaatagagggttctgtggccaagtaagtttgggaaatagtgggttagacaaagttgagttactgttggcctttcagacctttgatacgctaatgtgcattttaaatctccaagaagcacctctattttatacatcatttccctaatttattttaatatggatttcttgtttttgttttcttgagacggagtcttggtcttgtcacccaggctggagtgcagtggcacgatctcggctcactacaacctccgcctcccaggttcaagcgattctcctgcctcagcctcccaatttactgggattacaggcacctgccaccacgcccagctaatttttgtatttttagtagagatggggtttcaccatgttgaccaggctgattttgaactcctgacctcaggtgattctgcccgcctcaccctcccacagtgctggaattataggtatgagccactgtccccggccagatttttttaaaagtaggtatcttgtgggatttatgttctgagagatacacctaaggaaatgctgccctacagtgtttttgctagttcatactcattacaaaggtttcttgttgttgggtgcccctctagccagtggtagtaaaatgggaagagacaggtcaagactcccttggaccatggcattgagagagggatggctgtcggcatagatatgttggttatttaggcatttgtgagggaggcccctggctcttccagcctgtttccttaggatcccagttggccgggaacagctgtacaagggtctgctgaactggtggtttcagcagactacccagttcctaagcatccatgagacagagggaaccaacttgtatttccagaacaattttccaaaccttttctggctgtactttaaaagtgccaaaaaggcaatgggtgtttatgacactaaagtcacatacaagctagtatgatacatacatcatagaaagcttatagttgctcagtgacaaagcaaaggaagtttaatattttccagttttgttcattaccgaagacagtctacggttcatagttttcactaaattctaagcagattctatatcctaaaacatttaaacctcactaggcctgcaattttgagagggttagctaaatatgtttggtatcacttcagagtctaaaaccagattactaatcgtgtgtaaggaggcattttgtgtgtctttgcaatgtatacaattggattatttggaacaccattttgaatgtgtatttgagagaaagctcgcctgtgggttttgagttgtggtgtaatggtgaacatgtagccacgtgaaaggccgttggatctttgttctgattcttcagtcgtcttcttgcaaattcagagaaatgtcttttaatcatttcgtttacatatcccagatccttggaaatcatgaaaaataacttgccagagtttgcatcagccctcagtaagtcatgaaccatagagaaggtcatggggccatttattctttggaccactggctacttctgaagttctggcttccttctctctaggaggagtcgtgtattcaagcttttaagttaaatgcataaaaatgagttttacttctcttctgacttgatttttaattttatgaaatgggaaataatgtttttccatttttctgttcattttgaagtgggaatttgaggtgtttgtaatgtcatgttactgttctgaaagattgacagtaaagaagacaagaaatatatgtatgtagtatgcatattagttttgtcccaccaagcctatctttgaatggcaaacattttaaaaacatctgttctagttgcacaactactctagcttctttataaagtaaacaatcttaaagtaagcaatgttggccataatttcaatattctagccttgccgagtgtgaatatattttactcagagactatgtacaaatacactaaagtggtgatggtgatcaatattgtaaagaatttattctgataaatgagaaactggatataatgtcaaaatagctattttctcaataaaaatctcaaatctcctga

SEQ ID NO: 456224 - DNA, 4443 bp, Homo sapiens
cagagcacagaacattttttcagactgaacagactgttggaccagcctgtcatgatatgttttagataaagtttgagtgagttcattgggataaatggtccacaatcttaaacagaatactgtgagccaatgccttttggaagtaatggtggaggataatatgattaaagggaacatgcttgtgtttatttttgttggtagtatatgattagaaaaactagataattcccataagatgaagatcttccatgaacaaactaccatcaatcatccatcagattgattttttttttttttataagtaacactaaagaagctgtaaagaacattgaaggtggtcattccttcaaaactgtgttttgaccacacaaggtgggcattaacaaaccaaatttcaacttaagtctgtttgtattatattgggggtgctgcgagactggagattttataaaagcaagcatttttatttccatttataatttctattcaatattgctagatatattaacatgaaggaatggggaagcttatttcaatcaaagctaaaattttcagaagtctgtaaaaatggaaaaacaccattgaaagaggcagaaacaggtaagggggatagtatcttagaaaacctgttggttaaggcagctgcatgtgataaaagtggtacttgaacttggtagtgtttccttagaacctcctccaaaaatatgcatttaccaggcttgttacaattttttgacagtttttcatcaactgtcaaaaacttcaacccttttaaaacctagatataaatgcttacatgtaaagaaaggaagctaagcagtgggtacctgggatctctctgaactatttttataacttcttgtgagtcttaagtatttcaaaataaaagtggttttaaagtaaattcatagattaaatgtatcattatctatatataaaccatgatttaaaactttaattttctaaacatagtattcaacttagttgaataaatatatgatagaagttaaatagaatttttatttcattcttaagaaaaactcatgtttgtaacaaatgatatctaaagatctattttgccttaccagaaaagaaaaaaaaaaccctaaaaccaaaaactccttttccctaggaagtcaaaaatgctgtgatttaaaatatctaattatatttttttctttctatggtagtggggtttacttctgaggataaaatattttgaaaaagctctgtcccttgacatggtagttctcccgtgccttgtacttgttctctctccatatgcacagtgtgacaagatgctcacctttaatgaagaaggtgtagcttttcgttttaagctgtaattgtctttgtcttgatttggctatttttataactgaaatcctgagcaacagagataatttgggtggtaatgatcatcttttgtatatgttcttgatgttaagaaatattttttgctgccattcagctttgtggaatttatgtttacttttcaatattttcatatttcttaaccagattttaaagaaatttgttgttagttacgtgaaatcaaaggtcaggtcagtaagcccattatcctcaaacttgaagtttcgttggatgttcaaaatgctaatttttgcagagatataaggataaattagttttagtttgtgttcttaagggtttgcaaaataatttggctcccaaactcttgttggggtgtagtgtttgctaggagcccaggatacctgccctggacttaaattgtgattgaagtggagaggtactctaggaatttaaaaagacacaaaattatttttttccagactagtgtgccatggatttctgataagaattaacattcttgaacaaaggtatcagaaagggtaactcgagttgaaggtttgtgaatagaaggggaaatgtgatagaagattattcagaacaaaataagtagacaaaataacaaaagacaggaaaataagtctctttgtatccttattaatcatttgaaattatgctataatattttttaaaactcacctgtttggttctgggtgaagcagttcctgaaggagtgtttgtcagaatatattgttaggagaatagagggttctgtggccaagtaagtttgggaaatagtgggttagacaaagttgagttactgttggcctttcagacctttgatacgctaatgtgcattttaaatctccaagaagcacctctattttatacatcatttccctaatttattttaatatggatttcttgtttttgttttcttgagacggagtcttggtcttgtcacccaggctggagtgcagtggcacgatctcggctcactacaacctccgcctcccaggttcaagcgattctcctgcctcagcctcccaatttactgggattacaggcacctgccaccacgcccagctaatttttgtatttttagtagagatggggtttcaccatgttgaccaggctgattttgaactcctgacctcaggtgattctgcccgcctcaccctcccacagtgctggaattataggtatgagccactgtccccggccagatttttttaaaagtaggtatcttgtgggatttatgttctgagagatacacctaaggaaatgctgccctacagtgtttttgctagttcatactcattacaaaggtttcttgttgttgggtgcccctctagccagtggtagtaaaatgggaagagacaggtcaagactcccttggaccatggcattgagagagggatggctgtcggcatagatatgttggttatttaggcatttgtgagggaggcccctggctcttccagcctgtttccttaggatcccagttggccgggaacagctgtacaagggtctgctgaactggtggtttcagcagactacccagttcctaagcatccatgagacagagggaaccaacttgtatttccagaacaattttccaaaccttttctggctgtactttaaaagtgccaaaaaggcaatgggtgtttatgacactaaagtcacatacaagctagtatgatacatacatcatagaaagcttatagttgctcagtgacaaagcaaaggaagtttaatattttccagttttgttcattaccgaagacagtctacggttcatagttttcactaaattctaagcagattctatatcctaaaacatttaaacctcactaggcctgcaattttgagagggttagctaaatatgtttggtatcacttcagagtctaaaaccagattactaatcgtgtgtaaggaggcattttgtgtgtctttgcaatgtatacaattggattatttggaacaccattttgaatgtgtatttgagagaaagctcgcctgtgggttttgagttgtggtgtaatggtgaacatgtagccacgtgaaaggccgttggatctttgttctgattcttcagtcgtcttcttgcaaattcagagaaatgtcttttaatcatttcgtttacatatcccagatccttggaaatcatgaaaaataacttgccagagtttgcatcagccctcagtaagtcatgaaccatagagaaggtcatggggccatttattctttggaccactggctacttctgaagttctggcttccttctctctaggaggagtcgtgtattcaagcttttaagttaaatgcataaaaatgagttttacttctcttctgacttgatttttaattttatgaaatgggaaataatgtttttccatttttctgttcattttgaagtgggaatttgaggtgtttgtaatgtcatgttactgttctgaaagattgacagtaaagaagacaagaaatatatgtatgtagtatgcatattagttttgtcccaccaagcctatctttgaatggcaaacattttaaaaacatctgttctagttgcacaactactctagcttctttataaagtaaacaatcttaaagtaagcaatgttggccataatttcaatattctagccttgccgagtgtgaatatattttactcagagactatgtacaaatacactaaagtggtgatggtgatcaatattgtaaagaatttattctgataaatgagaaactggatataatgtcaaaatagctattttctcaataaaaatctcaaatctcctgactgcttatgaattctcgatttaatgttatttattctttgaggtaaatcttttcatcgcgaagaattttttgctggttgaatgtggttgttcagggctgggactgagctatagacatagtgggtttttaaaaaatgtccattctttttttttttttttgagacagagttttgctcttatcacccaggctggagtgcaatggtgtgaactcggctcactgcaaccttcgccacctgggttcaagcaattctcctgccttagcctcccaagtagctgggattacaggcacctgccaccttacccggctaa

SEQ ID NO: 456225 - DNA, 441 bp, Homo sapiens
gagcggccgcccgggcaggtacttaatgtttttccatttttctgttcattttgaagtgggaatttgaggtgtttgtaatgtcatgttactgttctgaaagattgacagtaaagaagacaagaaatatatgtatgtagtatgcatattagttttgtcccaccaagcctatctttgaatggcaaacattttaaaaacatctgttctagttgcacaactactctagcttctttataaagtaaacaatcttaaagtaagcaatgttggccataatttcaatattctagccttgccgagtgtgaatatattttactcagagactatgtacaaatacactaaagtggtgatggtgatcaatattgtaaagaatttattctgataaatgagaaactggatataatgtcaaaatagctattttctcaataaaaatctcaaatctcctga

SEQ ID NO: 456226 - DNA, 279 bp, Homo sapiens
caggggaaccagaagaagcctctggtgggaaaaaaggcagcagctaccaagaaaacaaggctgtgaacttttcgggaactggaactgtttaacttgaacccaggattgtttaaagctttatttatttatagcttcttcttaaaaaaaagtgttgaagaaattttttggttattcatacaaaaaaatgagttgatgatggaaaagcaagtcataatcatctaattgtttttgtctaggtcgagaatgaatgttagctgatgaaataaaccctgacaagga

SEQ ID NO: 456227 - DNA, 4031 bp, Homo sapiens
cggcgccgagtagccgggccgggccggagcgcgggcgcggcggaggcagctgcgcccggctcctgccctcccaggccccgcgccccgcgcccgggccccggcgatggtgacacatgcggcggcggcgcgccggcggcaggaccatggttgagcgcgccagcaagttcgtgctggtggtggcgggctcggtgtgcttcatgctcatcttgtaccagtacgcgggcccaggactgagcctgggcgcgcccggcggccgcgcgccgcccgacgacctggacctgttccccacgcccgacccccactacgagaagaagtactacttcccggtccgcgagctggagcgctcgctgcgcttcgacatgaagggcgacgacgtgatcgtcttcctgcacatccagaagacgggcggcaccaccttcggccgccacctcgtgcagaacgtacgcctcgaggtgccgtgcgactgccggcccggccagaagaagtgcacctgctaccggcccaaccgccgcgagacttggctcttctcccgcttctccaccggctggagctgcgggctgcacgccgactggaccgagctcaccaactgcgtgcccggcgtgctggaccgccgcgactccgccgcgctgcgcacgcccaggaagttctactacatcaccctgctacgagaccccgtgtcccgctacctgagcgagtggcggcatgtgcagaggggtgccacgtggaagacgtcgttgcatatgtgtgatgggcgcacgcccacgcctgaggagctgccgccctgctacgagggcacggactggtcgggctgcacgctacaggagttcatggactgcccgtacaacctggccaacaaccgccaggtgcgcatgctggccgacctgagcctggtgggctgctacaacctgtccttcatccccgagggcaagcgggcccagctgctgctcgagagcgccaagaagaacctgcggggcatggccttcttcggcctgaccgagttccagcgcaagacgcagtacctgttcgagcggacgttcaacctcaagttcatccggcccttcatgcagtacaatagcacgcgggcgggcggcgtggaggtggatgaagacaccatccggcgcatcgaggagctcaacgacctggacatgcagctgtacgactacgccaaggacctcttccagcagcgctaccagtacaagcggcagctggagcgcagggagcagcgcctgaggagccgcgaggagcgtctgctgcaccgggccaaggaggcactgccgcgggaggatgccgacgagccgggccgcgtgcccaccgaggactacatgagccacatcattgagaagtggtagtggcggtggtggccacggggaggcctcttggggggtgtgggggataaaacaggacagacgacaggtccacccaagactgtcaagggatgagcatcccaaacctgctccacagaggtagctgcgtcctgaaaaaaaacagagcagggatgtagtggggctgggcagggatgggggcttgagaaatcaacaggtgcagcccagtgggtcagaggaaagcgtgctcgaaggatgccatggtcagggcagggcctccagagcaggtgttgtgcctggagctgctctcctggcctccttggatttatcgcaaaaactgaaggtttgcgcaagagacgaggacagcggaaagtggacctgccaggccgggagtgtgtccctcaccaactatgcacacagcactcgctcttagctcctctgtccgggctactaggagtgagaccagcttctggcaactgccccagctccaggccatcccatagcccctcctcttctggctgcccccaatgccccgaggcctggggagcccccagctcacccatctgtagctccctcaaagtcagggcccaccccatctgaggcagagaagactcgagtccagcccccaggaagcctgctcccctctctggcccatggtcctgcttcatgctttgggtcaggaggccaaagctgatgttcaggccccacccactccctacagtcctcagaccaaggaggggtttgggtagtaggcccgagctgcattgccggccttcctcgggccaactggcagcccaggagtggggaggctttggccagggatgctgccacttgtgcgtgagtccgcggctggcccttggaggtgaccatccaggcaggcctggctcagactggaagggctggggaccgagggctcccctgcctctgttctcctttctgacccactgggatttgctagcaggctgccccagccccatcaccgaaacacatactcaagagctcaaataccactgctcccaccagcgtacggattaagttcatcaggcttccatcggctggagcatgggaccatagcccctgcccaggagccgtaccctcggaccacagtggctctgtatggccaggaactgggactcgagctttcagattctcaactagccttggcaaaacagctgtaggtggcctccctgacaacagacactcagccctccccaccctggctctccttgcatttccccatgctccccaccccctggcaaaaggctggccatgctctgttcccagcagccgcgcaggtttccccactggctgcaatggccctaccaaaagccatgttgcatatccgttgtaagcacgtgccctgtgccctgtccccattccttatgccctaggaggccaagctggtgtctctaggagggcccacacaggcaccctggatcccccagagagtagattggtgtgctcaggccgcaggctgactcagaggtagggcagtgggctctgcaggccacctggctggggttggtgggggtcctctctcctgccccagcttccactcagccaccacagttgccacaccatggggtggagacgtgggtcaccacgggcttgggagcaagcgccttctgcagcacaggaagccgaagctggggtcaggtgaggtcgctacccctggaggtctggcataagggccccaccctcaggtctcctacactggccccattttactttggggtccaaggacaggatggtcaacagggcagggtggacagcgtgccagcgccgcgcagggccacctccctgggtggatgcatcacactaaggaagtgagtgccaaggggatttagtggtgtggttctttcaaagggaggtcagggtcaatgggaatctgctcggacactcaacatgggggtgggtgcactccttggaggaggaggaacacgttcaggggattgtgaggtcttgcacaagccacgtggggcaccttggcttcccggcaggaggtggacacccagccagaggcctggctcaaggtgacctcaccttcaccatgggcttcctgggtgcgcgggcctgagcgcaggttgttttgtacatattggaatatgtgttaacttatgccccgcatcccaactcacacggaagcacgggtcttgtctcagtctcttcgctgcatttggaaagcagtctcctctcgggccagcgccgggctgaggtgtccagaggcggcggcagctggcagtgccctcagcccccaagtgtccagcctggcacttcccattcaggccacctgctttgggtcaacagttcctttgccagcagcatctcctaaattgtaaggactctgtccaccggggccctcccagggctgtgaggacggaaacaggcagggagtggagctaacagcttagtcaccaggacccccagacctgcaaacgtcccctcctggaaggggaagccaggaacagcagaactgcccacaaaacaaggctgtgaacttttcgggaactggaactgtttaacttgaacccaggattgtttaaagctttatttatttatagcttcttcttaaaaaaaagtgttgaagaaattttttggttattcatacaaaaaaatgagttgatgatggaaaagcaagtcataatcatctaattgtttttgtctaggtcgagaatgaatgttagctgatgaaataaaccctgacaagga

SEQ ID NO: 456228 - DNA, 4026 bp, Homo sapiens
cggcgccgagtagccgggccgggccggagcgcgggcgcggcggaggcagctgcgcccggctcctgccctcccaggccccgcgccccgcgcccgggccccggcgatggtgacacatgcggcggcggcgcgccggcggcaggaccatggttgagcgcgccagcaagttcgtgctggtggtggcgggctcggtgtgcttcatgctcatcttgtaccagtacgcgggcccaggactgagcctgggcgcgcccggcggccgcgcgccgcccgacgacctggacctgttccccacgcccgacccccactacgagaagaagtactacttcccggtccgcgagctggagcgctcgctgcgcttcgacatgaagggcgacgacgtgatcgtcttcctgcacatccagaagacgggcggcaccaccttcggccgccacctcgtgcagaacgtacgcctcgaggtgccgtgcgactgccggcccggccagaagaagtgcacctgctaccggcccaaccgccgcgagacttggctcttctcccgcttctccaccggctggagctgcgggctgcacgccgactggaccgagctcaccaactgcgtgcccggcgtgctggaccgccgcgactccgccgcgctgcgcacgcccaggaagttctactacatcaccctgctacgagaccccgtgtcccgctacctgagcgagtggcggcatgtgcagaggggtgccacgtggaagacgtcgttgcatatgtgtgatgggcgcacgcccacgcctgaggagctgccgccctgctacgagggcacggactggtcgggctgcacgctacaggagttcatggactgcccgtacaacctggccaacaaccgccaggtgcgcatgctggccgacctgagcctggtgggctgctacaacctgtccttcatccccgagggcaagcgggcccagctgctgctcgagagcgccaagaagaacctgcggggcatggccttcttcggcctgaccgagttccagcgcaagacgcagtacctgttcgagcggacgttcaacctcaagttcatccggcccttcatgcagtacaatagcacgcgggcgggcggcgtggaggtggatgaagacaccatccggcgcatcgaggagctcaacgacctggacatgcagctgtacgactacgccaaggacctcttccagcagcgctaccagtacaagcggcagctggagcgcagggagcagcgcctgaggagccgcgaggagcgtctgctgcaccgggccaaggaggcactgccgcgggaggatgccgacgagccgggccgcgtgcccaccgaggactacatgagccacatcattgagaagtggtagtggcggtggtggccacggggaggcctcttggggggtgtgggggataaaacaggacagacgacaggtccacccaagactgtcaagggatgagcatcccaaacctgctccacagaggtagctgcgtcctgaaaaaaaacagagcagggatgtagtggggctgggcagggatgggggcttgagaaatcaacaggtgcagcccagtgggtcagaggaaagcgtgctcgaaggatgccatggtcagggcagggcctccagagcaggtgttgtgcctggagctgctctcctggcctccttggatttatcgcaaaaactgaaggtttgcgcaagagacgaggacagcggaaagtggacctgccaggccgggagtgtgtccctcaccaactatgcacacagcactcgctcttagctcctctgtccgggctactaggagtgagaccagcttctggcaactgccccagctccaggccatcccatagcccctcctcttctggctgcccccaatgccccgaggcctggggagcccccagctcacccatctgtagctccctcaaagtcagggcccaccccatctgaggcagagaagactcgagtccagcccccaggaagcctgctcccctctctggcccatggtcctgcttcatgctttgggtcaggaggccaaagctgatgttcaggccccacccactccctacagtcctcagaccaaggaggggtttgggtagtaggcccgagctgcattgccggccttcctcgggccaactggcagcccaggagtggggaggctttggccagggatgctgccacttgtgcgtgagtccgcggctggcccttggaggtgaccatccaggcaggcctggctcagactggaagggctggggaccgagggctcccctgcctctgttctcctttctgacccactgggatttgctagcaggctgccccagccccatcaccgaaacacatactcaagagctcaaataccactgctcccaccagcgtacggattaagttcatcaggcttccatcggctggagcatgggaccatagcccctgcccaggagccgtaccctcggaccacagtggctctgtatggccaggaactgggactcgagctttcagattctcaactagccttggcaaaacagctgtaggtggcctccctgacaacagacactcagccctccccaccctggctctccttgcatttccccatgctccccaccccctggcaaaaggctggccatgctctgttcccagcagccgcgcaggtttccccactggctgcaatggccctaccaaaagccatgttgcatatccgttgtaagcacgtgccctgtgccctgtccccattccttatgccctaggaggccaagctggtgtctctaggagggcccacacaggcaccctggatcccccagagagtagattggtgtgctcaggccgcaggctgactcagaggtagggcagtgggctctgcaggccacctggctggggttggtgggggtcctctctcctgccccagcttccactcagccaccacagttgccacaccatggggtggagacgtgggtcaccacgggcttgggagcaagcgccttctgcagcacaggaagccgaagctggggtcaggtgaggtcgctacccctggaggtctggcataagggccccaccctcaggtctcctacactggccccattttactttggggtccaaggacaggatggtcaacagggcagggtggacagcgtgccagcgccgcgcagggccacctccctgggtggatgcatcacactaaggaagtgagtgccaaggggatttagtggtgtggttctttcaaagggaggtcagggtcaatgggaatctgctcggacactcaacatgggggtgggtgcactccttggaggaggaggaacacgttcaggggattgtgaggtcttgcacaagccacgtggggcaccttggcttcccggcaggaggtggacacccagccagaggcctggctcaaggtgacctcaccttcaccatgggcttcctgggtgcgcgggcctgagcgcaggttgttttgtacatattggaatatgtgttaacttatgccccgcatcccaactcacacggaagcacgggtcttgtctcagtctcttcgctgcatttggaaagcagtctcctctcgggccagcgccgggctgaggtgtccagaggcggcggcagctggcagtgccctcagcccccaagtgtccagcctggcacttcccattcaggccacctgctttgggtcaacagttcctttgccagcagcatctcctaaattgtaaggactctgtccaccggggccctcccagggctgtgaggacggaaacaggcagggagtggagctaacagcttagtcaccaggacccccagacctgcaaacgtcccctcctggaaggggaagccaggaacagcagaactgcccacaaaacaaggctgtgaacttttcgggaactggaactgtttaacttgaacccaggattgtttaaagctttatttatttatagcttcttcttaaaaaaaagtgttgaagaaattttttggttattcatacaaaaaaatgagttgatgatggaaaagcaagtcataatcatctaattgtttttgtcttgggtcgtttgtcttcgggtcgtttatcttcgggtcgttt

SEQ ID NO: 456229 - DNA, 3969 bp, Homo sapiens
cggcgccgagtagccgggccgggccggagcgcgggcgcggcggaggcagctgcgcccggctcctgccctcccaggccccgcgccccgcgcccgggccccggcgatggtgacacatgcggcggcggcgcgccggcggcaggaccatggttgagcgcgccagcaagttcgtgctggtggtggcgggctcggtgtgcttcatgctcatcttgtaccagtacgcgggcccaggactgagcctgggcgcgcccggcggccgcgcgccgcccgacgacctggacctgttccccacgcccgacccccactacgagaagaagtactacttcccggtccgcgagctggagcgctcgctgcgcttcgacatgaagggcgacgacgtgatcgtcttcctgcacatccagaagacgggcggcaccaccttcggccgccacctcgtgcagaacgtacgcctcgaggtgccgtgcgactgccggcccggccagaagaagtgcacctgctaccggcccaaccgccgcgagacttggctcttctcccgcttctccaccggctggagctgcgggctgcacgccgactggaccgagctcaccaactgcgtgcccggcgtgctggaccgccgcgactccgccgcgctgcgcacgcccaggaagttctactacatcaccctgctacgagaccccgtgtcccgctacctgagcgagtggcggcatgtgcagaggggtgccacgtggaagacgtcgttgcatatgtgtgatgggcgcacgcccacgcctgaggagctgccgccctgctacgagggcacggactggtcgggctgcacgctacaggagttcatggactgcccgtacaacctggccaacaaccgccaggtgcgcatgctggccgacctgagcctggtgggctgctacaacctgtccttcatccccgagggcaagcgggcccagctgctgctcgagagcgccaagaagaacctgcggggcatggccttcttcggcctgaccgagttccagcgcaagacgcagtacctgttcgagcggacgttcaacctcaagttcatccggcccttcatgcagtacaatagcacgcgggcgggcggcgtggaggtggatgaagacaccatccggcgcatcgaggagctcaacgacctggacatgcagctgtacgactacgccaaggacctcttccagcagcgctaccagtacaagcggcagctggagcgcagggagcagcgcctgaggagccgcgaggagcgtctgctgcaccgggccaaggaggcactgccgcgggaggatgccgacgagccgggccgcgtgcccaccgaggactacatgagccacatcattgagaagtggtagtggcggtggtggccacggggaggcctcttggggggtgtgggggataaaacaggacagacgacaggtccacccaagactgtcaagggatgagcatcccaaacctgctccacagaggtagctgcgtcctgaaaaaaaacagagcagggatgtagtggggctgggcagggatgggggcttgagaaatcaacaggtgcagcccagtgggtcagaggaaagcgtgctcgaaggatgccatggtcagggcagggcctccagagcaggtgttgtgcctggagctgctctcctggcctccttggatttatcgcaaaaactgaaggtttgcgcaagagacgaggacagcggaaagtggacctgccaggccgggagtgtgtccctcaccaactatgcacacagcactcgctcttagctcctctgtccgggctactaggagtgagaccagcttctggcaactgccccagctccaggccatcccatagcccctcctcttctggctgcccccaatgccccgaggcctggggagcccccagctcacccatctgtagctccctcaaagtcagggcccaccccatctgaggcagagaagactcgagtccagcccccaggaagcctgctcccctctctggcccatggtcctgcttcatgctttgggtcaggaggccaaagctgatgttcaggccccacccactccctacagtcctcagaccaaggaggggtttgggtagtaggcccgagctgcattgccggccttcctcgggccaactggcagcccaggagtggggaggctttggccagggatgctgccacttgtgcgtgagtccgcggctggcccttggaggtgaccatccaggcaggcctggctcagactggaagggctggggaccgagggctcccctgcctctgttctcctttctgacccactgggatttgctagcaggctgccccagccccatcaccgaaacacatactcaagagctcaaataccactgctcccaccagcgtacggattaagttcatcaggcttccatcggctggagcatgggaccatagcccctgcccaggagccgtaccctcggaccacagtggctctgtatggccaggaactgggactcgagctttcagattctcaactagccttggcaaaacagctgtaggtggcctccctgacaacagacactcagccctccccaccctggctctccttgcatttccccatgctccccaccccctggcaaaaggctggccatgctctgttcccagcagccgcgcaggtttccccactggctgcaatggccctaccaaaagccatgttgcatatccgttgtaagcacgtgccctgtgccctgtccccattccttatgccctaggaggccaagctggtgtctctaggagggcccacacaggcaccctggatcccccagagagtagattggtgtgctcaggccgcaggctgactcagaggtagggcagtgggctctgcaggccacctggctggggttggtgggggtcctctctcctgccccagcttccactcagccaccacagttgccacaccatggggtggagacgtgggtcaccacgggcttgggagcaagcgccttctgcagcacaggaagccgaagctggggtcaggtgaggtcgctacccctggaggtctggcataagggccccaccctcaggtctcctacactggccccattttactttggggtccaaggacaggatggtcaacagggcagggtggacagcgtgccagcgccgcgcagggccacctccctgggtggatgcatcacactaaggaagtgagtgccaaggggatttagtggtgtggttctttcaaagggaggtcagggtcaatgggaatctgctcggacactcaacatgggggtgggtgcactccttggaggaggaggaacacgttcaggggattgtgaggtcttgcacaagccacgaacagcagaactgcccacaaaacaaggctgtgaacttttcgggaactggaactgtttaacttgaacccaggattgtttaaagctttatttatttatagcttcttcttaaaaaaaagtgttgaagaaattttttggttattcatacaaaaaaatgagttgatgatggaaaagcaagtcataatcatctaattgtttttgtctaggtcgagaatgaatgttagctgatgaaataaaccctgacaaggaaaaaatataatgcaaaattgaaacacaatttatacgagacacaacgaaccgcgaaaagaataaaactcatcaaatccataacaaagcacaacacaacacaaacacagacagaaacggagcggccgcgccccacgaccacacgcccaccggagggaccaacaaaaggcagatgcaccacacaccatccagcacaacagagggcccgcacccaaacaagacgggcgacgcaaacagaccaggacgcgagccgcgagcggccaccgtcgcgcacaaaccaccgcgagcgcaccggacaacaccacggagtagggccgcacacccgtgcgaggagagccgcacccccgcgcgagcgggggaggagaaccaacggcggcgacaaccaccaccgacgaggaggggggaagcgcgaccgcggggcgagacaa

SEQ ID NO: 456230 - DNA, 4456 bp, Homo sapiens
cggcgccgagtagccgggccgggccggagcgcgggcgcggcggaggcagctgcgcccggctcctgccctcccaggccccgcgccccgcgcccgggccccggcgatggtgacacatgcggcggcggcgcgccggcggcaggaccatggttgagcgcgccagcaagttcgtgctggtggtggcgggctcggtgtgcttcatgctcatcttgtaccagtacgcgggcccaggactgagcctgggcgcgcccggcggccgcgcgccgcccgacgacctggacctgttccccacgcccgacccccactacgagaagaagtactacttcccggtccgcgagctggagcgctcgctgcgcttcgacatgaagggcgacgacgtgatcgtcttcctgcacatccagaagacgggcggcaccaccttcggccgccacctcgtgcagaacgtacgcctcgaggtgccgtgcgactgccggcccggccagaagaagtgcacctgctaccggcccaaccgccgcgagacttggctcttctcccgcttctccaccggctggagctgcgggctgcacgccgactggaccgagctcaccaactgcgtgcccggcgtgctggaccgccgcgactccgccgcgctgcgcacgcccaggaagttctactacatcaccctgctacgagaccccgtgtcccgctacctgagcgagtggcggcatgtgcagaggggtgccacgtggaagacgtcgttgcatatgtgtgatgggcgcacgcccacgcctgaggagctgccgccctgctacgagggcacggactggtcgggctgcacgctacaggagttcatggactgcccgtacaacctggccaacaaccgccaggtgcgcatgctggccgacctgagcctggtgggctgctacaacctgtccttcatccccgagggcaagcgggcccagctgctgctcgagagcgccaagaagaacctgcggggcatggccttcttcggcctgaccgagttccagcgcaagacgcagtacctgttcgagcggacgttcaacctcaagttcatccggcccttcatgcagtacaatagcacgcgggcgggcggcgtggaggtggatgaagacaccatccggcgcatcgaggagctcaacgacctggacatgcagctgtacgactacgccaaggacctcttccagcagcgctaccagtacaagcggcagctggagcgcagggagcagcgcctgaggagccgcgaggagcgtctgctgcaccgggccaaggaggcactgccgcgggaggatgccgacgagccgggccgcgtgcccaccgaggactacatgagccacatcattgagaagtggtagtggcggtggtggccacggggaggcctcttggggggtgtgggggataaaacaggacagacgacaggtccacccaagactgtcaagggatgagcatcccaaacctgctccacagaggtagctgcgtcctgaaaaaaaacagagcagggatgtagtggggctgggcagggatgggggcttgagaaatcaacaggtgcagcccagtgggtcagaggaaagcgtgctcgaaggatgccatggtcagggcagggcctccagagcaggtgttgtgcctggagctgctctcctggcctccttggatttatcgcaaaaactgaaggtttgcgcaagagacgaggacagcggaaagtggacctgccaggccgggagtgtgtccctcaccaactatgcacacagcactcgctcttagctcctctgtccgggctactaggagtgagaccagcttctggcaactgccccagctccaggccatcccatagcccctcctcttctggctgcccccaatgccccgaggcctggggagcccccagctcacccatctgtagctccctcaaagtcagggcccaccccatctgaggcagagaagactcgagtccagcccccaggaagcctgctcccctctctggcccatggtcctgcttcatgctttgggtcaggaggccaaagctgatgttcaggccccacccactccctacagtcctcagaccaaggaggggtttgggtagtaggcccgagctgcattgccggccttcctcgggccaactggcagcccaggagtggggaggctttggccagggatgctgccacttgtgcgtgagtccgcggctggcccttggaggtgaccatccaggcaggcctggctcagactggaagggctggggaccgagggctcccctgcctctgttctcctttctgacccactgggatttgctagcaggctgccccagccccatcaccgaaacacatactcaagagctcaaataccactgctcccaccagcgtacggattaagttcatcaggcttccatcggctggagcatgggaccatagcccctgcccaggagccgtaccctcggaccacagtggctctgtatggccaggaactgggactcgagctttcagattctcaactagccttggcaaaacagctgtaggtggcctccctgacaacagacactcagccctccccaccctggctctccttgcatttccccatgctccccaccccctggcaaaaggctggccatgctctgttcccagcagccgcgcaggtttccccactggctgcaatggccctaccaaaagccatgttgcatatccgttgtaagcacgtgccctgtgccctgtccccattccttatgccctaggaggccaagctggtgtctctaggagggcccacacaggcaccctggatcccccagagagtagattggtgtgctcaggccgcaggctgactcagaggtagggcagtgggctctgcaggccacctggctggggttggtgggggtcctctctcctgccccagcttccactcagccaccacagttgccacaccatggggtggagacgtgggtcaccacgggcttgggagcaagcgccttctgcagcacaggaagccgaagctggggtcaggtgaggtcgctacccctggaggtctggcataagggccccaccctcaggtctcctacactggccccattttactttggggtccaaggacaggatggtcaacagggcagggtggacagcgtgccagcgccgcgcagggccacctccctgggtggatgcatcacactaaggaagtgagtgccaaggggatttagtggtgtggttctttcaaagggaggtcagggtcaatgggaatctgctcggacactcaacatgggggtgggtgcactccttggaggaggaggaacacgttcaggggattgtgaggtcttgcacaagccacgtggggcaccttggcttcccggcaggaggtggacacccagccagaggcctggctcaaggtgacctcaccttcaccatgggcttcctgggtgcgcgggcctgagcgcaggttgttttgtacatattggaatatgtgttaacttatgccccgcatcccaactcacacggaagcacgggtcttgtctcagtctcttcgctgcatttggaaagcagtctcctctcgggccagcgccgggctgaggtgtccagaggcggcggcagctggcagtgccctcagcccccaagtgtccagcctggcacttcccattcaggccacctgctttgggtcaacagttcctttgccagcagcatctcctaaattgtaaggactctgtccaccggggccctcccagggctgtgaggacggaaacaggcagggagtggagctaacagcttagtcaccaggacccccagacctgcaaacgtcccctcctggaaggggaagccaggaacagcagaactgcccacaaaacaaggctgtgaacttttcgggaactggaactgtttaacttgaacccaggattgtttaaagctttatttatttatagcttcttcttaaaaaaaagtgttgaagaaattttttggttattcatacaaaaaaatgagttgatgatggaaaagcaagtcataatcatctaattgtttttgtctaggtcgagaatgaatgttagctgatgaaataaaccctgacaaggaaaaaatataatgcaaaattgaaacacaatttatacgagacacaacgaaccgcgaaaagaataaaactcatcaaatccataacaaagcacaacacaacacaaacacagacagaaacggagcggccgcgccccacgaccacacgcccaccggagggaccaacaaaaggcagatgcaccacacaccatccagcacaacagagggcccgcacccaaacaagacgggcgacgcaaacagaccaggacgcgagccgcgagcggccaccgtcgcgcacaaaccaccgcgagcgcaccggacaacaccacggagtagggccgcacacccgtgcgaggagagccgcacccccgcgcgagcgggggaggagaaccaacggcggcgacaaccaccaccgacgaggaggggggaagcgcgaccgcggggcgagacaa

SEQ ID NO: 456231 - DNA, 3726 bp, Homo sapiens
  misc_feature (3588)..(3588): n is a, c, g, or t
cggcgccgagtagccgggccgggccggagcgcgggcgcggcggaggcagctgcgcccggctcctgccctcccaggccccgcgccccgcgcccgggccccggcgatggtgacacatgcggcggcggcgcgccggcggcaggaccatggttgagcgcgccagcaagttcgtgctggtggtggcgggctcggtgtgcttcatgctcatcttgtaccagtacgcgggcccaggactgagcctgggcgcgcccggcggccgcgcgccgcccgacgacctggacctgttccccacgcccgacccccactacgagaagaagtactacttcccggtccgcgagctggagcgctcgctgcgcttcgacatgaagggcgacgacgtgatcgtcttcctgcacatccagaagacgggcggcaccaccttcggccgccacctcgtgcagaacgtacgcctcgaggtgccgtgcgactgccggcccggccagaagaagtgcacctgctaccggcccaaccgccgcgagacttggctcttctcccgcttctccaccggctggagctgcgggctgcacgccgactggaccgagctcaccaactgcgtgcccggcgtgctggaccgccgcgactccgccgcgctgcgcacgcccaggaagttctactacatcaccctgctacgagaccccgtgtcccgctacctgagcgagtggcggcatgtgcagaggggtgccacgtggaagacgtcgttgcatatgtgtgatgggcgcacgcccacgcctgaggagctgccgccctgctacgagggcacggactggtcgggctgcacgctacaggagttcatggactgcccgtacaacctggccaacaaccgccaggtgcgcatgctggccgacctgagcctggtgggctgctacaacctgtccttcatccccgagggcaagcgggcccagctgctgctcgagagcgccaagaagaacctgcggggcatggccttcttcggcctgaccgagttccagcgcaagacgcagtacctgttcgagcggacgttcaacctcaagttcatccggcccttcatgcagtacaatagcacgcgggcgggcggcgtggaggtggatgaagacaccatccggcgcatcgaggagctcaacgacctggacatgcagctgtacgactacgccaaggacctcttccagcagcgctaccagtacaagcggcagctggagcgcagggagcagcgcctgaggagccgcgaggagcgtctgctgcaccgggccaaggaggcactgccgcgggaggatgccgacgagccgggccgcgtgcccaccgaggactacatgagccacatcattgagaagtggtagtggcggtggtggccacggggaggcctcttggggggtgtgggggataaaacaggacagacgacaggtccacccaagactgtcaagggatgagcatcccaaacctgctccacagaggtagctgcgtcctgaaaaaaaacagagcagggatgtagtggggctgggcagggatgggggcttgagaaatcaacaggtgcagcccagtgggtcagaggaaagcgtgctcgaaggatgccatggtcagggcagggcctccagagcaggtgttgtgcctggagctgctctcctggcctccttggatttatcgcaaaaactgaaggtttgcgcaagagacgaggacagcggaaagtggacctgccaggccgggagtgtgtccctcaccaactatgcacacagcactcgctcttagctcctctgtccgggctactaggagtgagaccagcttctggcaactgccccagctccaggccatcccatagcccctcctcttctggctgcccccaatgccccgaggcctggggagcccccagctcacccatctgtagctccctcaaagtcagggcccaccccatctgaggcagagaagactcgagtccagcccccaggaagcctgctcccctctctggcccatggtcctgcttcatgctttgggtcaggaggccaaagctgatgttcaggccccacccactccctacagtcctcagaccaaggaggggtttgggtagtaggcccgagctgcattgccggccttcctcgggccaactggcagcccaggagtggggaggctttggccagggatgctgccacttgtgcgtgagtccgcggctggcccttggaggtgaccatccaggcaggcctggctcagactggaagggctggggaccgagggctcccctgcctctgttctcctttctgacccactgggatttgctagcaggctgccccagccccatcaccgaaacacatactcaagagctcaaataccactgctcccaccagcgtacggattaagttcatcaggcttccatcggctggagcatgggaccatagcccctgcccaggagccgtaccctcggaccacagtggctctgtatggccaggaactgggactcgagctttcagattctcaactagccttggcaaaacagctgtaggtggcctccctgacaacagacactcagccctccccaccctggctctccttgcatttccccatgctccccaccccctggcaaaaggctggccatgctctgttcccagcagccgcgcaggtttccccactggctgcaatggccctaccaaaagccatgttgcatatccgttgtaagcacgtgccctgtgccctgtccccattccttatgccctaggaggccaagctggtgtctctaggagggcccacacaggcaccctggatcccccagagagtagattggtgtgctcaggccgcaggctgactcagaggtagggcagtgggctctgcaggccacctggctggggttggtgggggtcctctctcctgccccagcttccactcagccaccacagttgccacaccatggggtggagacgtgggtcaccacgggcttgggagcaagcgccttctgcagcacaggaagccgaagctggggtcaggtgaggtcgctacccctggaggtctggcataagggccccaccctcaggtctcctacactggccccattttactttggggtccaaggacaggatggtcaacagggcagggtggacagcgtgccagcgccgcgcagggccacctccctgggtggatgcatcacactaaggaagtgagtgccaaggggatttagtggtgtggttctttcaaagggaggtcagggtcaatgggaatctgctcggacactcaacatgggggtgggtgcactccttggaggaggaggaacacgttcaggggattgtgaggtcttgcacaagccacgtggggcaccttggcttcccggcaggaggtggacacccagccagaggcctggctcaaggtgacctcaccttcaccatgggcttcctgggtgcgcgggcctgagcgcaggttgttttgtacatattggaatatgtgttaacttatgccccgcatcccaactcacacggaagcacgggtcttgtctcagtctcttcgctgcatttggaaagcagtctcctctcgggccagcgccgggctgaggtgtccagaggcggcggcagctggcagtgccctcagcccaaggtcagctgnattccatcaggcactgtgggtcaccggtccttgcagagattctaatgagacgcgcacgggccccagggggggcggaaagggggggggaactgcaggacccaagaagcccgggggggagaagagcccaaaagggggggg

SEQ ID NO: 456232 - DNA, 2924 bp, Homo sapiens
cggcgccgagtagccgggccgggccggagcgcgggcgcggcggaggcagctgcgcccggctcctgccctcccaggccccgcgccccgcgcccgggccccggcgatggtgacacatgcggcggcggcgcgccggcggcaggaccatggttgagcgcgccagcaagttcgtgctggtggtggcgggctcggtgtgcttcatgctcatcttgtaccagtacgcgggcccaggactgagcctgggcgcgcccggcggccgcgcgccgcccgacgacctggacctgttccccacgcccgacccccactacgagaagaagtactacttcccggtccgcgagctggagcgctcgctgcgcttcgacatgaagggcgacgacgtgatcgtcttcctgcacatccagaagacgggcggcaccaccttcggccgccacctcgtgcagaacgtacgcctcgaggtgccgtgcgactgccggcccggccagaagaagtgcacctgctaccggcccaaccgccgcgagacttggctcttctcccgcttctccaccggctggagctgcgggctgcacgccgactggaccgagctcaccaactgcgtgcccggcgtgctggaccgccgcgactccgccgcgctgcgcacgcccaggaagttctactacatcaccctgctacgagaccccgtgtcccgctacctgagcgagtggcggcatgtgcagaggggtgccacgtggaagacgtcgttgcatatgtgtgatgggcgcacgcccacgcctgaggagctgccgccctgctacgagggcacggactggtcgggctgcacgctacaggagttcatggactgcccgtacaacctggccaacaaccgccaggtgcgcatgctggccgacctgagcctggtgggctgctacaacctgtccttcatccccgagggcaagcgggcccagctgctgctcgagagcgccaagaagaacctgcggggcatggccttcttcggcctgaccgagttccagcgcaagacgcagtacctgttcgagcggacgttcaacctcaagttcatccggcccttcatgcagtacaatagcacgcgggcgggcggcgtggaggtggatgaagacaccatccggcgcatcgaggagctcaacgacctggacatgcagctgtacgactacgccaaggacctcttccagcagcgctaccagtacaagcggcagctggagcgcagggagcagcgcctgaggagccgcgaggagcgtctgctgcaccgggccaaggaggcactgccgcgggaggatgccgacgagccgggccgcgtgcccaccgaggactacatgagccacatcattgagaagtggtagtggcggtggtggccacggggaggcctcttggggggtgtgggggataaaacaggacagacgacaggtccacccaagactgtcaagggatgagcatcccaaacctgctccacagaggtagctgcgtcctgaaaaaaaacagagcagggatgtagtggggctgggcagggatgggggcttgagaaatcaacaggtgcagcccagtgggtcagaggaaagcgtgctcgaaggatgccatggtcagggcagggcctccagagcaggtgttgtgcctggagctgctctcctggcctccttggatttatcgcaaaaactgaaggtttgcgcaagagacgaggacagcggaaagtggacctgccaggccgggagtgtgtccctcaccaactatgcacacagcactcgctcttagctcctctgtccgggctactaggagtgagaccagcttctggcaactgccccagctccaggccatcccatagcccctcctcttctggctgcagcacaggaagccgaagctggggtcaggtgaggtcgctacccctggaggtctggcataagggccccaccctcaggtctcctacactggccccattttactttggggtccaaggacaggatggtcaacagggcagggtggacagcgtgccagcgccgcgcagggccacctccctgggtggatgcatcacactaaggaagtgagtgccaaggggatttagtggtgtggttctttcaaagggaggtcagggtcaatgggaatctgctcggacactcaacatgggggtgggtgcactccttggaggaggaggaacacgttcaggggattgtgaggtcttgcacaagccacgtggggcaccttggcttcccggcaggaggtggacacccagccagaggcctggctcaaggtgacctcaccttcaccatgggcttcctgggtgcgcgggcctgagcgcaggttgttttgtacatattggaatatgtgttaacttatgccccgcatcccaactcacacggaagcacgggtcttgtctcagtctcttcgctgcatttggaaagcagtctcctctcgggccagcgccgggctgaggtgtccagaggcggcggcagctggcagtgccctcagcccccaagtgtccagcctggcacttcccattcaggccacctgctttgggtcaacagttcctttgccagcagcatctcctaaattgtaaggactctgtccaccggggccctcccagggctgtgaggacggaaacaggcagggagtggagctaacagcttagtcaccaggacccccagacctgcaaacgtcccctcctggaaggggaagccaggaacagcagaactgcccacaaaacaaggctgtgaacttttcgggaactggaactgtttaacttgaacccaggattgtttaaagctttatttatttatagcttcttcttaaaaaaaagtgttgaagaaattttttggttattcatacaaaaaaatgagttgatgatggaaaagcaagtcataatcatctaattgtttttgtctaggtcgagaatgaatgttagctgatgaaataaaccctgacaagga

SEQ ID NO: 456233 - DNA, 2172 bp, Homo sapiens
gccctgcagtgccattggcctggcaggcaggatcgaggaggaagtggctgattactgagcggttcttcctcacctggcttgggccactgtgcacagctgtgccgctggctcagccccgccccctgcggccctccgccgtggcttccccctccctacagagagatgctgtcccgtgggtggtttcaccgagacctcagtgggctggatgcagagaccctgctcaagggccgaggtgtccacggtagcttcctggctcggcccagtcgcaagaaccagggtgacttctcgctctccgtcagggtgggggatcaggtgacccatattcggatccagaactcaggggatttctatgacctgtatggaggggagaagtttgcgactctgacagagctggtggagtactacactcagcagcagggtgtcctgcaggaccgcgacggcaccatcatccacctcaagtacccgctgaactgctccgatcccactagtgagaggtggtaccatggccacatgtctggcgggcaggcagagacgctgctgcaggccaagggcgagccctggacgtttcttgtgcgtgagagcctcagccagcctggagacttcgtgctttctgtgctcagtgaccagcccaaggctggcccaggctccccgctcagggtcacccacatcaaggtcatgtgcgagggtggacgctacacagtgggtggtttggagaccttcgacagcctcacggacctggtggagcatttcaagaagacggggattgaggaggcctcaggcgcctttgtctacctgcggcagccgtactatgccacgagggtgaatgcggctgacattgagaaccgagtgttggaactgaacaagaagcaggagtccgaggatacagccaaggctggcttctgggaggagtttgagagtttgcagaagcaggaggtgaagaacttgcaccagcgtctggaagggcagcggccagagaacaagggcaagaaccgctacaagaacattctcccctttgaccacagccgagtgatcctgcagggacgggacagtaacatccccgggtccgactacatcaatgccaactacatcaagaaccagctgctaggccctgatgagaacgctaagacctacatcgccagccagggctgtctggaggccacggtcaatgacttctggcagatggcgtggcaggagaacagccgtgtcatcgtcatgaccacccgagaggtggagaaaggccggaacaaatgcgtcccatactggcccgaggtgggcatgcagcgtgcttatgggccctactctgtgaccaactgcggggagcatgacacaaccgaatacaaactccgtaccttacaggtctccccgctggacaatggagacctgattcgggagatctggcattaccagtacctgagctggcccgaccatggggtccccagtgagcctgggggtgtcctcagcttcctggaccagatcaaccagcggcaggaaagtctgcctcacgcagggcccatcatcgtgcactgcagcgccggcatcggccgcacaggcaccatcattgtcatcgacatgctcatggagaacatctccaccaagggcctggactgtgacattgacatccagaagaccatccagatggtgcgggcgcagcgctcgggcatggtgcagacggaggcgcagtacaagttcatctacgtggccatcgcccagttcattgaaaccactaagaagaagctggaggtcctgcagtcgcagaagggccaggagtcggagtacgggaacatcacctatcccccagccatgaagaatgcccatgccaaggcctcccgcacctcgtccaaacacaaggaggatgtgtatgagaacctgcacactaagaacaagagggaggagaaagtgaagaagcagcggtcagcagacaaggagaagagcaagggttccctcaagaggaagtgagcggtgctgtcctcaggtggccatgcctcagccctgaccctgtggaagcatttcgcgatggacagactcacaacctgaacctaggagtgccccattcttttgtaatttaaatggctgcatcccccccacctctccctgaccctgtatatagcccagccaggccccaggcagggccaacccttctcctcttgtaaataaagccctgggatcactgtg

SEQ ID NO: 456234 - DNA, 455 bp, Homo sapiens
tgccggctgccccaggccagtggagtggcagccccagaactgggaccaccgggggtggtgaggcggcccggcactgggagctgcatctgaggcttagtccctgagctctctgcctgcccagactagctgcacctcctcattccctgcgcccccttcctctccggaagcccccaggatggtgaggtggtttcaccgagacctcagtgggctggatgcagagaccctgctcaagggccgaggtgtccacggtagcttcctggctcggcccagtcgcaagaaccagggtgacttctcgctctccgtcaggtaggtgggccccccgcaaccccgggcattttggccactctcttgtgccatccaggccctgaaccactcattcctggttccccgtggcagtgctgactccccgtctgttcccttgcccccaacccccacactccccatccctgtctgtg

SEQ ID NO: 456235 - DNA, 340 bp, Homo sapiens
tggctggtactgcctcggaggtactgggatgcgcccccttcctctccggaagcccccaggatggtgaggtggtttcaccgagacctcagtgggctggatgcagagaccctgctcaagggccgaggtgtccacggtagcttcctggctcggcccagtcgcaagaaccagggtgacttctcgctctccgtcaggtaggtgggccccccgcaaccccgggcattttggccactctcttgtgccatccaggccctgaaccactcattcctggttccccgtggcagtgctgactccccgtctgttcccttgcccccaacccccacactccccatccctgtctgtg

SEQ ID NO: 456236 - DNA, 2554 bp, Homo sapiens
tgccggctgccccaggccagtggagtggcagccccagaactgggaccaccgggggtggtgaggcggcccggcactgggagctgcatctgaggcttagtccctgagctctctgcctgcccagactagctgcacctcctcattccctgcgcccccttcctctccggaagcccccaggatggtgaggtggtttcaccgagacctcagtgggctggatgcagagaccctgctcaagggccgaggtgtccacggtagcttcctggctcggcccagtcgcaagaaccagggtgacttctcgctctccgtcagggtgggggatcaggtgacccatattcggatccagaactcaggggatttctatgacctgtatggaggggagaagtttgcgactctgacagagctggtggagtactacactcagcagcagggtgtcctgcaggaccgcgacggcaccatcatccacctcaagtacccgctgaactgctccgatcccactagtgagaggtggtaccatggccacatgtctggcgggcaggcagagacgctgctgcaggccaagggcgagccctggacgtttcttgtgcgtgagagcctcagccagcctggagacttcgtgctttctgtgctcagtgaccagcccaaggctggcccaggctccccgctcagggtcacccacatcaaggtcatgtgcgagggtggacgctacacagtgggtggtttggagaccttcgacagcctcacggacctggtggagcatttcaagaagacggggattgaggaggcctcaggcgcctttgtctacctgcggcagccgtactatgccacgagggtgaatgcggctgacattgagaaccgagtgttggaactgaacaagaagcaggagtccgaggatacagccaaggctggcttctgggaggagtttgagagtttgcagaagcaggaggtgaagaacttgcaccagcgtctggaagggcagcggccagagaacaagggcaagaaccgctacaagaacattctcccctttgaccacagccgagtgatcctgcagggacgggacagtaacatccccgggtccgactacatcaatgccaactacatcaagaaccagctgctaggccctgatgagaacgctaagacctacatcgccagccagggctgtctggaggccacggtcaatgacttctggcagatggcgtggcaggagaacagccgtgtcatcgtcatgaccacccgagaggtggagaaaggccggaacaaatgcgtcccatactggcccgaggtgggcatgcagcgtgcttatgggccctactctgtgaccaactgcggggagcatgacacaaccgaatacaaactccgtaccttacaggtctccccgctggacaatggagacctgattcgggagatctggcattaccagtacctgagctggcccgaccatggggtccccagtgagcctgggggtgtcctcagcttcctggaccagatcaaccagcggcaggaaagtctgcctcacgcagggcccatcatcgtgcactgcagcgccggcatcggccgcacaggcaccatcattgtcatcgacatgctcatggagaacatctccaccaagggcctggactgtgacattgacatccagaagaccatccagatggtgcgggcgcagcgctcgggcatggtgcagacggaggcgcagtacaagttcatctacgtggccatcgcccagttcattgaaaccactaagaagaagctggaggtcctgcagtcgcagaagggccaggagtcggagtacgggaacatcacctatcccccagccatgaagaatgcccatgccaaggcctcccgcacctcgtccaaacacaaggaggatgtgtatgagaacctgcacactaagaacaagagggaggagaaagtgaagaagcagcggtcagcagacaaggagaagagcaagggttccctcaagaggaagtgagcggtgctgtcctcaggtggccatgcctcagccctgaccctgtggaagcatttcgcgatggacagactcacaacctgaacctaggagtgccccattcttttgtaatttaaatggctgcatcccccccacctctccctgaccctgtatatagcccagccaggccccaggcagggccaacccttctcctcttgtaaataaagccctgggatcactgtgaaaaaaaaaacaaaaacgaaacaaaaaaaaaaaacaaaaacaaaaaaaaataaaaacaaacaaaacaaacaacacgaacactatgtgaatggctggatcagtatgtaataaataccactgactagaagttgagtgagtaagtagtggtaagtgagccgctcctactccaagatgtatgttgaggaaggactgggactgtacattcaattcgacggaacaccaggcaaattgcgtcggtgttgtggtgtaagcaattcggagggtgacgagtgaccgctgtagggatagaacacacagtgggatggtctgatgtaggaactcatagcacgcacacaggaaaactagatcagaacagggaactactagcaaaaccga

SEQ ID NO: 456237 - DNA, 2031 bp, Homo sapiens
cctactttctcgtgcaaagcccccaggatggtgaggtggtttcaccgagacctcagtgggctggatgcagagaccctgctcaagggccgaggtgtccacggtagcttcctggctcggcccagtcgcaagaaccagggtgacttctcgctctccgtcagggtgggggatcaggtgacccatattcggatccagaactcaggggatttctatgacctgtatggaggggagaagtttgcgactctgacagagctggtggagtactacactcagcagcagggtgtcctgcaggaccgcgacggcaccatcatccacctcaagtacccgctgaactgctccgatcccactagtgagaggtggtaccatggccacatgtctggcgggcaggcagagacgctgctgcaggccaagggcgagccctggacgtttcttgtgcgtgagagcctcagccagcctggagacttcgtgctttctgtgctcagtgaccagcccaaggctggcccaggctccccgctcagggtcacccacatcaaggtcatgtgcgagggtggacgctacacagtgggtggtttggagaccttcgacagcctcacggacctggtggagcatttcaagaagacggggattgaggaggcctcaggcgcctttgtctacctgcggcagccgtactatgccacgagggtgaatgcggctgacattgagaaccgagtgttggaactgaacaagaagcaggagtccgaggatacagccaaggctggcttctgggaggagtttgagagtttgcagaagcaggaggtgaagaacttgcaccagcgtctggaagggcagcggccagagaacaagggcaagaaccgctacaagaacattctcccctttgaccacagccgagtgatcctgcagggacgggacagtaacatccccgggtccgactacatcaatgccaactacatcaagaaccagctgctaggccctgatgagaacgctaagacctacatcgccagccagggctgtctggaggccacggtcaatgacttctggcagatggcgtggcaggagaacagccgtgtcatcgtcatgaccacccgagaggtggagaaaggccggaacaaatgcgtcccatactggcccgaggtgggcatgcagcgtgcttatgggccctactctgtgaccaactgcggggagcatgacacaaccgaatacaaactccgtaccttacaggtctccccgctggacaatggagacctgattcgggagatctggcattaccagtacctgagctggcccgaccatggggtccccagtgagcctgggggtgtcctcagcttcctggaccagatcaaccagcggcaggaaagtctgcctcacgcagggcccatcatcgtgcactgcagcgccggcatcggccgcacaggcaccatcattgtcatcgacatgctcatggagaacatctccaccaagggcctggactgtgacattgacatccagaagaccatccagatggtgcgggcgcagcgctcgggcatggtgcagacggaggcgcagtacaagttcatctacgtggccatcgcccagttcattgaaaccactaagaagaagctggaggtcctgcagtcgcagaagggccaggagtcggagtacgggaacatcacctatcccccagccatgaagaatgcccatgccaaggcctcccgcacctcgtccaaacacaaggaggatgtgtatgagaacctgcacactaagaacaagagggaggagaaagtgaagaagcagcggtcagcagacaaggagaagagcaagggttccctcaagaggaagtgagcggtgctgtcctcaggtggccatgcctcagccctgaccctgtggaagcatttcgcgatggacagactcacaacctgaacctaggagtgccccattcttttgtaatttaaatggctgcatcccccccacctctccctgaccctgtatatagcccagccaggccccaggcagggccaacccttctcctcttgtaaataaagccctgggatcactgtg

SEQ ID NO: 456238 - DNA, 1954 bp, Homo sapiens
gttaaggctaggtacgaggctgggtgttaattcgccgagggccagtcgcaagatccagggtgacttctcgctctccgtcagggtgggggatcaggtgacccatattcggatccagaactcaggggatttctatgacctgtatggaggggagaagtttgcgactctgacagagctggtggagtactacactcagcagcagggtgtcctgcaggaccgcgacggcaccatcatccacctcaagtacccgctgaactgctccgatcccactagtgagaggtggtaccatggccacatgtctggcgggcaggcagagacgctgctgcaggccaagggcgagccctggacgtttcttgtgcgtgagagcctcagccagcctggagacttcgtgctttctgtgctcagtgaccagcccaaggctggcccaggctccccgctcagggtcacccacatcaaggtcatgtgcgagggtggacgctacacagtgggtggtttggagaccttcgacagcctcacggacctggtggagcatttcaagaagacggggattgaggaggcctcaggcgcctttgtctacctgcggcagccgtactatgccacgagggtgaatgcggctgacattgagaaccgagtgttggaactgaacaagaagcaggagtccgaggatacagccaaggctggcttctgggaggagtttgagagtttgcagaagcaggaggtgaagaacttgcaccagcgtctggaagggcagcggccagagaacaagggcaagaaccgctacaagaacattctcccctttgaccacagccgagtgatcctgcagggacgggacagtaacatccccgggtccgactacatcaatgccaactacatcaagaaccagctgctaggccctgatgagaacgctaagacctacatcgccagccagggctgtctggaggccacggtcaatgacttctggcagatggcgtggcaggagaacagccgtgtcatcgtcatgaccacccgagaggtggagaaaggccggaacaaatgcgtcccatactggcccgaggtgggcatgcagcgtgcttatgggccctactctgtgaccaactgcggggagcatgacacaaccgaatacaaactccgtaccttacaggtctccccgctggacaatggagacctgattcgggagatctggcattaccagtacctgagctggcccgaccatggggtccccagtgagcctgggggtgtcctcagcttcctggaccagatcaaccagcggcaggaaagtctgcctcacgcagggcccatcatcgtgcactgcagcgccggcatcggccgcacaggcaccatcattgtcatcgacatgctcatggagaacatctccaccaagggcctggactgtgacattgacatccagaagaccatccagatggtgcgggcgcagcgctcgggcatggtgcagacggaggcgcagtacaagttcatctacgtggccatcgcccagttcattgaaaccactaagaagaagctggaggtcctgcagtcgcagaagggccaggagtcggagtacgggaacatcacctatcccccagccatgaagaatgcccatgccaaggcctcccgcacctcgtccaaacacaaggaggatgtgtatgagaacctgcacactaagaacaagagggaggagaaagtgaagaagcagcggtcagcagacaaggagaagagcaagggttccctcaagaggaagtgagcggtgctgtcctcaggtggccatgcctcagccctgaccctgtggaagcatttcgcgatggacagactcacaacctgaacctaggagtgccccattcttttgtaatttaaatggctgcatcccccccacctctccctgaccctgtatatagcccagccaggccccaggcagggccaacccttctcctcttgtaaataaagccctgggatcactgtg

SEQ ID NO: 456239 - DNA, 2174 bp, Homo sapiens
cctactttctcgtgcaaagcccccaggatggtgaggtggtttcaccgagacctcagtgggctggatgcagagaccctgctcaagggccgaggtgtccacggtagcttcctggctcggcccagtcgcaagaaccagggtgacttctcgctctccgtcagggtgggggatcaggtgacccatattcggatccagaactcaggggatttctatgacctgtatggaggggagaagtttgcgactctgacagagctggtggagtactacactcagcagcagggtgtcctgcaggaccgcgacggcaccatcatccacctcaagtacccgctgaactgctccgatcccactagtgagaggtggtaccatggccacatgtctggcgggcaggcagagacgctgctgcaggccaagggcgagccctggacgtttcttgtgcgtgagagcctcagccagcctggagacttcgtgctttctgtgctcagtgaccagcccaaggctggcccaggctccccgctcagggtcacccacatcaaggtcatgtgcgagggtggacgctacacagtgggtggtttggagaccttcgacagcctcacggacctggtggagcatttcaagaagacggggattgaggaggcctcaggcgcctttgtctacctgcggcagccgtactatgccacgagggtgaatgcggctgacattgagaaccgagtgttggaactgaacaagaagcaggagtccgaggatacagccaaggctggcttctgggaggagtttgagagtttgcagaagcaggaggtgaagaacttgcaccagcgtctggaagggcagcggccagagaacaagggcaagaaccgctacaagaacattctcccctttgaccacagccgagtgatcctgcagggacgggacagtaacatccccgggtccgactacatcaatgccaactacatcaagaaccagctgctaggccctgatgagaacgctaagacctacatcgccagccagggctgtctggaggccacggtcaatgacttctggcagatggcgtggcaggagaacagccgtgtcatcgtcatgaccacccgagaggtggagaaaggccggaacaaatgcgtcccatactggcccgaggtgggcatgcagcgtgcttatgggccctactctgtgaccaactgcggggagcatgacacaaccgaatacaaactccgtaccttacaggtctccccgctggacaatggagacctgattcgggagatctggcattaccagtacctgagctggcccgaccatggggtccccagtgagcctgggggtgtcctcagcttcctggaccagatcaaccagcggcaggaaagtctgcctcacgcagggcccatcatcgtgcactgcagcgccggcatcggccgcacaggcaccatcattgtcatcgacatgctcatggagaacatctccaccaagggcctggactgtgacattgacatccagaagaccatccagatggtgcgggcgcagcgctcgggcatggtgcagacggaggcgcagtacaagttcatctacgtggccatcgcccagttcattgaaaccactaagaagaagctggaggtcctgcagtcgcagaagggccaggagtcggagtacgggaacatcacctatcccccagccatgaagaatgcccatgccaaggcctcccgcacctcgtccaagagcttggagtctagtgcagggaccgtggctgcgtcacctgtgagacggggtggccagaggggactgccagtgccgggtccccctgtgctgtctcctgacctgcaccaactgcctgtacttgcccccctgcacccggctgcagacacaaggaggatgtgtatgagaacctgcacactaagaacaagagggaggagaaagtgaagaagcagcggtcagcagacaaggagaagagcaagggttccctcaagaggaagtgagcggtgctgtcctcaggtggccatgcctcagccctgaccctgtggaagcatttcgcgatggacagactcacaacctgaacctaggagtgccccattcttttgtaatttaaatggctgcatcccccccacctctccctgaccctgtatatagcccagccaggccccaggcagggccaacccttctcctcttgtaaataaagccctgggatcactgtg

SEQ ID NO: 456240 - DNA, 1891 bp, Homo sapiens
tgccggctgccccaggccagtggagtggcagccccagaactgggaccaccgggggtggtgaggcggcccggcactgggagctgcatctgaggcttagtccctgagctctctgcctgcccagactagctgcacctcctcattccctgcgcccccttcctctccggaagcccccaggatggtgaggtggtttcaccgagacctcagtgggctggatgcagagaccctgctcaagggccgaggtgtccacggtagcttcctggctcggcccagtcgcaagaaccagggtgacttctcgctctccgtcagggtgggggatcaggtgacccatattcggatccagaactcaggggatttctatgacctgtatggaggggagaagtttgcgactctgacagagctggtggagtactacactcagcagcagggtgtcctgcaggaccgcgacggcaccatcatccacctcaagtacccgctgaactgctccgatcccactagtgagaggtggtaccatggccacatgtctggcgggcaggcagagacgctgctgcaggccaagggcgagccctggacgtttcttgtgcgtgagagcctcagccagcctggagacttcgtgctttctgtgctcagtgaccagcccaaggctggcccaggctccccgctcagggtcacccacatcaaggtcatgtgcgagggtggacgctacacagtgggtggtttggagaccttcgacagcctcacggacctggtggagcatttcaagaagacggggattgaggaggcctcaggcgcctttgtctacctgcggcagccgtactatgccacgagggtgaatgcggctgacattgagaaccgagtgttggaactgaacaagaagcaggagtccgaggatacagccaaggctggcttctgggaggagtttgagagtttgcagaagcaggaggtgaagaacttgcaccagcgtctggaagggcagcggccagagaacaagggcaagaaccgctacaagaacattctcccctttgaccacagccgagtgatcctgcagggacgggacagtaacatccccgggtccgactacatcaatgccaactacatcaagaaccagctgctaggccctgatgagaacgctaagacctacatcgccagccagggctgtctggaggccacggtcaatgacttctggcagatggcgtggcaggagaacagccgtgtcatcgtcatgaccacccgagaggtggagaaaggccggaacaaatgcgtcccatactggcccgaggtgggcatgcagcgtgcttatgggccctactctgtgaccaactgcggggagcatgacacaaccgaatacaaactccgtaccttacaggtctccccgctggacaatggagacctgattcgggagatctggcattaccagtacctgagctggcccgaccatggggtccccagtgagcctgggggtgtcctcagcttcctggaccagatcaaccagcggcaggaaagtctgcctcacgcagggcccatcatcgtgcactgcagcgccggcatcggccgcacaggcaccatcattgtcatcgacatgctcatggagaacatctccaccaagggcctggactgtgacattgacatccagaagaccatccagatggtgcgggcgcagcgctcgggcatggtgcagacggaggcgcagtacaagttcatctacgtggccatcgcccagttcattgaaaccactaagaagaagctggaggtcctgcagtcgcagaagggccaggagtcggagtacgggaacatcacctatcccccactctccctgaccctgtatatagcccagccaggccccaggcagggccaacccttctcctcttgtaaataaagccctgggatcactgtg

SEQ ID NO: 456241 - DNA, 2001 bp, Homo sapiens
tgccggctgccccaggccagtggagtggcagccccagaactgggaccaccgggggtggtgaggcggcccggcactgggagctgcatctgaggcttagtccctgagctctctgcctgcccagactagctgcacctcctcattccctgcgcccccttcctctccggaagcccccaggatggtgaggtggtttcaccgagacctcagtgggctggatgcagagaccctgctcaagggccgaggtgtccacggtagcttcctggctcggcccagtcgcaagaaccagggtgacttctcgctctccgtcagggtgggggatcaggtgacccatattcggatccagaactcaggggatttctatgacctgtatggaggggagaagtttgcgactctgacagagctggtggagtactacactcagcagcagggtgtcctgcaggaccgcgacggcaccatcatccacctcaagtacccgctgaactgctccgatcccactagtgagaggtggtaccatggccacatgtctggcgggcaggcagagacgctgctgcaggccaagggcgagccctggacgtttcttgtgcgtgagagcctcagccagcctggagacttcgtgctttctgtgctcagtgaccagcccaaggctggcccaggctccccgctcagggtcacccacatcaaggtcatgtgcgagggtggacgctacacagtgggtggtttggagaccttcgacagcctcacggacctggtggagcatttcaagaagacggggattgaggaggcctcaggcgcctttgtctacctgcggcagccgtactatgccacgagggtgaatgcggctgacattgagaaccgagtgttggaactgaacaagaagcaggagtccgaggatacagccaaggctggcttctgggaggagtttgagagtttgcagaagcaggaggtgaagaacttgcaccagcgtctggaagggcagcggccagagaacaagggcaagaaccgctacaagaacattctcccctttgaccacagccgagtgatcctgcagggacgggacagtaacatccccgggtccgactacatcaatgccaactacatcaagaaccagctgctaggccctgatgagaacgctaagacctacatcgccagccagggctgtctggaggccacggtcaatgacttctggcagatggcgtggcaggagaacagccgtgtcatcgtcatgaccacccgagaggtggagaaaggccggaacaaatgcgtcccatactggcccgaggtgggcatgcagcgtgcttatgggccctactctgtgaccaactgcggggagcatgacacaaccgaatacaaactccgtaccttacaggtctccccgctggacaatggagacctgattcgggagatctggcattaccagtacctgagctggcccgaccatggggtccccagtgagcctgggggtgtcctcagcttcctggaccagatcaaccagcggcaggaaagtctgcctcacgcagggcccatcatcgtgcactgcaggtgaggatgataatcctgatggtagtagtgacagctgagaagtaaatactgctaagtgccatgagctgttataagcaatataaacgttagctcgcacattgagtgccctccgctcacccccggcttctcctgggtcccctcatggctccagaaccctgggtggatcgtggctggaaccagccccactttggccctctgcctgtgggtatcttcctcagagccctctccggatgtaccatctcgcccaaccctgccaaatacagaggaggagcccgggacccagttgctggccaggcccaagctagtcagggcaaggccgggcaggcacccacagtaggcctgtgtcccggctgctccgctttctctcgaggtcccattctgttggtttcttctcccaggaacatctatgaggcatgtgctccccattcctcctctttttccatcggtagccgcagggcttcggct

SEQ ID NO: 456242 - DNA, 1536 bp, Homo sapiens
ccccaggcctgcgacggcctctggcttcctcctcttcccccagcagctgtttgtcctgggacagggcaagtcggctgaatctagaggtgcccccgatgggctgtccggggacgcggctctgtcctgtgctctctcagggacaggcccatccccgagagctaccctcctgctcacccgccacacacacattcacacacttcttgaaagccccatggcctttatttagacgttacaggaaggaagtgggtgtggggggttatttttgacaatctgggtttgaaattagacagcgcgactcagggcatcagcttgctgggctcagctgagggtgggcctggggtctccctgaggtctgtttgcccagggctgggaaaggagagaaacttcctactgcactgctcccctgagtcccctgaccctgtgcccccgcaccctgctgtctcagggctatcctttccctgacgtcagggtttgaaggaaaagggaagtgaagccatgctgagagacgctccataactccttcagggagaggcggggagggctcagggtacctgggagccggcaggacagtggtgggatttgggggtcccaggtcttccggggtgggggcagccactcactaggagtgaggagtcggcgcgaggagtggaggagggaaggatggtggcagctggggagccagcgtcagcaccgcagagcccgaggtggagcgtgtccatgcagagctgggcaaacctccatcatcacttgcccggtgaccctgggcacattccctcccatcactggaggctcaggctgctcctgtggtgcctggggctggagctgagcgctgggtaccccccttcccggggagggcttgactggcctctgatggcacccccgtctttccccagcgccggcatcggccgcacaggcaccatcattgtcatcgacatgctcatggagaacatctccaccaagggcctggactgtgacattgacatccagaagaccatccagatggtgcgggcgcagcgctcgggcatggtgcagacggaggcgcagtacaagttcatctacgtggccatcgcccagttcattgaaaccactaagaagaagctggaggtcctgcagtcgcagaagggccaggagtcggagtacgggaacatcacctatcccccagccatgaagaatgcccatgccaaggcctcccgcacctcgtccaaacacaaggaggatgtgtatgagaacctgcacactaagaacaagagggaggagaaagtgaagaagcagcggtcagcagacaaggagaagagcaagggttccctcaagaggaagtgagcggtgctgtcctcaggtggccatgcctcagccctgaccctgtggaagcatttcgcgatggacagactcacaacctgaacctaggagtgccccattcttttgtaatttaaatggctgcatcccccccacctctccctgaccctgtatatagcccagccaggccccaggcagggccaacccttctcctcttgtaaataaagccctgggatcactgtg

SEQ ID NO: 456243 - DNA, 1135 bp, Homo sapiens
tgccggctgccccaggccagtggagtggcagccccagaactgggaccaccgggggtggtgaggcggcccggcactgggagctgcatctgaggcttagtccctgagctctctgcctgcccagactagctgcacctcctcattccctgcgcccccttcctctccggaagcccccaggatggtgaggtggtttcaccgagacctcagtgggctggatgcagagaccctgctcaagggccgaggtgtccacggtagcttcctggctcggcccagtcgcaagaaccagggtgacttctcgctctccgtcagggtgggggatcaggtgacccatattcggatccagaactcaggggatttctatgacctgtatggaggggagaagtttgcgactctgacagagctggtggagtactacactcagcagcagggtgtcctgcaggaccgcgacggcaccatcatccacctcaagtacccgctgaactgctccgatcccactagtgagaggtggtaccatggccacatgtctggcgggcaggcagagacgctgctgcaggccaagggcgagccctggacgtttcttgtgcgtgagagcctcagccagcctggagacttcgtgctttctgtgctcagtgaccagcccaaggctggcccaggctccccgctcagggtcacccacatcaaggtcatgtgcgagggtggacgctacacagtgggtggtttggagaccttcgacagcctcacggacctggtggagcatttcaagaagacggggattgaggaggcctcaggcgcctttgtctacctgcggcagccgtactatgccacgagggtgaatgcggctgacattgagaaccgagtgttggaactgaacaagaagcaggagtccgaggatacagccaaggctggcttctgggaggagtttgagagtttgcttcactctctagactagagtagaatttcatttggcagtctcctatacaaataatgtgtttatgttttttgacacatactgccagcaggtatgttgaaatacttattttggcaaggagggaacagaggaaggaagaatcatctaatgcttatttttggtaggttggaacttactgaagggacagtagccctgaactgggtctcagga

SEQ ID NO: 456244 - DNA, 933 bp, Homo sapiens
gccctgcagtgccattggcctggcaggcaggatcgaggaggaagtggctgattactgagcggttcttcctcacctggcttgggccactgtgcacagctgtgccgctggctcagccccgccccctgcggccctccgccgtggcttccccctccctacagagagatgctgtcccgtgggtggtttcaccgagacctcagtgggctggatgcagagaccctgctcaagggccgaggtgtccacggtagcttcctggctcggcccagtcgcaagaaccagggtgacttctcgctctccgtcaggtggtaccatggccacatgtctggcgggcaggcagagacgctgctgcaggccaagggcgagccctggacgtttcttgtgcgtgagagcctcagccagcctggagacttcgtgctttctgtgctcagtgaccagcccaaggctggcccaggctccccgctcagggtcacccacatcaaggtcatgtgcgagggtggacgctacacagtgggtggtttggagaccttcgacagcctcacggacctggtggagcatttcaagaagacggggattgaggaggcctcaggcgcctttgtctacctgcggcagccgtactatgccacgagggtgaatgcggctgacattgagaaccgagtgttggaactgaacaagaagcaggagtccgaggatacagccaaggctggcttctgggaggagtttgagagtttgcttcactctctagactagagtagaatttcatttggcagtctcctatacaaataatgtgtttatgttttttgacacatactgccagcaggtatgttgaaatacttattttggcaaggagggaacagaggaaggaagaatcatctaatgcttatttttggtaggttggaacttactgaagggacagtagccctgaactgggtctcagga

SEQ ID NO: 456245 - DNA, 2179 bp, Homo sapiens
tgccggctgccccaggccagtggagtggcagccccagaactgggaccaccgggggtggtgaggcggcccggcactgggagctgcatctgaggcttagtccctgagctctctgcctgcccagactagctgcacctcctcattccctgcgcccccttcctctccggaagcccccaggatggtgaggtggtttcaccgagacctcagtgggctggatgcagagaccctgctcaagggccgaggtgtccacggtagcttcctggctcggcccagtcgcaagaaccagggtgacttctcgctctccgtcagggtgggggatcaggtgacccatattcggatccagaactcaggggatttctatgacctgtatggaggggagaagtttgcgactctgacagagctggtggagtactacactcagcagcagggtgtcctgcaggaccgcgacggcaccatcatccacctcaagtacccgctgaactgctccgatcccactagtgagaggtggtaccatggccacatgtctggcgggcaggcagagacgctgctgcaggccaagggcgagccctggacgtttcttgtgcgtgagagcctcagccagcctggagacttcgtgctttctgtgctcagtgaccagcccaaggctggcccaggctccccgctcagggtcacccacatcaaggtcatgtgcgagggtggacgctacacagtgggtggtttggagaccttcgacagcctcacggacctggtggagcatttcaagaagacggggattgaggaggcctcaggcgcctttgtctacctgcggcagccgtactatgccacgagggtgaatgcggctgacattgagaaccgagtgttggaactgaacaagaagcaggagtccgaggatacagccaaggctggcttctgggaggagtttgagagtttgcagaagcaggaggtgaagaacttgcaccagcgtctggaagggcagcggccagagaacaagggcaagaaccgctacaagaacattctcccctttgaccacagccgagtgatcctgcagggacgggacagtaacatccccgggtccgactacatcaatgccaactacatcaagaaccagctgctaggccctgatgagaacgctaagacctacatcgccagccagggctgtctggaggccacggtcaatgacttctggcagatggcgtggcaggagaacagccgtgtcatcgtcatgaccacccgagaggtggagaaaggccggaacaaatgcgtcccatactggcccgaggtgggcatgcagcgtgcttatgggccctactctgtgaccaactgcggggagcatgacacaaccgaatacaaactccgtaccttacaggtctccccgctggacaatggagacctgattcgggagatctggcattaccagtacctgagctggcccgaccatggggtccccagtgagcctgggggtgtcctcagcttcctggaccagatcaaccagcggcaggaaagtctgcctcacgcagggcccatcatcgtgcactgcagcgccggcatcggccgcacaggcaccatcattgtcatcgacatgctcatggagaacatctccaccaagggcctggactgtgacattgacatccagaagaccatccagatggtgcgggcgcagcgctcgggcatggtgcagacggaggcgcagtacaagttcatctacgtggccatcgcccagttcattgaaaccactaagaagaagctggaggtcctgcagtcgcagaagggccaggagtcggagtacgggaacatcacctatcccccagccatgaagaatgcccatgccaaggcctcccgcacctcgtccaaacacaaggaggatgtgtatgagaacctgcacactaagaacaagagggaggagaaagtgaagaagcagcggtcagcagacaaggagaagagcaagggttccctcaagaggaagtgagcggtgctgtcctcaggtggccatgcctcagccctgaccctgtggaagcatttcgcgatggacagactcacaacctgaacctaggagtgccccattcttttgtaatttaaatggctgcatcccccccacctctccctgaccctgtatatagcccagccaggccccaggcagggccaacccttctcctcttgtaaataaagccctgggatcactgtg

SEQ ID NO: 456246 - DNA, 2263 bp, Homo sapiens
caagaagacggggattgaggaggcctcaggcgcctttgtctacctgcggcagccgtactatgccacgagggtgaatgcggctgacattgagaaccgagtgttggaactgaacaagaagcaggatcgaggaggaagtggctgattactgagcggttcttcctcacctggcttgggccactgtgcacagctgtgccgctggctcagccccgccccctgcggccctccgccgtggcttccccctccctacagagagatgctgtcccgtgggtggtttcaccgagacctcagtgggctggatgcagagaccctgctcaagggccgaggtgtccacggtagcttcctggctcggcccagtcgcaagaaccagggtgacttctcgctctccgtcagggtgggggatcaggtgacccatattcggatccagaactcaggggatttctatgacctgtatggaggggagaagtttgcgactctgacagagctggtggagtactacactcagcagcagggtgtcctgcaggaccgcgacggcaccatcatccacctcaagtacccgctgaactgctccgatcccactagtgagaggtggtaccatggccacatgtctggcgggcaggcagagacgctgctgcaggccaagggcgagccctggacgtttcttgtgcgtgagagcctcagccagcctggagacttcgtgctttctgtgctcagtgaccagcccaaggctggcccaggctccccgctcagggtcacccacatcaaggtcatgtgcgagggtggacgctacacagtgggtggtttggagaccttcgacagcctcacggacctggtggagcatttcaagaagacggggattgaggaggcctcaggcgcctttgtctacctgcggcagccgtactatgccacgagggtgaatgcggctgacattgagaaccgagtgttggaactgaacaagaagcaggagtccgaggatacagccaaggctggcttctgggaggagtttgagagtttgcagaagcaggaggtgaagaacttgcaccagcgtctggaagggcagcggccagagaacaagggcaagaaccgctacaagaacattctcccctttgaccacagccgagtgatcctgcagggacgggacagtaacatccccgggtccgactacatcaatgccaactacatcaagaaccagctgctaggccctgatgagaacgctaagacctacatcgccagccagggctgtctggaggccacggtcaatgacttctggcagatggcgtggcaggagaacagccgtgtcatcgtcatgaccacccgagaggtggagaaaggccggaacaaatgcgtcccatactggcccgaggtgggcatgcagcgtgcttatgggccctactctgtgaccaactgcggggagcatgacacaaccgaatacaaactccgtaccttacaggtctccccgctggacaatggagacctgattcgggagatctggcattaccagtacctgagctggcccgaccatggggtccccagtgagcctgggggtgtcctcagcttcctggaccagatcaaccagcggcaggaaagtctgcctcacgcagggcccatcatcgtgcactgcagcgccggcatcggccgcacaggcaccatcattgtcatcgacatgctcatggagaacatctccaccaagggcctggactgtgacattgacatccagaagaccatccagatggtgcgggcgcagcgctcgggcatggtgcagacggaggcgcagtacaagttcatctacgtggccatcgcccagttcattgaaaccactaagaagaagctggaggtcctgcagtcgcagaagggccaggagtcggagtacgggaacatcacctatcccccagccatgaagaatgcccatgccaaggcctcccgcacctcgtccaaacacaaggaggatgtgtatgagaacctgcacactaagaacaagagggaggagaaagtgaagaagcagcggtcagcagacaaggagaagagcaagggttccctcaagaggaagtgagcggtgctgtcctcaggtggccatgcctcagccctgaccctgtggaagcatttcgcgatggacagactcacaacctgaacctaggagtgccccattcttttgtaatttaaatggctgcatcccccccacctctccctgaccctgtatatagcccagccaggccccaggcagggccaacccttctcctcttgtaaataaagccctgggatcactgtg

SEQ ID NO: 456247 - DNA, 2355 bp, Homo sapiens
caagaagacggggattgaggaggcctcaggcgcctttgtctacctgcggcagccgtactatgccacgagggtgaatgcggctgacattgagaaccgagtgttggaactgaacaagaagcaggatcgaggaggaagtggctgattactgagcggttcttcctcacctggcttgggccactgtgcacagctgtgccgctggctcagccccgccccctgcggccctccgccgtggcttccccctccctacagagagatgctgtcccgtggtgaggtaagggcctgccacccacggtagacaggaggcaagggtgcctggtgcccacgggacccctcctcactgccctgcctgggccgcccaggtggtttcaccgagacctcagtgggctggatgcagagaccctgctcaagggccgaggtgtccacggtagcttcctggctcggcccagtcgcaagaaccagggtgacttctcgctctccgtcagggtgggggatcaggtgacccatattcggatccagaactcaggggatttctatgacctgtatggaggggagaagtttgcgactctgacagagctggtggagtactacactcagcagcagggtgtcctgcaggaccgcgacggcaccatcatccacctcaagtacccgctgaactgctccgatcccactagtgagaggtggtaccatggccacatgtctggcgggcaggcagagacgctgctgcaggccaagggcgagccctggacgtttcttgtgcgtgagagcctcagccagcctggagacttcgtgctttctgtgctcagtgaccagcccaaggctggcccaggctccccgctcagggtcacccacatcaaggtcatgtgcgagggtggacgctacacagtgggtggtttggagaccttcgacagcctcacggacctggtggagcatttcaagaagacggggattgaggaggcctcaggcgcctttgtctacctgcggcagccgtactatgccacgagggtgaatgcggctgacattgagaaccgagtgttggaactgaacaagaagcaggagtccgaggatacagccaaggctggcttctgggaggagtttgagagtttgcagaagcaggaggtgaagaacttgcaccagcgtctggaagggcagcggccagagaacaagggcaagaaccgctacaagaacattctcccctttgaccacagccgagtgatcctgcagggacgggacagtaacatccccgggtccgactacatcaatgccaactacatcaagaaccagctgctaggccctgatgagaacgctaagacctacatcgccagccagggctgtctggaggccacggtcaatgacttctggcagatggcgtggcaggagaacagccgtgtcatcgtcatgaccacccgagaggtggagaaaggccggaacaaatgcgtcccatactggcccgaggtgggcatgcagcgtgcttatgggccctactctgtgaccaactgcggggagcatgacacaaccgaatacaaactccgtaccttacaggtctccccgctggacaatggagacctgattcgggagatctggcattaccagtacctgagctggcccgaccatggggtccccagtgagcctgggggtgtcctcagcttcctggaccagatcaaccagcggcaggaaagtctgcctcacgcagggcccatcatcgtgcactgcagcgccggcatcggccgcacaggcaccatcattgtcatcgacatgctcatggagaacatctccaccaagggcctggactgtgacattgacatccagaagaccatccagatggtgcgggcgcagcgctcgggcatggtgcagacggaggcgcagtacaagttcatctacgtggccatcgcccagttcattgaaaccactaagaagaagctggaggtcctgcagtcgcagaagggccaggagtcggagtacgggaacatcacctatcccccagccatgaagaatgcccatgccaaggcctcccgcacctcgtccaaacacaaggaggatgtgtatgagaacctgcacactaagaacaagagggaggagaaagtgaagaagcagcggtcagcagacaaggagaagagcaagggttccctcaagaggaagtgagcggtgctgtcctcaggtggccatgcctcagccctgaccctgtggaagcatttcgcgatggacagactcacaacctgaacctaggagtgccccattcttttgtaatttaaatggctgcatcccccccacctctccctgaccctgtatatagcccagccaggccccaggcagggccaacccttctcctcttgtaaataaagccctgggatcactgtg

SEQ ID NO: 456248 - DNA, 2140 bp, Homo sapiens
caagaagacggggattgaggaggcctcaggcgcctttgtctacctgcggcagccgtactatgccacgagggtgaatgcggctgacattgagaaccgagtgttggaactgaacaagaagcaggatcgaggaggaagtggctgattactgagcggttcttcctcacctggcttgggccactgtgcacagctgtgccgctggctcagccccgccccctgcggccctccgccgtggcttccccctccctacagagagatgctgtcccgtggggtgggggatcaggtgacccatattcggatccagaactcaggggatttctatgacctgtatggaggggagaagtttgcgactctgacagagctggtggagtactacactcagcagcagggtgtcctgcaggaccgcgacggcaccatcatccacctcaagtacccgctgaactgctccgatcccactagtgagaggtggtaccatggccacatgtctggcgggcaggcagagacgctgctgcaggccaagggcgagccctggacgtttcttgtgcgtgagagcctcagccagcctggagacttcgtgctttctgtgctcagtgaccagcccaaggctggcccaggctccccgctcagggtcacccacatcaaggtcatgtgcgagggtggacgctacacagtgggtggtttggagaccttcgacagcctcacggacctggtggagcatttcaagaagacggggattgaggaggcctcaggcgcctttgtctacctgcggcagccgtactatgccacgagggtgaatgcggctgacattgagaaccgagtgttggaactgaacaagaagcaggagtccgaggatacagccaaggctggcttctgggaggagtttgagagtttgcagaagcaggaggtgaagaacttgcaccagcgtctggaagggcagcggccagagaacaagggcaagaaccgctacaagaacattctcccctttgaccacagccgagtgatcctgcagggacgggacagtaacatccccgggtccgactacatcaatgccaactacatcaagaaccagctgctaggccctgatgagaacgctaagacctacatcgccagccagggctgtctggaggccacggtcaatgacttctggcagatggcgtggcaggagaacagccgtgtcatcgtcatgaccacccgagaggtggagaaaggccggaacaaatgcgtcccatactggcccgaggtgggcatgcagcgtgcttatgggccctactctgtgaccaactgcggggagcatgacacaaccgaatacaaactccgtaccttacaggtctccccgctggacaatggagacctgattcgggagatctggcattaccagtacctgagctggcccgaccatggggtccccagtgagcctgggggtgtcctcagcttcctggaccagatcaaccagcggcaggaaagtctgcctcacgcagggcccatcatcgtgcactgcagcgccggcatcggccgcacaggcaccatcattgtcatcgacatgctcatggagaacatctccaccaagggcctggactgtgacattgacatccagaagaccatccagatggtgcgggcgcagcgctcgggcatggtgcagacggaggcgcagtacaagttcatctacgtggccatcgcccagttcattgaaaccactaagaagaagctggaggtcctgcagtcgcagaagggccaggagtcggagtacgggaacatcacctatcccccagccatgaagaatgcccatgccaaggcctcccgcacctcgtccaaacacaaggaggatgtgtatgagaacctgcacactaagaacaagagggaggagaaagtgaagaagcagcggtcagcagacaaggagaagagcaagggttccctcaagaggaagtgagcggtgctgtcctcaggtggccatgcctcagccctgaccctgtggaagcatttcgcgatggacagactcacaacctgaacctaggagtgccccattcttttgtaatttaaatggctgcatcccccccacctctccctgaccctgtatatagcccagccaggccccaggcagggccaacccttctcctcttgtaaataaagccctgggatcactgtg

SEQ ID NO: 456249 - DNA, 2049 bp, Homo sapiens
tgccggctgccccaggccagtggagtggcagccccagaactgggaccaccgggggtggtgaggcggcccggcactgggagctgcatctgaggcttagtccctgagctctctgcctgcccagactagctgcacctcctcattccctgcgcccccttcctctccggaagcccccaggatggtgaggtggtttcaccgagacctcagtgggctggatgcagagaccctgctcaagggccgaggtgtccacggtagcttcctggctcggcccagtcgcaagaaccagggtgacttctcgctctccgtcaggaccgcgacggcaccatcatccacctcaagtacccgctgaactgctccgatcccactagtgagaggtggtaccatggccacatgtctggcgggcaggcagagacgctgctgcaggccaagggcgagccctggacgtttcttgtgcgtgagagcctcagccagcctggagacttcgtgctttctgtgctcagtgaccagcccaaggctggcccaggctccccgctcagggtcacccacatcaaggtcatgtgcgagggtggacgctacacagtgggtggtttggagaccttcgacagcctcacggacctggtggagcatttcaagaagacggggattgaggaggcctcaggcgcctttgtctacctgcggcagccgtactatgccacgagggtgaatgcggctgacattgagaaccgagtgttggaactgaacaagaagcaggagtccgaggatacagccaaggctggcttctgggaggagtttgagagtttgcagaagcaggaggtgaagaacttgcaccagcgtctggaagggcagcggccagagaacaagggcaagaaccgctacaagaacattctcccctttgaccacagccgagtgatcctgcagggacgggacagtaacatccccgggtccgactacatcaatgccaactacatcaagaaccagctgctaggccctgatgagaacgctaagacctacatcgccagccagggctgtctggaggccacggtcaatgacttctggcagatggcgtggcaggagaacagccgtgtcatcgtcatgaccacccgagaggtggagaaaggccggaacaaatgcgtcccatactggcccgaggtgggcatgcagcgtgcttatgggccctactctgtgaccaactgcggggagcatgacacaaccgaatacaaactccgtaccttacaggtctccccgctggacaatggagacctgattcgggagatctggcattaccagtacctgagctggcccgaccatggggtccccagtgagcctgggggtgtcctcagcttcctggaccagatcaaccagcggcaggaaagtctgcctcacgcagggcccatcatcgtgcactgcagcgccggcatcggccgcacaggcaccatcattgtcatcgacatgctcatggagaacatctccaccaagggcctggactgtgacattgacatccagaagaccatccagatggtgcgggcgcagcgctcgggcatggtgcagacggaggcgcagtacaagttcatctacgtggccatcgcccagttcattgaaaccactaagaagaagctggaggtcctgcagtcgcagaagggccaggagtcggagtacgggaacatcacctatcccccagccatgaagaatgcccatgccaaggcctcccgcacctcgtccaaacacaaggaggatgtgtatgagaacctgcacactaagaacaagagggaggagaaagtgaagaagcagcggtcagcagacaaggagaagagcaagggttccctcaagaggaagtgagcggtgctgtcctcaggtggccatgcctcagccctgaccctgtggaagcatttcgcgatggacagactcacaacctgaacctaggagtgccccattcttttgtaatttaaatggctgcatcccccccacctctccctgaccctgtatatagcccagccaggccccaggcagggccaacccttctcctcttgtaaataaagccctgggatcactgtg

SEQ ID NO: 456250 - DNA, 2150 bp, Homo sapiens
tgccggctgccccaggccagtggagtggcagccccagaactgggaccaccgggggtggtgaggcggcccggcactgggagctgcatctgaggcttagtccctgagctctctgcctgcccagactagctgcacctcctcattccctgcgcccccttcctctccggaagcccccaggatggtgaggtggtttcaccgagacctcagtgggctggatgcagagaccctgctcaagggccgaggtgtccacggtagcttcctggctcggcccagtcgcaagaaccagggtgacttctcgctctccgtcagggtgggggatcaggtgacccatattcggatccagaactcaggggatttctatgacctgtatggaggggagaagtttgcgactctgacagagctggtggagtactacactcagcagcagggtgtcctgcaggaccgcgacggcaccatcatccacctcaagtacccgctgaactgctccgatcccactagtgagaggtggtaccatggccacatgtctggcgggcaggcagagacgctgctgcaggccaagggcgagccctggacgtttcttgtgcgtgagagcctcagccagcctggagacttcgtgctttctgtgctcagtgaccagcccaaggctggcccaggctccccgctcagggtcacccacatcaaggtcatgtgcgagggtggacgctacacagtgggtggtttggagaccttcgacagcctcacggacctggtggagcatttcaagaagacggggattgaggaggcctcaggcgcctttgtctacctgcggcagccgtactatgccacgagggtgaatgcggctgacattgagaaccgagtgttggaactgaacaagaagcaggagtccgaggatacagccaaggctggcttctgggaggagtttgagagtttgcagaagcaggaggtgaagaacttgcaccagcgtctggaagggcagcggccagagaacaagggcaagaaccgctacaagaacattctcccctttgaccacagccgagtgatcctgcagggacgggacagtaacatccccgggtccgactacatcaatgccaactacatcaagaaccagctgctaggccctgatgagaacgctaagacctacatcgccagccagggctgtctggaggccacggtcaatgacttctggcagatggcgtggcaggagaacagccgtgtcatcgtcatgaccacccgagaggtggagaaaggccggaacaaatgcgtcccatactggcccgaggtgggcatgcagcgtgcttatgggccctactctgtgaccaactgcggggagcatgacacaaccgaatacaaactccgtaccttacaggtctccccgctggacaatggagacctgattcgggagatctggcattaccagtacctgagctggcccgaccatggggtccccagtgagcctgggggtgtcctcagcttcctggaccagatcaaccagcggcaggaaagtctgcctcacgcagggcccatcatcgtgcactgcagcgccggcatcggccgcacaggcaccatcattgtcatcgacatgctcatggagaacatctccaccaagggcctggactgtgacattgacatccagaagaccatccagatggtgcgggcgcagcgctcgggcatggtgcagacggaggcgcagtacaagttcatctacgtggccatcgcccagttcattgaaaccactaagaagaagctggaggtcctgcagtcgcagaagggccaggagtcggagtacgggaacatcacctatcccccagccatgaagaatgcccatgccaaggcctcccgcacctcgtccaaacacaaggaggatgtgtatgagaacctgcacactaagaacaagagggaggagaaagtgaagaagcagcggtcagcagacaaggagaagagcaagggttccctcaagaggaacctcagccctgaccctgtggaagcatttcgcgatggacagactcacaacctgaacctaggagtgccccattcttttgtaatttaaatggctgcatcccccccacctctccctgaccctgtatatagcccagccaggccccaggcagggccaacccttctcctcttgtaaataaagccctgggatcactgtg

SEQ ID NO: 456251 - DNA, 1237 bp, Homo sapiens
gaggatcccattggatatgcggatagggcagcggccagagaacaagggcaagaaccgctacaagaacattctcccctttgaccacagccgagtgatcctgcagggacgggacagtaacatccccgggtccgactacatcaatgccaactacatcaagaaccagctgctaggccctgatgagaacgctaagacctacatcgccagccagggctgtctggaggccacggtcaatgacttctggcagatggcgtggcaggagaacagccgtgtcatcgtcatgaccacccgagaggtggagaaaggccggaacaaatgcgtcccatactggcccgaggtgggcatgcagcgtgcttatgggccctactctgtgaccaactgcggggagcatgacacaaccgaatacaaactccgtaccttacaggtctccccgctggacaatggagacctgattcgggagatctggcattaccagtacctgagctggcccgaccatggggtccccagtgagcctgggggtgtcctcagcttcctggaccagatcaaccagcggcaggaaagtctgcctcacgcagggcccatcatcgtgcactgcagcgccggcatcggccgcacaggcaccatcattgtcatcgacatgctcatggagaacatctccaccaagggcctggactgtgacattgacatccagaagaccatccagatggtgcgggcgcagcgctcgggcatggtgcagacggaggcgcagtacaagttcatctacgtggccatcgcccagttcattgaaaccactaagaagaagctggaggtcctgcagtcgcagaagggccaggagtcggagtacgggaacatcacctatcccccagccatgaagaatgcccatgccaaggcctcccgcacctcgtccaaacacaaggaggatgtgtatgagaacctgcacactaagaacaagagggaggagaaagtgaagaagcagcggtcagcagacaaggagaagagcaagggttccctcaagaggaagtgagcggtgctgtcctcaggtggccatgcctcagccctgaccctgtggaagcatttcgcgatggacagactcacaacctgaacctaggagtgccccattcttttgtaatttaaatggctgcatcccccccacctctccctgaccctgtatatagcccagccaggccccaggcagggccaacccttctcctcttgtaaataaagccctgggatcactgtg

SEQ ID NO: 456252 - DNA, 1127 bp, Homo sapiens
tgccggctgccccaggccagtggagtggcagccccagaactgggaccaccgggggtggtgaggcggcccggcactgggagctgcatctgaggcttagtccctgagctctctgcctgcccagactagctgcacctcctcattccctgcgcccccttcctctccggaagcccccaggatggtgaggtggtttcaccgagacctcagtgggctggatgcagagaccctgctcaagggccgaggtgtccacggtagcttcctggctcggcccagtcgcaagaaccagggtgacttctcgctctccgtcagggtgggggatcaggtgacccatattcggatccagaactcaggggatttctatgacctgtatggaggggagaagtttgcgactctgacagagctggtggagtactacactcagcagcagggtgtcctgcaggaccgcgacggcaccatcatccacctcaagtacccgctgaactgctccgatcccactagtgagaggtggtaccatggccacatgtctggcgggcaggcagagacgctgctgcaggccaagggcgagccctggacgtttcttgtgcgtgagagcctcagccagcctggagacttcgtgctttctgtgctcagtgaccagcccaaggctggcccaggctccccgctcagggtcacccacatcaaggtcatgtgcgagggtggacgctacacagtgggtggtttggagaccttcgacagcctcacggacctggtggagcatttcaagaagacggggattgaggaggcctcaggcgcctttgtctacctgcggcagccgtactatgccacgagggtgaatgcggctgacattgagaaccgagtgttggaactgaacaagaagcaggagtccgaggatacagccaaggctggcttctgggaggagtttgagagtttgcagaagcaggaggtgaagaacttgcaccagcgtctggaagggcagcggccagagaacaagggcaagaaccgctacaagaacattctcccctgtgagcacccaggctgccccattcacccaggataccgccccctgcccagctgcctcccctcatctcacaggtctccaccctccacgccaggaggggccatctccccac

SEQ ID NO: 456253 - DNA, 755 bp, Homo sapiens
tgccggctgccccaggccagtggagtggcagccccagaactgggaccaccgggggtggtgaggcggcccggcactgggagctgcatctgaggcttagtccctgagctctctgcctgcccagactagctgcacctcctcattccctgcgcccccttcctctccggaagcccccaggatggtgaggtggtttcaccgagacctcagtgggctggatgcagagaccctgctcaagggccgaggtgtccacggtagcttcctggctcggcccagtcgcaagaaccagggtgacttctcgctctccgtcagggtgggggatcaggtgacccatattcggatccagaactcaggggatttctatgacctgtatggaggggagaagtttgcgactctgacagagctggtggagtactacactcagcagcagggtgtcctgcaggaccgcgacggcaccatcatccacctcaagtacccgctgaactgctccgatcccactagtgagaggtggtaccatggccacatgtctggcgggcaggcagagacgctgctgcaggccaagggcgagcccctcagccctgaccctgtggaagcatttcgcgatggacagactcacaacctgaacctaggagtgccccattcttttgtaatttaaatggctgcatcccccccacctctccctgaccctgtatatagcccagccaggccccaggcagggccaacccttctcctcttgtaaataaagccctgggatcactgtg

SEQ ID NO: 456254 - DNA, 196 bp, Homo sapiens
ggaggagaaagtgaagaagcagcggtcagcagacaaggagaagagcaagggttccctcaagaggaagtgagcggtgctgtcctcaggtggccatggtacagctcttctgcctgggtgtcctccctgccctgccctgtgtccttggctccactgccttccctgggtggatggggtggccgcagcctcattctgtgct

SEQ ID NO: 456255 - DNA, 3371 bp, Homo sapiens
aggcggggcaccctgaggggcggggaaggactagggtgcggggagggggttgcaaaaggagccgagcggcttctgctcaatggcggaaaagccgccggtgctctgacggcctcgttcccctagcagttgcgggggagtttcctgccggcgcggctggagtctctgattctcagggttcggtggttggaagatgctccagagagacgaggctgcggcggaggaggtggcggcggccgaatcggcaacggcgctagggtggagagaaggcggcagcggcggcggcggcggcgtgaggggccgggcggtgtaaacagccccggaggcggcggaggcggcggtcgagaccccgagggggaagcggcggctgagtcagggtcgcgcctccgttggaaacttgggctgagtaccgcggcgggcgcgagcgaggcgccctagacatcttctccctcccttgcctcagatttattgctaaacatgggtgcatttttggataaacccaaaactgaaaaacataatgctcatggtgctgggaatggtttacgttatggcctgagcagcatgcaaggatggagagtggaaatggaagatgcacacacagctgttgtaggtattcctcacggcttggaagactggtcattttttgcagtttatgatggtcatgctggatcccgagtggcaaattactgctcaacacatttattagaacacatcactactaacgaagactttagggcagctggaaaatcaggatctgctcttgagctttcagtggaaaatgttaagaatggtatcagaactggatttttgaaaattgatgaatacatgcgtaacttttcagacctcagaaacgggatggacaggagtggttcaactgcagtgggagttatgatttcacctaagcatatctactttatcaactgtggtgattcacgtgctgttctgtataggaatggacaagtctgcttttctacccaggatcacaaaccttgcaatccaagggaaaaggagcgaatccaaaatgcaggaggcagcgtgatgatacaacgtgttaatggttcattagcagtatctcgtgctctgggggactatgattacaagtgtgttgatggcaagggcccaacagaacaacttgtttctccagagcctgaggtttatgaaattttaagagcagaagaggatgaatttatcatcttggcttgtgatgggatctgggatgttatgagtaatgaggagctctgtgaatatgttaaatctaggcttgaggtatctgatgacctggaaaatgtgtgcaattgggtagtggacacttgtttacacaagggaagtcgagataacatgagtattgtactagtttgcttttcaaatgctcccaaggtctcagatgaagcggtgaaaaaagattcagagttggataagcacttggaatcacgggttgaagagattatggagaagtctggcgaggaaggaatgcctgatcttgcccatgtcatgcgcatcttgtctgcagaaaatatcccaaatttgcctcctgggggaggtcttgctggcaagcgtaatgttattgaagctgtttatagtagactgaatccacatagagaaagtgatgggggtgctggagatctagaagacccatggtagccttaaaaaccttctaaaatgcttttgattctgaaaattgggggaaaaaacttttaatcacaattttcttcaatacaaggggaaaatattcttgcggattcccaacgttttgtgatatgagcagaaaatcattagcatttcccatcatttgttcatatttgtgttttctgacagttgccacttgtagcattgcctgtactacagtattttttgccaacctcaggcatactcgttacatctgtattgaactttcggccctagaaaccagtggagttatttcaccacaaatcaacaatgtgcctgaggtgcatgggaaatatagttagctatactctgaaaatacattatgttttttttctttaaacaaaacacacaacatgtaagcatgtaagagtaaagaattgtatgatatgttccttttttcagttcaccaagttggaagccttttgcagctctgtggcttggaatttcatttgagcaatttctataggatatgtatttattattgattgttatttaatttttttccaattttacctgtattaccaaactgggttctccaataatgtccaaattgtaatgttgccttgcttcaagataaagtgtatttgggaataatattataaacccttacaaattttatgcatgtatctactgcatccttcaactctcactagaaaatcttttgaaaccaaatggattaatttatggctatttataatttgctttgacatctcactgttggaaattttttaaagatgagatttgcctttataatgtaaattgtgatttttgttttacatgtgggtttctatagttttaattttttcagcttttaagatacgagttttgtgtaatttggtatttttaatcatttatgttattttaaaagctcagaatatcacattgaaattactataaatacatttaaaattatctattttagatctaaggaaatactacagagatattttcatgggttcagtaacttttcattttataacattgggcacggtacagagtgattgtcacataaggtacttgaagatttattagtttaattctatttttacagtaaccttgaattcttctgagttttgcatgtattaaattcaattaatgctgaacatgaagagtaaagtatttatctgaaagaagtttctgggttaggagaagtaatgaatgtatccatttgtacatggtttacatgttgtggatgctttgtaaacattttcctgtatgtttaaattgtgtttcagcaggatgtaattgcccttgtgtgtagttaaaatgagtcatcatctggtcctttgtgaaatggaattcatggtattttctgtaacgttttcctgaagctgtttctggagagccacacatttaaatacagacagctttcctgatcatttgatttattgtgcacctgatttttggtctaaaaggaattattgccacaatatattttatttattctttagattttagccttgtaagttaaagtgctttacatgatgatgtgaaaagctgtttgtccctttactgggtttggggggttgttaaaagatagggaatgaagaatgcaaaatggtttatcgttcaaactgtccactctgatccaaccctgtactgatagtacttcccagtatgatattgtgatgtttcatacaatgcagtgaacataaccaacttgttacctaaataaagaattgataaaaacagtgtgacatattaaaaaa

SEQ ID NO: 456256 - DNA, 2668 bp, Homo sapiens
aggcggggcaccctgaggggcggggaaggactagggtgcggggagggggttgcaaaaggagccgagcggcttctgctcaatggcggaaaagccgccggtgctctgacggcctcgttcccctagcagttgcgggggagtttcctgccggcgcggctggagtctctgattctcagggttcggtggttggaagatgctccagagagacgaggctgcggcggaggaggtggcggcggccgaatcggcaacggcgctagggtggagagaaggcggcagcggcggcggcggcggcgtgaggggccgggcggtgtaaacagccccggaggcggcggaggcggcggtcgagaccccgagggggaagcggcggctgagtcagggtcgcgcctccgttggaaacttgggctgagtaccgcggcgggcgcgagcgaggcgccctagacatcttctccctcccttgcctcagatttattgctaaacatgggtgcatttttggataaacccaaaactgaaaaacataatgctcatggtgctgggaatggtttacgttatggcctgagcagcatgcaaggatggagagtggaaatggaagatgcacacacagctgttgtaggtattcctcacggcttggaagactggtcattttttgcagtttatgatggtcatgctggatcccgagtggcaaattactgctcaacacatttattagaacacatcactactaacgaagactttagggcagctggaaaatcaggatctgctcttgagctttcagtggaaaatgttaagaatggtatcagaactggatttttgaaaattgatgaatacatgcgtaacttttcagacctcagaaacgggatggacaggagtggttcaactgcagtgggagttatgatttcacctaagcatatctactttatcaactgtggtgattcacgtgctgttctgtataggaatggacaagtctgcttttctacccaggatcacaaaccttgcaatccaagggaaaaggagcgaatccaaaatgcaggaggcagcgtgatgatacaacgtgttaatggttcattagcagtatctcgtgctctgggggactatgattacaagtgtgttgatggcaagggcccaacagaacaacttgtttctccagagcctgaggtttatgaaattttaagagcagaagaggatgaatttatcatcttggcttgtgatgggatctgggatgttatgagtaatgaggagctctgtgaatatgttaaatctaggcttgaggtatctgatgacctggaaaatgtgtgcaattgggtagtggacacttgtttacacaagggaagtcgagataacatgagtattgtactagtttgcttttcaaatgctcccaaggtctcagatgaagcggtgaaaaaagattcagagttggataagcacttggaatcacgggttgaagagattatggagaagtctggcgaggaaggaatgcctgatcttgcccatgtcatgcgcatcttgtctgcagaaaatatcccaaatttgcctcctgggggaggtcttgctggcaagcgtaatgttattgaagctgtttatagtagactgaatccacatagagaaagtgatggggcctccgatgaagcagaggaaagtggatcacagggaaaattggtggaagctctcaggcaaatgagaattaatcataggggaaactaccgacaacttctggaggagatgctgactagttacaggctagctaaagtagagggagaagaaagccctgctgaaccagctgccacagctacttcttcgaacagtgatgctggaaacccagtgacaatgcaggaaagccatactgaatcagaaagtggtcttgctgaattagacagctctaatgaagatgcagggacaaagatgagtggtgaaaaaatatgactttcctttttggtaatatttttgtgatctttgatggtttttaacctaggaagtgtaatgtatgcatttatataactgttttgttatttgaatcttggaaaactagttttattatattcagatagccttgttttttaaaaaggcctttgcatacacctttatgagatagtgtaaaattgactatttatagtactatggatttaatgaaattatatgtcatttcacattgtatgccagaaattaggctaccaattatgaattaaagtcagtagttaaattaatactagatagaattagaaattttgattagagagattatgctatattatggaaaaacttgttaatgtagaattatactgcttcatattattttacctattagtacactcatagttagctttgtaataaatttatgttttctttaataattttagttcttcaaagaatggctgatgctggcctgtaatttttctttcaaggatgataatttgtgtgttgtttgatttgtttatattttacatctctgtagttttatttttagaagttgtgagatattggatgtgtggctatttttcctttctctgtattctttatgaaacataacttttgaaaaacctatgtattattcatacagctttggtttgtatattctgtatagcctaactacacacatcaaaatgtatgtcaaccaagtgtttagaatgaaattataagtgtttaagtccaaataaagcatgtgatgtggaataatcta

SEQ ID NO: 456257 - DNA, 157 bp, Homo sapiens
atgttatccccaacacctatccccaacacctggaaacccagtgacaatgcaggaaagccatactgaatcagaaagtggtcttgctgaattagacagctctaatgaagatgcagggacaaagatgagtgggtgttgggcgataacatccgggatcctc

SEQ ID NO: 456258 - DNA, 3317 bp, Homo sapiens
aggcggggcaccctgaggggcggggaaggactagggtgcggggagggggttgcaaaaggagccgagcggcttctgctcaatggcggaaaagccgccggtgctctgacggcctcgttcccctagcagttgcgggggagtttcctgccggcgcggctggagtctctgattctcagggttcggtggttggaagatgctccagagagacgaggctgcggcggaggaggtggcggcggccgaatcggcaacggcgctagggtggagagaaggcggcagcggcggcggcggcggcgtgaggggccgggcggtgtaaacagccccggaggcggcggaggcggcggtcgagaccccgagggggaagcggcggctgagtcagggtcgcgcctccgttggaaacttgggctgagtaccgcggcgggcgcgagcgaggcgccctagacatcttctccctcccttgcctcagatttattgctaaacatgggtgcatttttggataaacccaaaactgaaaaacataatgctcatggtgctgggaatggtttacgttatggcctgagcagcatgcaaggatggagagtggaaatggaagatgcacacacagctgttgtaggtattcctcacggcttggaagactggtcattttttgcagtttatgatggtcatgctggatcccgagtggcaaattactgctcaacacatttattagaacacatcactactaacgaagactttagggcagctggaaaatcaggatctgctcttgagctttcagtggaaaatgttaagaatggtatcagaactggatttttgaaaattgatgaatacatgcgtaacttttcagacctcagaaacgggatggacaggagtggttcaactgcagtgggagttatgatttcacctaagcatatctactttatcaactgtggtgattcacgtgctgttctgtataggaatggacaagtctgcttttctacccaggatcacaaaccttgcaatccaagggaaaaggagcgaatccaaaatgcaggaggcagcgtgatgatacaacgtgttaatggttcattagcagtatctcgtgctctgggggactatgattacaagtgtgttgatggcaagggcccaacagaacaacttgtttctccagagcctgaggtttatgaaattttaagagcagaagaggatgaatttatcatcttggcttgtgatgggatctgggatgttatgagtaatgaggagctctgtgaatatgttaaatctaggcttgaggtatctgatgacctggaaaatgtgtgcaattgggtagtggacacttgtttacacaagggaagtcgagataacatgagtattgtactagtttgcttttcaaatgctcccaaggtctcagatgaagcggtgaaaaaagattcagagttggataagcacttggaatcacgggttgaagagattatggagaagtctggcgaggaaggaatgcctgatcttgcccatgtcatgcgcatcttgtctgcagaaaatatcccaaatttgcctcctgggggaggtcttgctggcaagcgtaatgttattgaagctgtttatagtagactgaatccacatagagaaagtgatgggggtgctggagatctagaagacccatggtagccttaaaaaccttctaaaatgcttttgattctgaaaattgggggaaaaaacttttaatcacaattttcttcaatacaaggggaaaatattcttgcggattcccaacgttttgtgatatgagcagaaaatcattagcatttcccatcatttgttcatatttgtgttttctgacagttgccacttgtagcattgcctgtactacagtattttttgccaacctcaggcatactcgttacatctgtattgaactttcggccctagaaaccagtggagttatttcaccacaaatcaacaatgtgcctgaggtgcatgggaaatatagttagctatactctgaaaatacattatgttttttttctttaaacaaaacacacaacatgtaagcatgtaagagtaaagaattgtatgatatgttccttttttcagttcaccaagttggaagccttttgcagctctgtggcttggaatttcatttgagcaatttctataggatatgtatttattattgattgttatttaatttttttccaattttacctgtattaccaaactgggttctccaataatgtccaaattgtaatgttgccttgcttcaagataaagtgtatttgggaataatattataaacccttacaaattttatgcatgtatctactgcatccttcaactctcactagaaaatcttttgaaaccaaatggattaatttatggctatttataatttgctttgacatctcactgttggaaattttttaaagatgagatttgcctttataatgtaaattgtgatttttgttttacatgtgggtttctatagttttaattttttcagcttttaagatacgagttttgtgtaatttggtatttttaatcatttatgttattttaaaagctcagaatatcacattgaaattactataaatacatttaataacttttcattttataacattgggcacggtacagagtgattgtcacataaggtacttgaagatttattagtttaattctatttttacagtaaccttgaattcttctgagttttgcatgtattaaattcaattaatgctgaacatgaagagtaaagtatttatctgaaagaagtttctgggttaggagaagtaatgaatgtatccatttgtacatggtttacatgttgtggatgctttgtaaacattttcctgtatgtttaaattgtgtttcagcaggatgtaattgcccttgtgtgtagttaaaatgagtcatcatctggtcctttgtgaaatggaattcatggtattttctgtaacgttttcctgaagctgtttctggagagccacacatttaaatacagacagctttcctgatcatttgatttattgtgcacctgatttttggtctaaaaggaattattgccacaatatattttatttattctttagattttagccttgtaagttaaagtgctttacatgatgatgtgaaaagctgtttgtccctttactgggtttggggggttgttaaaagatagggaatgaagaatgcaaaatggtttatcgttcaaactgtccactctgatccaaccctgtactgatagtacttcccagtatgatattgtgatgtttcatacaatgcagtgaacataaccaacttgttacctaaataaagaattgataaaaacagtgtgacatattaaaaaa

SEQ ID NO: 456259 - DNA, 3418 bp, Homo sapiens
aggcggggcaccctgaggggcggggaaggactagggtgcggggagggggttgcaaaaggagccgagcggcttctgctcaatggcggaaaagccgccggtgctctgacggcctcgttcccctagcagttgcgggggagtttcctgccggcgcggctggagtctctgattctcagggttcggtggttggaagatgctccagagagacgaggctgcggcggaggaggtggcggcggccgaatcggcaacggcgctagggtggagagaaggcggcagcggcggcggcggcggcgtgaggggccgggcggtgtaaacagccccggaggcggcggaggcggcggtcgagaccccgagggggaagcggcggctgagtcagggtcgcgcctccgttggaaacttgggctgagtaccgcggcgggcgcgagcgaggcgccctagacatcttctccctcccttgcctcagatttattgctaaacatgggtgcatttttggataaacccaaaactgaaaaacataatgctcatggtgctgggaatggtttacgttatggcctgagcagcatgcaaggatggagagtggaaatggaagatgcacacacagctgttgtaggtattcctcacggcttggaagactggtcattttttgcagtttatgatggtcatgctggatcccgagtggcaaattactgctcaacacatttattagaacacatcactactaacgaagactttagggcagctggaaaatcaggatctgctcttgagctttcagtggaaaatgttaagaatggtatcagaactggatttttgaaaattgatgaatacatgcgtaacttttcagacctcagaaacgggatggacaggagtggttcaactgcagtgggagttatgatttcacctaagcatatctactttatcaactgtggtgattcacgtgctgttctgtataggaatggacaagtctgcttttctacccaggatcacaaaccttgcaatccaagggaaaaggagcgaatccaaaatgcaggaggcagcgtgatgatacaacgtgttaatggttcattagcagtatctcgtgctctgggggactatgattacaagtgtgttgatggcaagggcccaacagaacaacttgtttctccagagcctgaggtttatgaaattttaagagcagaagaggatgaatttatcatcttggcttgtgatgggatctgggatgttatgagtaatgaggagctctgtgaatatgttaaatctaggcttgaggtatctgatgacctggaaaatgtgtgcaattgggtagtggacacttgtttacacaagggaagtcgagataacatgagtattgtactagtttgcttttcaaatgctcccaaggtctcagatgaagcggtgaaaaaagattcagagttggataagcacttggaatcacgggttgaagagattatggagaagtctggcgaggaaggaatgcctgatcttgcccatgtcatgcgcatcttgtctgcagaaaatatcccaaatttgcctcctgggggaggtcttgctggcaagcgtaatgttattgaagctgtttatagtagactgaatccacatagagaaagtgatggggcctccgatgaagcagaggaaagtggatcacagggaaaattggtggaagctctcaggcaaatgagaattaatcataggggaaactaccgacaacttctggaggagatgctgactagttacaggctagctaaagtagagggagaagaaagccctgctgaaccagctgccacagctacttcttcgaacagtgatgctggaaacccagtgacaatgcaggaaagccatactgaatcagaaagtggtcttgctgaattagacagctctaatgaagatgcagggacaaagatgagtggtgaaaaaatatgactttcctttttggtaatatttttgtgatctttgatggtttttaacctaggaagtgtaatgtatgcatttatataactgttttgttatttgaatcttggaaaactagttttattatattcagatagccttgttttttaaaaaggcctttgcatacacctttatgagatagtgtaaaattgactatttatagtactatggatttaatgaaattatatgtcatttcacattgtatgccagaaattaggctaccaattatgaattaaagtcagtagttaaattaatactagatagaattagaaattttgattagagagattatgctatattatggaaaaacttgttaatgtagaattatactgcttcatattattttacctattagtacactcatagttagctttgtaataaatttatgttttctttaataattttagttcttcaaagaatggctgatgctggcctgtaatttttctttcaaggatgataatttgtgtgttgtttgatttgtttatattttacatctctgtagttttatttttagaagttgtgagatattggatgtgtggctatttttcctttctctgtattctttatgaaacataacttttgaaaaacctatgtattattcatacagctttggtttgtatattctgtatagcctaactacacacatcaaaatgtatgtcaaccaagtgtttagaatgaaattataagtgtttaagtccaaataaagcatgtgatgtggaataatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaggggggggggggcaagtaaacatacttcccgaggggggcacactgaagtaccaccacaccccagcttttgttcgtcgaagaaagcaggggcccctaattatgatggagaagtatcataactaaagccagcagccggcgggcacgcctgattaaaaacaacgcgcgagcgacgaagaaacacgactgtatggtaggatagaatgtgtgaagagcaacaaacaaataataagagtagggagagaaaacagaagtgacaccactcacaagaaaaaattacacgccaggggggatacataaaacaaccagcgacgagtggatgatggggcaacacagcagtcattagtcaggcagagaagaaagcagccccaggaggtattctcgagaaaatatcaaccgcggggtcgatagtaataagagccgatcgctgccactcgactacaccgaaccaagagccacgacactagccatcagtacacaagacaagcagcgtgagacgacaaacaacaacccagcgaaccagacgacccactcgaaacacgcaatcgcagacacatagaccgaatcgatcgaggatcgagagaatcgaccgccacgcagggaccagccacttaggcacacaccagccagcacaagtgcaacaatgctgtcacacaaaaaact

SEQ ID NO: 456260 - DNA, 2831 bp, Homo sapiens
aggcggggcaccctgaggggcggggaaggactagggtgcggggagggggttgcaaaaggagccgagcggcttctgctcaatggcggaaaagccgccggtgctctgacggcctcgttcccctagcagttgcgggggagtttcctgccggcgcggctggagtctctgattctcagggttcggtggttggaagatgctccagagagacgaggctgcggcggaggaggtggcggcggccgaatcggcaacggcgctagggtggagagaaggcggcagcggcggcggcggcggcgtgaggggccgggcggtgtaaacagccccggaggcggcggaggcggcggtcgagaccccgagggggaagcggcggctgagtcagggtcgcgcctccgttggaaacttgggctgagtaccgcggcgggcgcgagcgaggcgccctagacatcttctccctcccttgcctcagatttattgctaaacatgggtgcatttttggataaacccaaaactgaaaaacataatgctcatggtgctgggaatggtttacgttatggcctgagcagcatgcaaggatggagagtggaaatggaagatgcacacacagctgttgtaggtattcctcacggcttggaagactggtcattttttgcagtttatgatggtcatgctggatcccgagtggcaaattactgctcaacacatttattagaacacatcactactaacgaagactttagggcagctggaaaatcaggatctgctcttgagctttcagtggaaaatgttaagaatggtatcagaactggatttttgaaaattgatgaatacatgcgtaacttttcagacctcagaaacgggatggacaggagtggttcaactgcagtgggagttatgatttcacctaagcatatctactttatcaactgtggtgattcacgtgctgttctgtataggaatggacaagtctgcttttctacccaggatcacaaaccttgcaatccaagggaaaaggagcgaatccaaaatgcaggaggcagcgtgatgatacaacgtgttaatggttcattagcagtatctcgtgctctgggggactatgattacaagtgtgttgatggcaagggcccaacagaacaacttgtttctccagagcctgaggtttatgaaattttaagagcagaagaggatgaatttatcatcttggcttgtgatgggatctgggatgttatgagtaatgaggagctctgtgaatatgttaaatctaggcttgaggtatctgatgacctggaaaatgtgtgcaattgggtagtggacacttgtttacacaagggaagtcgagataacatgagtattgtactagtttgcttttcaaatgctcccaaggtctcagatgaagcggtgaaaaaagattcagagttggataagcacttggaatcacgggttgaagagattatggagaagtctggcgaggaaggaatgcctgatcttgcccatgtcatgcgcatcttgtctgcagaaaatatcccaaatttgcctcctgggggaggtcttgctggcaagcgtaatgttattgaagctgtttatagtagactgaatccacatagagaaagtgatggggcctccgatgaagcagaggaaagtggatcacagggaaaattggtggaagctctcaggcaaatgagaattaatcataggggaaactaccgacaacttctggaggagatgctgactagttacaggctagctaaagtagagggagaagaaagccctgctgaaccagctgccacagctacttcttcgaacagtgatgctggaaacccagtgacaatgcaggaaagccatactgaatcagaaagtggtcttgctgaattagacagctctaatgaagatgcagggacaaagatgagtggtgaaaaaatatgactttcctttttggtaatatttttgtgatctttgatggtttttaacctaggaagtgtaatgtatgcatttatataactgttttgttatttgaatcttggaaaactagttttattatattcagatagccttgttttttaaaaaggcctttgcatacacctttatgagatagtgtaaaattgactatttatagtactatggatttaatgaaattatatgtcatttcacattgtatgccagaaattaggctaccaattatgaattaaagtcagtagttaaattaatactagatagaattagaaattttgattagagagattatgctatattatggaaaaacttgttaatgtagaattatactgcttcatattattttacctattagtacactcatagttagctttgtaataaatttatgttttctttaataattttagttcttcaaagaatggctgatgctggcctgtaatttttctttcaaggatgataatttgtgtgttgtttgatttgtttatattttacatctctgtagttttatttttagaagttgtgagatattggatgtgtggctatttttcctttctctgtattctttatgaaacataacttttgaaaaacctatgtattattcatacagctttggtttgtatattctgtatagcctaactacacacatcaaaatgtatgtcaaccaagtgtttagaatgaaattataagtgtttaagtccaaataaagcatgtgatgtggaataatctaattttaaattatatattataccagaatttttattaaaatgaatctatgtttatttttgtaataataaaaaaaaaatcttggaggggggtcccgttaccaatttccccttttttggagtgctttaaaatttaattggccggttttttaaacctttgtatgtgaa

SEQ ID NO: 456261 - DNA, 2137 bp, Homo sapiens
tcgtctttacgtttatatttatatcatgtgtctaaagttgctttaagttaccataaattgaaacttcggaatctttggatgttatagctgatgttttgatgtatttttccaatgccagaatatttttaagtgctttgagaaaggaaggcatttgatggagaggggaggaaaataacccaacccagttatctatccatattagatacacgtgtacacacacaatatgcaatacacaacatctctctgtaaaagtacccttttcagacaaagaaaggaaggtaatttgttcatcaattttgttttcttttgaaattcaatccaatctggaagtggcataggtaaataataatattcttccttttctcttcctgtagggtgctggagatctagaagacccatggtagccttaaaaaccttctaaaatgcttttgattctgaaaattgggggaaaaaacttttaatcacaattttcttcaatacaaggggaaaatattcttgcggattcccaacgttttgtgatatgagcagaaaatcattagcatttcccatcatttgttcatatttgtgttttctgacagttgccacttgtagcattgcctgtactacagtattttttgccaacctcaggcatactcgttacatctgtattgaactttcggccctagaaaccagtggagttatttcaccacaaatcaacaatgtgcctgaggtgcatgggaaatatagttagctatactctgaaaatacattatgttttttttctttaaacaaaacacacaacatgtaagcatgtaagagtaaagaattgtatgatatgttccttttttcagttcaccaagttggaagccttttgcagctctgtggcttggaatttcatttgagcaatttctataggatatgtatttattattgattgttatttaatttttttccaattttacctgtattaccaaactgggttctccaataatgtccaaattgtaatgttgccttgcttcaagataaagtgtatttgggaataatattataaacccttacaaattttatgcatgtatctactgcatccttcaactctcactagaaaatcttttgaaaccaaatggattaatttatggctatttataatttgctttgacatctcactgttggaaattttttaaagatgagatttgcctttataatgtaaattgtgatttttgttttacatgtgggtttctatagttttaattttttcagcttttaagatacgagttttgtgtaatttggtatttttaatcatttatgttattttaaaagctcagaatatcacattgaaattactataaatacatttaaaattatctattttagatctaaggaaatactacagagatattttcatgggttcagtaacttttcattttataacattgggcacggtacagagtgattgtcacataaggtacttgaagatttattagtttaattctatttttacagtaaccttgaattcttctgagttttgcatgtattaaattcaattaatgctgaacatgaagagtaaagtatttatctgaaagaagtttctgggttaggagaagtaatgaatgtatccatttgtacatggtttacatgttgtggatgctttgtaaacattttcctgtatgtttaaattgtgtttcagcaggatgtaattgcccttgtgtgtagttaaaatgagtcatcatctggtcctttgtgaaatggaattcatggtattttctgtaacgttttcctgaagctgtttctggagagccacacatttaaatacagacagctttcctgatcatttgatttattgtgcacctgatttttggtctaaaaggaattattgccacaatatattttatttattctttagattttagccttgtaagttaaagtgctttacatgatgatgtgaaaagctgtttgtccctttactgggtttggggggttgttaaaagatagggaatgaagaatgcaaaatggtttatcgttcaaactgtccactctgatccaaccctgtactgatagtacttcccagtatgatattgtgatgtttcatacaatgcagtgaacataaccaacttgttacctaaataaagaattgataaaaacagtgtgacatattaaaaaa

SEQ ID NO: 456262 - DNA, 2550 bp, Homo sapiens
aggcggggcaccctgaggggcggggaaggactagggtgcggggagggggttgcaaaaggagccgagcggcttctgctcaatggcggaaaagccgccggtgctctgacggcctcgttcccctagcagttgcgggggagtttcctgccggcgcggctggagtctctgattctcagggttcggtggttggaagatgctccagagagacgaggctgcggcggaggaggtggcggcggccgaatcggcaacggcgctagggtggagagaaggcggcagcggcggcggcggcggcgtgaggggccgggcggtgtaaacagccccggaggcggcggaggcggcggtcgagaccccgagggggaagcggcggctgagtcagggtcgcgcctccgttggaaacttgggctgagtaccgcggcgggcgcgagcgaggcgccctagacatcttctccctcccttgcctcagatttattgctaaacatgggtgcatttttggataaacccaaaactgaaaaacataatgctcatggtgctgggaatggtttacgttatggcctgagcagcatgcaaggatggagagtggaaatggaagatgcacacacagctgttgtaggtattcctcacggcttggaagactggtcattttttgcagtttatgatggtcatgctggatcccgagtggcaaattactgctcaacacatttattagaacacatcactactaacgaagactttagggcagctggaaaatcaggatctgctcttgagctttcagtggaaaatgttaagaatggtatcagaactggatttttgaaaattgatgaatacatgcgtaacttttcagacctcagaaacgggatggacaggagtggttcaactgcagtgggagttatgatttcacctaagcatatctactttatcaactgtggtgattcacgtgctgttctgtataggaatggacaagtctgcttttctacccaggatcacaaaccttgcaatccaagggaaaaggagcgaatccaaaatgcaggaggcagcgtgatgatacaacgtgttaatggttcattagcagtatctcgtgctctgggggactatgattacaagtgtgttgatggcaagggcccaacagaacaacttgtttctccagagcctgaggtttatgaaattttaagagcagaagaggatgaatttatcatcttggcttgtgatgggatctgggatgttatgagtaatgaggagctctgtgaatatgttaaatctaggcttgaggtatctgatgacctggaaaatgtgtgcaattgggtagtggacacttgtttacacaagagattatggagaagtctggcgaggaaggaatgcctgatcttgcccatgtcatgcgcatcttgtctgcagaaaatatcccaaatttgcctcctgggggaggtcttgctggcaagcgtaatgttattgaagctgtttatagtagactgaatccacatagagaaagtgatggggcctccgatgaagcagaggaaagtggatcacagggaaaattggtggaagctctcaggcaaatgagaattaatcataggggaaactaccgacaacttctggaggagatgctgactagttacaggctagctaaagtagagggagaagaaagccctgctgaaccagctgccacagctacttcttcgaacagtgatgctggaaacccagtgacaatgcaggaaagccatactgaatcagaaagtggtcttgctgaattagacagctctaatgaagatgcagggacaaagatgagtggtgaaaaaatatgactttcctttttggtaatatttttgtgatctttgatggtttttaacctaggaagtgtaatgtatgcatttatataactgttttgttatttgaatcttggaaaactagttttattatattcagatagccttgttttttaaaaaggcctttgcatacacctttatgagatagtgtaaaattgactatttatagtactatggatttaatgaaattatatgtcatttcacattgtatgccagaaattaggctaccaattatgaattaaagtcagtagttaaattaatactagatagaattagaaattttgattagagagattatgctatattatggaaaaacttgttaatgtagaattatactgcttcatattattttacctattagtacactcatagttagctttgtaataaatttatgttttctttaataattttagttcttcaaagaatggctgatgctggcctgtaatttttctttcaaggatgataatttgtgtgttgtttgatttgtttatattttacatctctgtagttttatttttagaagttgtgagatattggatgtgtggctatttttcctttctctgtattctttatgaaacataacttttgaaaaacctatgtattattcatacagctttggtttgtatattctgtatagcctaactacacacatcaaaatgtatgtcaaccaagtgtttagaatgaaattataagtgtttaagtccaaataaagcatgtgatgtggaataatcta

SEQ ID NO: 456263 - DNA, 1767 bp, Homo sapiens
aggcggggcaccctgaggggcggggaaggactagggtgcggggagggggttgcaaaaggagccgagcggcttctgctcaatggcggaaaagccgccggtgctctgacggcctcgttcccctagcagttgcgggggagtttcctgccggcgcggctggagtctctgattctcagggttcggtggttggaagatgctccagagagacgaggctgcggcggaggaggtggcggcggccgaatcggcaacggcgctagggtggagagaaggcggcagcggcggcggcggcggcgtgaggggccgggcggtgtaaacagccccggaggcggcggaggcggcggtcgagaccccgagggggaagcggcggctgagtcagggtcgcgcctccgttggaaacttgggctgagtaccgcggcgggcgcgagcgaggcgccctagacatcttctccctcccttgcctcagatttattgctaaacatgggtgcatttttggataaacccaaaactgaaaaacataatgctcatggtgctgggaatggtttacgttatggcctgagcagcatgcaaggatggagagtggaaatggaagatgcacacacagctgttgtaggtattcctcacggcttggaagactggtcattttttgcagtttatgatggtcatgctggatcccgagtggcaaattactgctcaacacatttattagaacacatcactactaacgaagactttagggcagctggaaaatcaggatctgctcttgagctttcagtggaaaatgttaagaatggtatcagaactggatttttgaaaattgatgaatacatgcgtaacttttcagacctcagaaacgggatggacaggagtggttcaactgcagtgggagttatgatttcacctaagcatatctactttatcaactgtggtgattcacgtgctgttctgtataggaatggacaagtctgcttttctacccaggatcacaaaccttgcaatccaagggaaaaggagcgaatccaaaatgcaggaggcagcgtgatgatacaacgtgttaatggttcattagcagtatctcgtgctctgggggactatgattacaagtgtgttgatggcaagggcccaacagaacaacttgtttctccagagcctgaggtttatgaaattttaagagcagaagaggatgaatttatcatcttggcttgtgatgggatctgggatgttatgagtaatgaggagctctgtgaatatgttaaatctaggcttgaggtatctgatgacctggaaaatgtgtgcaattgggtagtggacacttgtttacacaagggaagtcgagataacatgagtattgtactagtttgcttttcaaatgctcccaaggtctcagatgaagcggtgaaaaaagattcagagttggataagcacttggaatcacgggttgaagagattatggagaagtctggcgaggaaggaatgcctgatcttgcccatgtcatgcgcatcttgtctgcagaaaatatcccaaatttgcctcctgggggaggtcttgctggcaagcgtaatgttattgaagctgtttatagtagactgaatccacatagagaaagtgatgggatggcagtcttgggcacgtccatctgtaaacctgctgagagctctggtgacaagaaaggcagtggctggcagaccttccaagcactcagaagcacgcggacaaaaaggtttttttgtaaacccgaacgaaaaataaacccagcattatataattataaa

SEQ ID NO: 456264 - DNA, 1485 bp, Homo sapiens
aggcggggcaccctgaggggcggggaaggactagggtgcggggagggggttgcaaaaggagccgagcggcttctgctcaatggcggaaaagccgccggtgctctgacggcctcgttcccctagcagttgcgggggagtttcctgccggcgcggctggagtctctgattctcagggttcggtggttggaagatgctccagagagacgaggctgcggcggaggaggtggcggcggccgaatcggcaacggcgctagggtggagagaaggcggcagcggcggcggcggcggcgtgaggggccgggcggtgtaaacagccccggaggcggcggaggcggcggtcgagaccccgagggggaagcggcggctgagtcagggtcgcgcctccgttggaaacttgggctgagtaccgcggcgggcgcgagcgaggcgccctagacatcttctccctcccttgcctcagatttattgctaaacatgggtgcatttttggataaacccaaaactgaaaaacataatgctcatggtgctgggaatggtttacgttatggcctgagcagcatgcaaggatggagagtggaaatggaagatgcacacacagctgttgtaggtattcctcacggcttggaagactggtcattttttgcagtttatgatggtcatgctggatcccgagtggcaaattactgctcaacacatttattagaacacatcactactaacgaagactttagggcagctggaaaatcaggatctgctcttgagctttcagtggaaaatgttaagaatggtatcagaactggatttttgaaaattgatgaatacatgcgtaacttttcagacctcagaaacgggatggacaggagtggttcaactgcagtgggagttatgatttcacctaagcatatctactttatcaactgtggtgattcacgtgctgttctgtataggaatggacaagtctgcttttctacccaggatcacaaaccttgcaatccaagggaaaaggagcgaatccaaaatgcaggaggcagcgtgatgatacaacgtgttaatggttcattagcagtatctcgtgctctgggggactatgattacaagtgtgttgatggcaagggcccaacagaacaacttgtttctccagagcctgaggtttatgaaattttaagagcagaagaggatgaatttatcatcttggcttgtgatgggatctgggatgttatgagtaatgaggagctctgtgaatatgttaaatctaggcttgaggtatctgatgacctggaaaatgtgtgcaattgggtagtggacacttgtttacacaagagattatggagaagtctggcgaggaaggaatgcctgatcttgcccatgtcatgcgcatcttgtctgcagaaaatatcccaaatttgcctcctgggggaggtcttgctggcaagcgtaatgctattgaaacttctaaactaggggtccagctcgagttctatatgt

SEQ ID NO: 456265 - DNA, 896 bp, Homo sapiens
atgttatccccaacacctatccccaacacctggaaacccagtgacaatgcaggaaagccatactgaatcagaaagtggtcttgctgaattagacagctctaatgaagatgcagggacaaagatgagtggtgaaaaaatatgactttcctttttggtaatatttttgtgatctttgatggtttttaacctaggaagtgtaatgtatgcatttatataactgttttgttatttgaatcttggaaaactagttttattatattcagatagccttgttttttaaaaaggcctttgcatacacctttatgagatagtgtaaaattgactatttatagtactatggatttaatgaaattatatgtcatttcacattgtatgccagaaattaggctaccaattatgaattaaagtcagtagttaaattaatactagatagaattagaaattttgattagagagattatgctatattatggaaaaacttgttaatgtagaattatactgcttcatattattttacctattagtacactcatagttagctttgtaataaatttatgttttctttaataattttagttcttcaaagaatggctgatgctggcctgtaatttttctttcaaggatgataatttgtgtgttgtttgatttgtttatattttacatctctgtagttttatttttagaagttgtgagatattggatgtgtggctatttttcctttctctgtattctttatgaaacataacttttgaaaaacctatgtattattcatacagctttggtttgtatattctgtatagcctaactacacacatcaaaatgtatgtcaaccaagtgtttagaatgaaattataagtgtttaagtccaaataaagcatgtgatgtggaataatcta

SEQ ID NO: 456266 - DNA, 395 bp, Homo sapiens
caccttgtttcttcaagttgtgtttttagtaattcattggaataaaaatgaatgtgttaaacataaacgttctggatgattaaataaactataattgcttaaagtattttgaagtaaataatagttgattgtagaaatacaattttttttcttttttttctttaatacacagggaagtcgagataacatgagtattgtactagtttgcttttcaaatgctcccaaggtctcagatgaagcggtgaaaaaagattcagagttggataagcacttggaatcacgggttgaaggtaagacaaatgctttttaaaaatatagacaggccaggcacggtagctcatgcctgtaatcctagcacttttgtcgcctgggcgacacaccaaggctctgtctca

SEQ ID NO: 456267 - DNA, 382 bp, Homo sapiens
agttgtgtttttagtaattcattggaataaaaatgaatgtgttaaacataaacgttctggatgattaaataaactataattgcttaaagtattttgaagtaaataatagttgattgtagaaatacaattttttttcttttttttctttaatacacagggaagtcgagataacatgagtattgtactagtttgcttttcaaatgctcccaaggtctcagatgaagcggtgaaaaaagattcagagttggataagcacttggaatcacgggttgaaggtaagacaaatgctttttaaaaatatagacaggccaggcacggtagctcatgcctgtaatcctagcacttttgtcgcctgggcgacacaccaaggctctgtctcaaa

SEQ ID NO: 456268 - DNA, 1808 bp, Homo sapiens
aggcggggcaccctgaggggcggggaaggactagggtgcggggagggggttgcaaaaggagccgagcggcttctgctcaatggcggaaaagccgccggtgctctgacggcctcgttcccctagcagttgcgggggagtttcctgccggcgcggctggagtctctgattctcagggttcggtggttggaagatgctccagagagacgaggctgcggcggaggaggtggcggcggccgaatcggcaacggcgctagggtggagagaaggcggcagcggcggcggcggcggcgtgaggggccgggcggtgtaaacagccccggaggcggcggaggcggcggtcgagaccccgagggggaagcggcggctgagtcagggtcgcgcctccgttggaaacttgggctgagtaccgcggcgggcgcgagcgaggcgccctagacatcttctccctcccttgcctcagggaagtcgagataacatgagtattgtactagtttgcttttcaaatgctcccaaggtctcagatgaagcggtgaaaaaagattcagagttggataagcacttggaatcacgggttgaagagattatggagaagtctggcgaggaaggaatgcctgatcttgcccatgtcatgcgcatcttgtctgcagaaaatatcccaaatttgcctcctgggggaggtcttgctggcaagcgtaatgttattgaagctgtttatagtagactgaatccacatagagaaagtgatggggcctccgatgaagcagaggaaagtggatcacagggaaaattggtggaagctctcaggcaaatgagaattaatcataggggaaactaccgacaacttctggaggagatgctgactagttacaggctagctaaagtagagggagaagaaagccctgctgaaccagctgccacagctacttcttcgaacagtgatgctggaaacccagtgacaatgcaggaaagccatactgaatcagaaagtggtcttgctgaattagacagctctaatgaagatgcagggacaaagatgagtggtgaaaaaatatgactttcctttttggtaatatttttgtgatctttgatggtttttaacctaggaagtgtaatgtatgcatttatataactgttttgttatttgaatcttggaaaactagttttattatattcagatagccttgttttttaaaaaggcctttgcatacacctttatgagatagtgtaaaattgactatttatagtactatggatttaatgaaattatatgtcatttcacattgtatgccagaaattaggctaccaattatgaattaaagtcagtagttaaattaatactagatagaattagaaattttgattagagagattatgctatattatggaaaaacttgttaatgtagaattatactgcttcatattattttacctattagtacactcatagttagctttgtaataaatttatgttttctttaataattttagttcttcaaagaatggctgatgctggcctgtaatttttctttcaaggatgataatttgtgtgttgtttgatttgtttatattttacatctctgtagttttatttttagaagttgtgagatattggatgtgtggctatttttcctttctctgtattctttatgaaacataacttttgaaaaacctatgtattattcatacagctttggtttgtatattctgtatagcctaactacacacatcaaaatgtatgtcaaccaagtgtttagaatgaaattataagtgtttaagtccaaataaagcatgtgatgtggaataatcta

SEQ ID NO: 456269 - DNA, 3253 bp, Homo sapiens
aggcggggcaccctgaggggcggggaaggactagggtgcggggagggggttgcaaaaggagccgagcggcttctgctcaatggcggaaaagccgccggtgctctgacggcctcgttcccctagcagttgcgggggagtttcctgccggcgcggctggagtctctgattctcagggttcggtggttggaagatgctccagagagacgaggctgcggcggaggaggtggcggcggccgaatcggcaacggcgctagggtggagagaaggcggcagcggcggcggcggcggcgtgaggggccgggcggtgtaaacagccccggaggcggcggaggcggcggtcgagaccccgagggggaagcggcggctgagtcagggtcgcgcctccgttggaaacttgggctgagtaccgcggcgggcgcgagcgaggcgccctagacatcttctccctcccttgcctcagatttattgctaaacatgggtgcatttttggataaacccaaaactgaaaaacataatgctcatggtgctgggaatggtttacgttatggcctgagcagcatgcaaggatggagagtggaaatggaagatgcacacacagctgttgtaggtattcctcacggcttggaagactggtcattttttgcagtttatgatggtcatgctggatcccgagtggcaaattactgctcaacacatttattagaacacatcactactaacgaagactttagggcagctggaaaatcaggatctgctcttgagctttcagtggaaaatgttaagaatggtatcagaactggatttttgaaaattgatgaatacatgcgtaacttttcagacctcagaaacgggatggacaggagtggttcaactgcagtgggagttatgatttcacctaagcatatctactttatcaactgtggtgattcacgtgctgttctgtataggaatggacaagtctgcttttctacccaggatcacaaaccttgcaatccaagggaaaaggagcgaatccaaaatgcaggaggcagcgtgatgatacaacgtgttaatggttcattagcagtatctcgtgctctgggggactatgattacaagtgtgttgatggcaagggcccaacagaacaacttgtttctccagagcctgaggtttatgaaattttaagagcagaagaggatgaatttatcatcttggcttgtgatgggatctgggatgttatgagtaatgaggagctctgtgaatatgttaaatctaggcttgaggtatctgatgacctggaaaatgtgtgcaattgggtagtggacacttgtttacacaagagattatggagaagtctggcgaggaaggaatgcctgatcttgcccatgtcatgcgcatcttgtctgcagaaaatatcccaaatttgcctcctgggggaggtcttgctggcaagcgtaatgttattgaagctgtttatagtagactgaatccacatagagaaagtgatgggggtgctggagatctagaagacccatggtagccttaaaaaccttctaaaatgcttttgattctgaaaattgggggaaaaaacttttaatcacaattttcttcaatacaaggggaaaatattcttgcggattcccaacgttttgtgatatgagcagaaaatcattagcatttcccatcatttgttcatatttgtgttttctgacagttgccacttgtagcattgcctgtactacagtattttttgccaacctcaggcatactcgttacatctgtattgaactttcggccctagaaaccagtggagttatttcaccacaaatcaacaatgtgcctgaggtgcatgggaaatatagttagctatactctgaaaatacattatgttttttttctttaaacaaaacacacaacatgtaagcatgtaagagtaaagaattgtatgatatgttccttttttcagttcaccaagttggaagccttttgcagctctgtggcttggaatttcatttgagcaatttctataggatatgtatttattattgattgttatttaatttttttccaattttacctgtattaccaaactgggttctccaataatgtccaaattgtaatgttgccttgcttcaagataaagtgtatttgggaataatattataaacccttacaaattttatgcatgtatctactgcatccttcaactctcactagaaaatcttttgaaaccaaatggattaatttatggctatttataatttgctttgacatctcactgttggaaattttttaaagatgagatttgcctttataatgtaaattgtgatttttgttttacatgtgggtttctatagttttaattttttcagcttttaagatacgagttttgtgtaatttggtatttttaatcatttatgttattttaaaagctcagaatatcacattgaaattactataaatacatttaaaattatctattttagatctaaggaaatactacagagatattttcatgggttcagtaacttttcattttataacattgggcacggtacagagtgattgtcacataaggtacttgaagatttattagtttaattctatttttacagtaaccttgaattcttctgagttttgcatgtattaaattcaattaatgctgaacatgaagagtaaagtatttatctgaaagaagtttctgggttaggagaagtaatgaatgtatccatttgtacatggtttacatgttgtggatgctttgtaaacattttcctgtatgtttaaattgtgtttcagcaggatgtaattgcccttgtgtgtagttaaaatgagtcatcatctggtcctttgtgaaatggaattcatggtattttctgtaacgttttcctgaagctgtttctggagagccacacatttaaatacagacagctttcctgatcatttgatttattgtgcacctgatttttggtctaaaaggaattattgccacaatatattttatttattctttagattttagccttgtaagttaaagtgctttacatgatgatgtgaaaagctgtttgtccctttactgggtttggggggttgttaaaagatagggaatgaagaatgcaaaatggtttatcgttcaaactgtccactctgatccaaccctgtactgatagtacttcccagtatgatattgtgatgtttcatacaatgcagtgaacataaccaacttgttacctaaataaagaattgataaaaacagtgtgacatattaaaaaa

SEQ ID NO: 456270 - DNA, 3315 bp, Homo sapiens
aggcggggcaccctgaggggcggggaaggactagggtgcggggagggggttgcaaaaggagccgagcggcttctgctcaatggcggaaaagccgccggtgctctgacggcctcgttcccctagcagttgcgggggagtttcctgccggcgcggctggagtctctgattctcagggttcggtggttggaagatgctccagagagacgaggctgcggcggaggaggtggcggcggccgaatcggcaacggcgctagggtggagagaaggcggcagcggcggcggcggcggcgtgaggggccgggcggtgtaaacagccccggaggcggcggaggcggcggtcgagaccccgagggggaagcggcggctgagtcagggtcgcgcctccgttggaaacttgggctgagtaccgcggcgggcgcgagcgaggcgccctagacatcttctccctcccttgcctcagatttattgctaaacatgggtgcatttttggataaaccccagcatgcaaggatggagagtggaaatggaagatgcacacacagctgttgtaggtattcctcacggcttggaagactggtcattttttgcagtttatgatggtcatgctggatcccgagtggcaaattactgctcaacacatttattagaacacatcactactaacgaagactttagggcagctggaaaatcaggatctgctcttgagctttcagtggaaaatgttaagaatggtatcagaactggatttttgaaaattgatgaatacatgcgtaacttttcagacctcagaaacgggatggacaggagtggttcaactgcagtgggagttatgatttcacctaagcatatctactttatcaactgtggtgattcacgtgctgttctgtataggaatggacaagtctgcttttctacccaggatcacaaaccttgcaatccaagggaaaaggagcgaatccaaaatgcaggaggcagcgtgatgatacaacgtgttaatggttcattagcagtatctcgtgctctgggggactatgattacaagtgtgttgatggcaagggcccaacagaacaacttgtttctccagagcctgaggtttatgaaattttaagagcagaagaggatgaatttatcatcttggcttgtgatgggatctgggatgttatgagtaatgaggagctctgtgaatatgttaaatctaggcttgaggtatctgatgacctggaaaatgtgtgcaattgggtagtggacacttgtttacacaagggaagtcgagataacatgagtattgtactagtttgcttttcaaatgctcccaaggtctcagatgaagcggtgaaaaaagattcagagttggataagcacttggaatcacgggttgaagagattatggagaagtctggcgaggaaggaatgcctgatcttgcccatgtcatgcgcatcttgtctgcagaaaatatcccaaatttgcctcctgggggaggtcttgctggcaagcgtaatgttattgaagctgtttatagtagactgaatccacatagagaaagtgatgggggtgctggagatctagaagacccatggtagccttaaaaaccttctaaaatgcttttgattctgaaaattgggggaaaaaacttttaatcacaattttcttcaatacaaggggaaaatattcttgcggattcccaacgttttgtgatatgagcagaaaatcattagcatttcccatcatttgttcatatttgtgttttctgacagttgccacttgtagcattgcctgtactacagtattttttgccaacctcaggcatactcgttacatctgtattgaactttcggccctagaaaccagtggagttatttcaccacaaatcaacaatgtgcctgaggtgcatgggaaatatagttagctatactctgaaaatacattatgttttttttctttaaacaaaacacacaacatgtaagcatgtaagagtaaagaattgtatgatatgttccttttttcagttcaccaagttggaagccttttgcagctctgtggcttggaatttcatttgagcaatttctataggatatgtatttattattgattgttatttaatttttttccaattttacctgtattaccaaactgggttctccaataatgtccaaattgtaatgttgccttgcttcaagataaagtgtatttgggaataatattataaacccttacaaattttatgcatgtatctactgcatccttcaactctcactagaaaatcttttgaaaccaaatggattaatttatggctatttataatttgctttgacatctcactgttggaaattttttaaagatgagatttgcctttataatgtaaattgtgatttttgttttacatgtgggtttctatagttttaattttttcagcttttaagatacgagttttgtgtaatttggtatttttaatcatttatgttattttaaaagctcagaatatcacattgaaattactataaatacatttaaaattatctattttagatctaaggaaatactacagagatattttcatgggttcagtaacttttcattttataacattgggcacggtacagagtgattgtcacataaggtacttgaagatttattagtttaattctatttttacagtaaccttgaattcttctgagttttgcatgtattaaattcaattaatgctgaacatgaagagtaaagtatttatctgaaagaagtttctgggttaggagaagtaatgaatgtatccatttgtacatggtttacatgttgtggatgctttgtaaacattttcctgtatgtttaaattgtgtttcagcaggatgtaattgcccttgtgtgtagttaaaatgagtcatcatctggtcctttgtgaaatggaattcatggtattttctgtaacgttttcctgaagctgtttctggagagccacacatttaaatacagacagctttcctgatcatttgatttattgtgcacctgatttttggtctaaaaggaattattgccacaatatattttatttattctttagattttagccttgtaagttaaagtgctttacatgatgatgtgaaaagctgtttgtccctttactgggtttggggggttgttaaaagatagggaatgaagaatgcaaaatggtttatcgttcaaactgtccactctgatccaaccctgtactgatagtacttcccagtatgatattgtgatgtttcatacaatgcagtgaacataaccaacttgttacctaaataaagaattgataaaaacagtgtgacatattaaaaaa

SEQ ID NO: 456271 - DNA, 2444 bp, Homo sapiens
aggcggggcaccctgaggggcggggaaggactagggtgcggggagggggttgcaaaaggagccgagcggcttctgctcaatggcggaaaagccgccggtgctctgacggcctcgttcccctagcagttgcgggggagtttcctgccggcgcggctggagtctctgattctcagggttcggtggttggaagatgctccagagagacgaggctgcggcggaggaggtggcggcggccgaatcggcaacggcgctagggtggagagaaggcggcagcggcggcggcggcggcgtgaggggccgggcggtgtaaacagccccggaggcggcggaggcggcggtcgagaccccgagggggaagcggcggctgagtcagggtcgcgcctccgttggaaacttgggctgagtaccgcggcgggcgcgagcgaggcgccctagacatcttctccctcccttgcctcagatttattgctaaacatgggtgcatttttggataaacccaaaactgaaaaacataatgctcatggtgctgggaatggtttacgttatggcctgagcagcatgcaaggatggagagtggaaatggaagatgcacacacagctgttgtaggtattcctcacggcttggaagactggtcattttttgcagtttatgatggtcatgctggatcccgagtggcaaattactgctcaacacatttattagaacacatcactactaacgaagactttagggcagctggaaaatcaggatctgctcttgagctttcagtggaaaatgttaagaatggtatcagaactggatttttgaaaattgatgaatacatgcgtaacttttcagacctcagaaacgggatggacaggagtggttcaactgcagtgggagttatgatttcacctaagcatatctactttatcaactgtggtgattcacgtgctgttctgtataggaatggacaagtctgcttttctacccaggatcacaaaccttgcaatccaagggaaaaggagcgaatccaaaatgcaggaggcagcgtgatgatacaacgtgttaatggttcattagcagtatctcgtgctctgggggactatgattacaagtgtgttgatggcaagggcccaacagaacaacttgtttctccagagcctgaggtttatgaaattttaagagcagaagaggatgaatttatcatcttggcttgtgatgggatctgggatgttatgagtaatgaggagctctgtgaatatgttaaatctaggcttgaggtatctgatgacctggaaaatgtgtgcaattgggtagtggacacttgtttacacaagggaagtcgagataacatgagtattgtactagtttgcttttcaaatgctcccaaggtctcagatgaagcggtgaaaaaagattcagagttggataagcacttggaatcacgggttgaagagattatggagaagtctggcgaggaaggaatgcctgatcttgcccatgtcatgcgcatcttgtctgcagaaaatatcccaaatttgcctcctgggggaggtcttgctggcaagcgtaatgttattgaagctgtttatagtagactgaatccacatagagaaagtgatgggggtgctggagatctagaagacccatggtagccttaaaaaccttctaaaatgcttttgattctgaaaattgggggaaaaaacttttaatcacaattttcttcaatacaaggggaaaatattcttgcggattcccaacgttttgtgatatgagcagaaaatcattagcatttcccatcatttgttcatatttgtgttttctgacagttgccacttgtagcattgcctgtactacagtattttttgccaacctcaggcatactcgttacatctgtattgaactttcggccctagaaaccagtggagttatttcaccacaaatcaacaatgtgcctgaggtgcatgggaaatatagttagctatactctgaaaatacattatgttttttttctttaaacaaaacacacaacatgtaagcatgtaagagtaaagaattgtatgatatgttccttttttcagttcaccaagttggaagccttttgcagctctgtggcttggaatttcatttgagcaatttctataggatatgtatttattattgattgttatttaatttttttccaattttacctgtattaccaaactgggttctccaataatgtccaaattgtaatgttgccttgcttcaagataaagtgtatttgggaataatattataaacccttacaaattttatgcatgtatctactgcatccttcaactctcactagaaaatcttttgaaacaatttctaaagggagggctagccttatatctgacactgtgcttttgtgtttacctctggctttctaacggctccacgctttcaggcctcaagatagaagctgtagtttattgta

SEQ ID NO: 456272 - DNA, 1632 bp, Homo sapiens
aggcggggcaccctgaggggcggggaaggactagggtgcggggagggggttgcaaaaggagccgagcggcttctgctcaatggcggaaaagccgccggtgctctgacggcctcgttcccctagcagttgcgggggagtttcctgccggcgcggctggagtctctgattctcagggttcggtggttggaagatgctccagagagacgaggctgcggcggaggaggtggcggcggccgaatcggcaacggcgctagggtggagagaaggcggcagcggcggcggcggcggcgtgaggggccgggcggtgtaaacagccccggaggcggcggaggcggcggtcgagaccccgagggggaagcggcggctgagtcagggtcgcgcctccgttggaaacttgggctgagtaccgcggcgggcgcgagcgaggcgccctagacatcttctccctcccttgcctcagatttattgctaaacatgggtgcatttttggataaacccaaaactgaaaaacataatgctcatggtgctgggaatggtttacgttatggcctgagcagcatgcaaggatggagagtggaaatggaagatgcacacacagctgttgtaggtattcctcacggcttggaagactggtcattttttgcagtttatgatggtcatgctggatcccgagtggcaaattactgctcaacacatttattagaacacatcactactaacgaagactttagggcagctggaaaatcaggatctgctcttgagctttcagtggaaaatgttaagaatggtatcagaactggatttttgaaaattgatgaatacatgcgtaacttttcagacctcagaaacgggatggacaggagtggttcaactgcagtgggagttatgatttcacctaagcatatctactttatcaactgtggtgattcacgtgctgttctgtataggaatggacaagtctgcttttctacccaggatcacaaaccttgcaatccaagggaaaaggagcgaatccaaaatgcaggaggcagcgtgatgatacaacgtgttaatggttcattagcagtatctcgtgctctgggggactatgattacaagtgtgttgatggcaagggcccaacagaacaacttgtttctccagagcctgaggtttatgaaattttaagagcagaagaggatgaatttatcatcttggcttgtgatgggatctgggatgttatgagtaatgaggagctctgtgaatatgttaaatctaggcttgaggtatctgatgacctggaaaatgtgtgcaattgggtagtggacacttgtttacacaagggaagtcgagataacatgagtattgtactagtttgcttttcaaatgctcccaaggtctcagatgaagcggtgaaaaaagattcagagttggataagcacttggaatcacgggttgaagagattatggagaagtctggcgaggaaggaatgcctgatcttgcccatgtcatgcgcatcttgtctgcagaaaatatcccaaatttgcctcctgggggaggtcttgctggcaagcgtaatgttattgaagctgtttatagtagactgaatccacatagagaaagtgatggggtaagttttattttatttcataag

SEQ ID NO: 456273 - DNA, 2324 bp, Homo sapiens
gtctccccggggagggcggcgggcggcgggcggcggggaccgggtgcggtggtggctgcggcggcggcggcgggagcagcatggattggggcactgagctgtgggatcagttcgaggtgctcgagcgccacacgcagtgggggctggacctgttggacagatatgtaaagttcgtgaaagaacgcaccgaagtggaacaggcttacgccaaacaactgcggagcctggtgaaaaaatatctgcccaagagacctgccaaggatgatcctgagtccaaattcagccagcaacagtccttcgtacagattctccaggaggtgaatgactttgcaggccagcgggagctggtggctgagaacctcagtgtccgtgtatgtcttgagctgaccaagtactcacaagagatgaaacaggagaggaagatgcacttccaagaagggcggcgggcccagcagcagctggaaaatggctttaaacagctggagaatagtaagcgtaaatttgagcgggactgccgggaggcagagaaggcagcccagactgctgaacggctagaccaggatatcaacgccaccaaggctgatgtggagaaggccaagcagcaagcccaccttcggagtcacatggccgaagaaagcaaaaacgaatatgcggctcaactgcagcgcttcaaccgagaccaagcccacttctatttttcacagatgccccagatattcgataagctccaagacatggatgaacgcagggccacccgcctgggtgccgggtatgggctcctgtcggaggccgagctggaggtggtgcccataatagccaagtgcttggagggcatgaaggtggctgcaaatgctgtggatcccaagaacgactcccacgtccttatagagctgcacaagtcaggttttgcccgcccgggcgacgtggaattcgaggacttcagccagcccatgaaccgtgcaccctccgacagcagtctgggcaccccctcggatggacggcctgaactccgaggcccgggtcgcagccgcaccaagcgctggccttttggcaagaagaacaagacagtggtgaccgaggattttagccacttgcccccagagcagcagcgaaaacggcttcaacagcagttggaagaacgcagtcgtgaacttcagaaggaggttgaccagagggaagccctaaagaaaatgaaggatgtctatgagaagacacctcagatgggggaccccgccagcttggagccccagatcgctgaaaccctgagcaacattgaacggctgaaattggaagtgcagaagtatgaggcgtggctggcagaagctgaaagtcgagtccttagcaaccggggagacagcctgagccggcacgcccggcctcccgacccccccgctagcgccccgccagacagcagcagcaacagcgcatcacaggacaccaaggagagctctgaagagcctccctcagaagagagccaggacacccccatttacacggagtttgatgaggatttcgaggaggaacccacatcccccataggtcactgtgtggccatctaccactttgaagggtccagcgagggcactatctctatggccgagggtgaagacctcagtcttatggaagaagacaaaggggacggctggacccgggtcaggcggaaagagggaggcgagggctacgtgcccacctcctacctccgagtcacgctcaattgaaccctgccagagacgggaagaggggggctgtcggctgctgcttctgggccacggggagccccaggacctatgcactttatttctgaccccgtggcttcggctgagacctgtgtaacctgctgccccctccacccccaacccagtcctacctgtcacaccggacggacccgctgtgccttctaccatcgttccaccattgatgtacatactcatgttttacatcttttctttctgccgctcggctccggccattttgttttatacaaaaatgggaaaaaaaaaaaagaaattatataaagttcctagagtcggtgtcttattagaggatttaaatactgggactggaagtatctaacaccacgtttcttacaggccacacagggaatgaggaaggggaggtgatcttgggcacaccttgggtcaaccctgcccctttctggaagttggcctatgtcattgtcagtgggtgtctgcttgtgactcaggtagggagaaggataccaagtttcttttttttttctttttgagacagtctcacccagttgcccaggctggagtgcagtggcgtacgtgatctcagctcactgcagactccatctcccgagt

SEQ ID NO: 456274 - DNA, 2043 bp, Homo sapiens
gtctccccggggagggcggcgggcggcgggcggcggggaccgggtgcggtggtggctgcggcggcggcggcgggagcagcatggattggggcactgagctgtgggatcagttcgaggtgctcgagcgccacacgcagtgggggctggacctgttggacagatatgtaaagttcgtgaaagaacgcaccgaagtggaacaggcttacgccaaacaactgcggagcctggtgaaaaaatatctgcccaagagacctgccaaggatgatcctgagtccaaattcagccagcaacagtccttcgtacagattctccaggaggtgaatgactttgcaggccagcgggagctggtggctgagaacctcagtgtccgtgtatgtcttgagctgaccaagtactcacaagagatgaaacaggagaggaagatgcacttccaagaagggcggcgggcccagcagcagctggaaaatggctttaaacagctggagaatagtaagcgtaaatttgagcgggactgccgggaggcagagaaggcagcccagactgctgaacggctagaccaggatatcaacgccaccaaggctgatgtggagaaggccaagcagcaagcccaccttcggagtcacatggccgaagaaagcaaaaacgaatatgcggctcaactgcagcgcttcaaccgagaccaagcccacttctatttttcacagatgccccagatattcgataagctccaagacatggatgaacgcagggccacccgcctgggtgccgggtatgggctcctgtcggaggccgagctggaggtggtgcccataatagccaagtgcttggagggcatgaaggtggctgcaaatgctgtggatcccaagaacgactcccacgtccttatagagctgcacaagtcaggttttgcccgcccgggcgacgtggaattcgaggacttcagccagcccatgaaccgtgcaccctccgacagcagtctgggcaccccctcggatggacggcctgaactccgaggcccgggtcgcagccgcaccaagcgctggccttttggcaagaagaacaagacagtggtgaccgaggattttagccacttgcccccagagcagcagcgaaaacggcttcaacagcagttggaagaacgcagtcgtgaacttcagaaggaggttgaccagagggaagccctaaagaaaatgaaggatgtctatgagaagacacctcagatgggggaccccgccagcttggagccccagatcgctgaaaccctgagcaacattgaacggctgaaattggaagtgcagaagtatgaggcgtggctggcagaagctgaaagtcgagtccttagcaaccggggagacagcctgagccggcacgcccggcctcccgacccccccgctagcgccccgccagacagcagcagcaacagcgcatcacaggacaccaaggagagctctgaagagcctccctcagaagagagccaggacacccccatttacacggagtttgatgaggatttcgaggaggaacccacatcccccataggtcactgtgtggccatctaccactttgaagggtccagcgagggcactatctctatggccgagggtgaagacctcagtcttatggaagaagacaaaggggacggctggacccgggtcaggcggaaagagggaggcgagggctacgtgcccacctcctacctccgagtcacgctcaattgaaccctgccagagacgggaagaggggggctgtcggctgctgcttctgggccacggggagccccaggacctatgcactttatttctgaccccgtggcttcggctgagacctgtgtaacctgctgccccctccacccccaacccagtcctacctgtcacaccggacggacccgctgtgccttctaccatcgttccaccattgatgtacatactcatgttttacatcttttctttctgccgctcggctccggccattttgttttatacaaaaatgggttttttttttttctttaatatatttcaagagatttttttttttttttttttt

SEQ ID NO: 456275 - DNA, 2492 bp, Homo sapiens
gtctccccggggagggcggcgggcggcgggcggcggggaccgggtgcggtggtggctgcggcggcggcggcgggagcagcatggattggggcactgagctgtgggatcagttcgaggtgctcgagcgccacacgcagtgggggctggacctgttggacagatatgtaaagttcgtgaaagaacgcaccgaagtggaacaggcttacgccaaacaactgcggagcctggtgaaaaaatatctgcccaagagacctgccaaggatgatcctgagtccaaattcagccagcaacagtccttcgtacagattctccaggaggtgaatgactttgcaggccagcgggagctggtggctgagaacctcagtgtccgtgtatgtcttgagctgaccaagtactcacaagagatgaaacaggagaggaagatgcacttccaagaagggcggcgggcccagcagcagctggaaaatggctttaaacagctggagaatagtaagcgtaaatttgagcgggactgccgggaggcagagaaggcagcccagactgctgaacggctagaccaggatatcaacgccaccaaggctgatgtggagaaggccaagcagcaagcccaccttcggagtcacatggccgaagaaagcaaaaacgaatatgcggctcaactgcagcgcttcaaccgagaccaagcccacttctatttttcacagatgccccagatattcgataagctccaagacatggatgaacgcagggccacccgcctgggtgccgggtatgggctcctgtcggaggccgagctggaggtggtgcccataatagccaagtgcttggagggcatgaaggtggctgcaaatgctgtggatcccaagaacgactcccacgtccttatagagctgcacaagtcaggttttgcccgcccgggcgacgtggaattcgaggacttcagccagcccatgaaccgtgcaccctccgacagcagtctgggcaccccctcggatggacggcctgaactccgaggcccgggtcgcagccgcaccaagcgctggccttttggcaagaagaacaagcctcgccccccacccctctcccccctggggggccccgtaccctcggcattgcctaacggacccccgtccccccgctccggccgtgaccccttggccatactgagcgagatcagtaagtcggtcaaaccgaggctagcatccttccgcagccttcgaggcagccgtgggacagtggtgaccgaggattttagccacttgcccccagagcagcagcgaaaacggcttcaacagcagttggaagaacgcagtcgtgaacttcagaaggaggttgaccagagggaagccctaaagaaaatgaaggatgtctatgagaagacacctcagatgggggaccccgccagcttggagccccagatcgctgaaaccctgagcaacattgaacggctgaaattggaagtgcagaagtatgaggcgtggctggcagaagctgaaagtcgagtccttagcaaccggggagacagcctgagccggcacgcccggcctcccgacccccccgctagcgccccgccagacagcagcagcaacagcgcatcacaggacaccaaggagagctctgaagagcctccctcagaagagagccaggacacccccatttacacggagtttgatgaggatttcgaggaggaacccacatcccccataggtcactgtgtggccatctaccactttgaagggtccagcgagggcactatctctatggccgagggtgaagacctcagtcttatggaagaagacaaaggggacggctggacccgggtcaggcggaaagagggaggcgagggctacgtgcccacctcctacctccgagtcacgctcaattgaaccctgccagagacgggaagaggggggctgtcggctgctgcttctgggccacggggagccccaggacctatgcactttatttctgaccccgtggcttcggctgagacctgtgtaacctgctgccccctccacccccaacccagtcctacctgtcacaccggacggacccgctgtgccttctaccatcgttccaccattgatgtacatactcatgttttacatcttttctttctgccgctcggctccggccattttgttttatacaaaaatgggaaaaaaaaaaaagaaattatataaagttcctagagtcggtgtcttattagaggatttaaatactgggactggaagtatctaacaccacgtttcttacaggccacacagggaatgaggaaggggaggtgatcttgggcacaccttgggtcaaccctgcccctttctggaagttggcctatgtcattgtcagtgggtgtctgcttgtgactcaggtagggagaaggataccaagtttcttttttttttctttttgagacagtctcacccagttgcccaggctggagtgcagtggcgtacgtgatctcagctcactgcagactccatctcccgagt

SEQ ID NO: 456276 - DNA, 2394 bp, Homo sapiens
ggtcggcgggctgtggggtcccaaaatcgtgaccccggcccctctcccctcctcccccaccatgtcccatgtcaggatcagttcgaggtgctcgagcgccacacgcagtgggggctggacctgttggacagatatgtaaagttcgtgaaagaacgcaccgaagtggaacaggcttacgccaaacaactgcggtgagaccctggggtggacgctacggaggacgcgcctggggcgacggggagcggtgggagggctgcgggctcagccctcctacctctgtctccccttaggagcctggtgaaaaaatatctgcccaagagacctgccaaggatgatcctgagtccaaattcagccagcaacagtccttcgtacagattctccaggaggtgaatgactttgcaggccagcgggagctggtggctgagaacctcagtgtccgtgtatgtcttgagctgaccaagtactcacaagagatgaaacaggagaggaagatgcacttccaagaagggcggcgggcccagcagcagctggaaaatggctttaaacagctggagaatagtaagcgtaaatttgagcgggactgccgggaggcagagaaggcagcccagactgctgaacggctagaccaggatatcaacgccaccaaggctgatgtggagaaggccaagcagcaagcccaccttcggagtcacatggccgaagaaagcaaaaacgaatatgcggctcaactgcagcgcttcaaccgagaccaagcccacttctatttttcacagatgccccagatattcgataagctccaagacatggatgaacgcagggccacccgcctgggtgccgggtatgggctcctgtcggaggccgagctggaggtggtgcccataatagccaagtgcttggagggcatgaaggtggctgcaaatgctgtggatcccaagaacgactcccacgtccttatagagctgcacaagtcaggttttgcccgcccgggcgacgtggaattcgaggacttcagccagcccatgaaccgtgcaccctccgacagcagtctgggcaccccctcggatggacggcctgaactccgaggcccgggtcgcagccgcaccaagcgctggccttttggcaagaagaacaagacagtggtgaccgaggattttagccacttgcccccagagcagcagcgaaaacggcttcaacagcagttggaagaacgcagtcgtgaacttcagaaggaggttgaccagagggaagccctaaagaaaatgaaggatgtctatgagaagacacctcagatgggggaccccgccagcttggagccccagatcgctgaaaccctgagcaacattgaacggctgaaattggaagtgcagaagtatgaggcgtggctggcagaagctgaaagtcgagtccttagcaaccggggagacagcctgagccggcacgcccggcctcccgacccccccgctagcgccccgccagacagcagcagcaacagcgcatcacaggacaccaaggagagctctgaagagcctccctcagaagagagccaggacacccccatttacacggagtttgatgaggatttcgaggaggaacccacatcccccataggtcactgtgtggccatctaccactttgaagggtccagcgagggcactatctctatggccgagggtgaagacctcagtcttatggaagaagacaaaggggacggctggacccgggtcaggcggaaagagggaggcgagggctacgtgcccacctcctacctccgagtcacgctcaattgaaccctgccagagacgggaagaggggggctgtcggctgctgcttctgggccacggggagccccaggacctatgcactttatttctgaccccgtggcttcggctgagacctgtgtaacctgctgccccctccacccccaacccagtcctacctgtcacaccggacggacccgctgtgccttctaccatcgttccaccattgatgtacatactcatgttttacatcttttctttctgccgctcggctccggccattttgttttatacaaaaatgggaaaaaaaaaaaagaaattatataaagttcctagagtcggtgtcttattagaggatttaaatactgggactggaagtatctaacaccacgtttcttacaggccacacagggaatgaggaaggggaggtgatcttgggcacaccttgggtcaaccctgcccctttctggaagttggcctatgtcattgtcagtgggtgtctgcttgtgactcaggtagggagaaggataccaagtttcttttttttttctttttgagacagtctcacccagttgcccaggctggagtgcagtggcgtacgtgatctcagctcactgcagactccatctcccgagt

SEQ ID NO: 456277 - DNA, 2561 bp, Homo sapiens
gtctccccggggagggcggcgggcggcgggcggcggggaccgggtgcggtggtggctgcggcggcggcggcgggagcagcatggattggggcactgagctgtgggatcagttcgaggtgctcgagcgccacacgcagtgggggctggacctgttggacagatatgtaaagttcgtgaaagaacgcaccgaagtggaacaggcttacgccaaacaactgcggagcctggtgaaaaaatatctgcccaagagacctgccaaggatgatcctgagtccaaattcagccagcaacagtccttcgtacagattctccaggaggtgaatgactttgcaggccagcgggagctggtggctgagaacctcagtgtccgtgtatgtcttgagctgaccaagtactcacaagagatgaaacaggagaggaagatgcacttccaagaagggcggcgggcccagcagcagctggaaaatggctttaaacagctggagaatgtgagtttgcagaggtagcagtgactgtggcccggaggcatgggggcagggttgcggatccggagtcagggagctgccctctttgtcagacctggaccttccctcccccataggcttccagtactcccttgacccctacttactggatgacatcccaataatccctgaaaccttggtttcccaccctgctgtctttgggatggtggctccctcactccggttctgtcccctacacagagtaagcgtaaatttgagcgggactgccgggaggcagagaaggcagcccagactgctgaacggctagaccaggatatcaacgccaccaaggctgatgtggagaaggccaagcagcaagcccaccttcggagtcacatggccgaagaaagcaaaaacgaatatgcggctcaactgcagcgcttcaaccgagaccaagcccacttctatttttcacagatgccccagatattcgataagctccaagacatggatgaacgcagggccacccgcctgggtgccgggtatgggctcctgtcggaggccgagctggaggtggtgcccataatagccaagtgcttggagggcatgaaggtggctgcaaatgctgtggatcccaagaacgactcccacgtccttatagagctgcacaagtcaggttttgcccgcccgggcgacgtggaattcgaggacttcagccagcccatgaaccgtgcaccctccgacagcagtctgggcaccccctcggatggacggcctgaactccgaggcccgggtcgcagccgcaccaagcgctggccttttggcaagaagaacaagacagtggtgaccgaggattttagccacttgcccccagagcagcagcgaaaacggcttcaacagcagttggaagaacgcagtcgtgaacttcagaaggaggttgaccagagggaagccctaaagaaaatgaaggatgtctatgagaagacacctcagatgggggaccccgccagcttggagccccagatcgctgaaaccctgagcaacattgaacggctgaaattggaagtgcagaagtatgaggcgtggctggcagaagctgaaagtcgagtccttagcaaccggggagacagcctgagccggcacgcccggcctcccgacccccccgctagcgccccgccagacagcagcagcaacagcgcatcacaggacaccaaggagagctctgaagagcctccctcagaagagagccaggacacccccatttacacggagtttgatgaggatttcgaggaggaacccacatcccccataggtcactgtgtggccatctaccactttgaagggtccagcgagggcactatctctatggccgagggtgaagacctcagtcttatggaagaagacaaaggggacggctggacccgggtcaggcggaaagagggaggcgagggctacgtgcccacctcctacctccgagtcacgctcaattgaaccctgccagagacgggaagaggggggctgtcggctgctgcttctgggccacggggagccccaggacctatgcactttatttctgaccccgtggcttcggctgagacctgtgtaacctgctgccccctccacccccaacccagtcctacctgtcacaccggacggacccgctgtgccttctaccatcgttccaccattgatgtacatactcatgttttacatcttttctttctgccgctcggctccggccattttgttttatacaaaaatgggaaaaaaaaaaaagaaattatataaagttcctagagtcggtgtcttattagaggatttaaatactgggactggaagtatctaacaccacgtttcttacaggccacacagggaatgaggaaggggaggtgatcttgggcacaccttgggtcaaccctgcccctttctggaagttggcctatgtcattgtcagtgggtgtctgcttgtgactcaggtagggagaaggataccaagtttcttttttttttctttttgagacagtctcacccagttgcccaggctggagtgcagtggcgtacgtgatctcagctcactgcagactccatctcccgagt

SEQ ID NO: 456278 - DNA, 2370 bp, Homo sapiens
gtctccccggggagggcggcgggcggcgggcggcggggaccgggtgcggtggtggctgcggcggcggcggcgggagcagcatggattggggcactgagctgtgggatcagttcgaggtgctcgagcgccacacgcagtgggggctggacctgttggacagatatgtaaagttcgtgaaagaacgcaccgaagtggaacaggcttacgccaaacaactgcggagcctggtgaaaaaatatctgcccaagagacctgccaaggatgatcctgagtccaaattcagccagcaacagtccttcgtacagattctccaggaggtgaatgactttgcaggccagcgggagctggtggctgagaacctcagtgtccgtgtatgtcttgagctgaccaagtactcacaagagatgaaacaggagaggaagatgcacttccaagaagggcggcgggcccagcagcagctggaaaatggctttaaacagctggagaatagtaagcgtaaatttgagcgggactgccgggaggcagagaaggcagcccagactgctgaacggctagaccaggatatcaacgccaccaaggctgatgtggagaaggccaagcagcaagcccaccttcggagtcacatggccgaagaaagcaaaaacgaatatgcggctcaactgcagcgcttcaaccgagaccaagcccacttctatttttcacagatgccccagatattcgataagctccaagacatggatgaacgcagggccacccgcctgggtgccgggtatgggctcctgtcggaggccgagctggaggtggtgcccataatagccaagtgcttggagggcatgaaggtggctgcaaatgctgtggatcccaagaacgactcccacgtccttatagagctgcacaagtcaggttttgcccgcccgggcgacgtggaattcgaggacttcagccagcccatgaaccgtgcaccctccgacagcagtctgggcaccccctcggatggacggcctgaactccgaggcccgggtcgcagccgcaccaagcgctggccttttggcaagaagaacaagacagtggtgaccgaggattttagccacttgcccccagagcagcagcgaaaacggcttcaacagcagttggaagaacgcagtcgtgaacttcagaaggaggttgaccagagggaagccctaaagaaaatgaaggatgtctatgagaagacacctcagatgggggaccccgccagcttggagccccagatcgctgaaaccctgagcaacattgaacggctgaaattggaagtgcagaagtatgaggcgtggctggcagaagctgaaagtcgagtccttagcaaccggggagacagcctgagccggcacgcccggcctcccgacccccccgctagcgccccgccagacagcagcagcaacagcgcatcacaggacaccaaggagagctctgaagagcctccctcagaagagagccaggacacccccatttacacggagtttgatgaggatttcgaggaggaacccacatcccccataggtcactgtgtggccatctaccactttgaaggtccagcgaagagggggggggggggggccccaaaccctttaatttcggtccagcgagggcactatctctatggccgagggtgaagacctcagtcttatggaagaagacaaaggggacggctggacccgggtcaggcggaaagagggaggcgagggctacgtgcccacctcctacctccgagtcacgctcaattgaaccctgccagagacgggaagaggggggctgtcggctgctgcttctgggccacggggagccccaggacctatgcactttatttctgaccccgtggcttcggctgagacctgtgtaacctgctgccccctccacccccaacccagtcctacctgtcacaccggacggacccgctgtgccttctaccatcgttccaccattgatgtacatactcatgttttacatcttttctttctgccgctcggctccggccattttgttttatacaaaaatgggaaaaaaaaaaaagaaattatataaagttcctagagtcggtgtcttattagaggatttaaatactgggactggaagtatctaacaccacgtttcttacaggccacacagggaatgaggaaggggaggtgatcttgggcacaccttgggtcaaccctgcccctttctggaagttggcctatgtcattgtcagtgggtgtctgcttgtgactcaggtagggagaaggataccaagtttcttttttttttctttttgagacagtctcacccagttgcccaggctggagtgcagtggcgtacgtgatctcagctcactgcagactccatctcccgagt

SEQ ID NO: 456279 - DNA, 954 bp, Homo sapiens
aaacatcctatcatctgtaggctcattcatttctctaacagcagcagcaacagcgcatcacaggacaccaaggagagctctgaagagcctccctcagaagagagccaggacacccccatttacacggagtttgatgaggatttcgaggaggaacccacatcccccataggtcactgtgtggccatctaccactttgaagggtccagcgagggcactatctctatggccgagggtgaagacctcagtcttatggaagaagacaaaggggacggctggacccgggtcaggcggaaagagggaggcgagggctacgtgcccacctcctacctccgagtcacgctcaattgaaccctgccagagacgggaagaggggggctgtcggctgctgcttctgggccacggggagccccaggacctatgcactttatttctgaccccgtggcttcggctgagacctgtgtaacctgctgccccctccacccccaacccagtcctacctgtcacaccggacggacccgctgtgccttctaccatcgttccaccattgatgtacatactcatgttttacatcttttctttctgccgctcggctccggccattttgttttatacaaaaatgggaaaaaaaaaaaagaaattatataaagttcctagagtcggtgtcttattagaggatttaaatactgggactggaagtatctaacaccacgtttcttacaggccacacagggaatgaggaaggggaggtgatcttgggcacaccttgggtcaaccctgcccctttctggaagttggcctatgtcattgtcagtgggtgtctgcttgtgactcaggtagggagaaggataccaagtttcttttttttttctttttgagacagtctcacccagttgcccaggctggagtgcagtggcgtacgtgatctcagctcactgcagactccatctcccgagt

SEQ ID NO: 456280 - DNA, 1322 bp, Homo sapiens
gtctccccggggagggcggcgggcggcgggcggcggggaccgggtgcggtggtggctgcggcggcggcggcgggagcagcatggattggggcactgagctgtgggatcagttcgaggtgctcgagcgccacacgcagtgggggctggacctgttggacagatatgtaaagttcgtgaaagaacgcaccgaagtggaacaggcttacgccaaacaactgcggagcctggtgaaaaaatatctgcccaagagacctgccaaggatgatcctgagtccaaattcagccagcaacagtccttcgtacagattctccaggaggtgaatgactttgcaggccagcgggagctggtggctgagaacctcagtgtccgtgtatgtcttgagctgaccaagtactcacaagagatgaaacaggagaggaagatgcacttccaagaagggcggcgggcccagcagcagctggaaaatggctttaaacagctggagaatagtaagcgtaaatttgagcgggactgccgggaggcagagaaggcagcccagactgctgaacggctagaccaggatatcaacgccaccaaggctgatgtggagaaggccaagcagcaagcccaccttcggagtcacatggccgaagaaagcaaaaacgaatatgcggctcaactgcagcgcttcaaccgagaccaagcccacttctatttttcacagatgccccagatattcgataagctccaagacatggatgaacgcagggccacccgcctgggtgccgggtatgggctcctgtcggaggccgagctggaggtggtgcccataatagccaagtgcttggagggcatgaaggtggctgcaaatgctgtggatcccaagaacgactcccacgtccttatagagctgcacaagtcaggttttgcccgcccgggcgacgtggaattcgaggacttcagccagcccatgaaccgtgcaccctccgacagcagtctgggcaccccctcggatggacggcctgaactccgaggcccgggtcgcagccgcaccaagcgctggccttttggcaagaagaacaagcctcggccccccaaaccctctccccccgtcaaaacacagccaactgcgccactgccacccacaacgacacccaagaacacacacactaccacatccgcagaaaaccgtagaccacagagcaacaacaggaagggcacacgggacccagacaaggactgcaagaaccaaccagaaagaaataggcaccactctcaagccgaacttgcacactagacaccatcgagacaccgggaccaggcccgcacacgcaacacgcgg

SEQ ID NO: 456281 - DNA, 1015 bp, Homo sapiens
gtctccccggggagggcggcgggcggcgggcggcggggaccgggtgcggtggtggctgcggcggcggcggcgggagcagcatggattggggcactgagctgtgggatcagttcgaggtgctcgagcgccacacgcagtgggggctggacctgttggacagatatgtaaagttcgtgaaagaacgcaccgaagtggaacaggcttacgccaaacaactgcggagcctggtgaaaaaatatctgcccaagagacctgccaaggatgatcctgagtccaaattcagccagcaacagtccttcgtacagattctccaggaggtgaatgactttgcaggccagcgggagctggtggctgagaacctcagtgtccgtgtatgtcttgagctgaccaagtactcacaagagatgaaacaggagaggaagatgcacttccaagaagggcggcgggcccagcagcagctggaaaatggctttaaacagctggagaatgtgagtttgcagaggtagcagtgactgtggcccggaggcatgggggcagggttgcggatccggagtcagggagctgccctctttgtcagacctggaccttccctcccccataggcttccagtactcccttgacccctacttactggatgacatcccaataatccctgaaaccttggtttcccaccctgctgtctttgggatggtggctccctcactccggttctgtcccctacacagagtaagcgtaaatttgagcgggactgccgggaggcagagaaggcagcccagactgctgaacggctagaccaggatatcaacgccaccaaggctgatgtggagaaggccaagcagcaagcccaccttcggagtcacatggccgaagaaagcaaaaacgaatatgcggctcaactgcagcgcttcaaccgagaccaagcccacttctatttttcacagatgccccagatattcgatgtgagtgctcccagttctcagacctaccttcgctcgaagcctacaaatgctacccg

SEQ ID NO: 456282 - DNA, 463 bp, Homo sapiens
ggtcggcgggctgtggggtcccaaaatcgtgaccccggcccctctcccctcctcccccaccatgtcccatgtcaggatcagttcgaggtgctcgagcgccacacgcagtgggggctggacctgttggacagatatgtaaagttcgtgaaagaacgcaccgaagtggaacaggcttacgccaaacaactgcggagcctggtgaaaaaatatctgcccaagagacctgccaaggatgatcctgagtccaaattcagccagcaacagtccttcgtacagattctccaggaggtgaatgactttgcaggccagcgggagctggtggctgagaacctcagtgtccgtgtatgtcttgagctgaccaagtactcacaagagaattgcttgaactcgggaggcagaggtttcagtgagttgcaccccagcctgggcaacaagagtgaaactccatctcaaaaaaaaaaaa

SEQ ID NO: 456283 - DNA, 2295 bp, Homo sapiens
ggtcggcgggctgtggggtcccaaaatcgtgaccccggcccctctcccctcctcccccaccatgtcccatgtcaggatcagttcgaggtgctcgagcgccacacgcagtgggggctggacctgttggacagatatgtaaagttcgtgaaagaacgcaccgaagtggaacaggcttacgccaaacaactgcggagcctggtgaaaaaatatctgcccaagagacctgccaaggatgatcctgagtccaaattcagccagcaacagtccttcgtacagattctccaggaggtgaatgactttgcaggccagcgggagctggtggctgagaacctcagtgtccgtgtatgtcttgagctgaccaagtactcacaagagatgaaacaggagaggaagatgcacttccaagaagggcggcgggcccagcagcagctggaaaatggctttaaacagctggagaatagtaagcgtaaatttgagcgggactgccgggaggcagagaaggcagcccagactgctgaacggctagaccaggatatcaacgccaccaaggctgatgtggagaaggccaagcagcaagcccaccttcggagtcacatggccgaagaaagcaaaaacgaatatgcggctcaactgcagcgcttcaaccgagaccaagcccacttctatttttcacagatgccccagatattcgataagctccaagacatggatgaacgcagggccacccgcctgggtgccgggtatgggctcctgtcggaggccgagctggaggtggtgcccataatagccaagtgcttggagggcatgaaggtggctgcaaatgctgtggatcccaagaacgactcccacgtccttatagagctgcacaagtcaggttttgcccgcccgggcgacgtggaattcgaggacttcagccagcccatgaaccgtgcaccctccgacagcagtctgggcaccccctcggatggacggcctgaactccgaggcccgggtcgcagccgcaccaagcgctggccttttggcaagaagaacaagacagtggtgaccgaggattttagccacttgcccccagagcagcagcgaaaacggcttcaacagcagttggaagaacgcagtcgtgaacttcagaaggaggttgaccagagggaagccctaaagaaaatgaaggatgtctatgagaagacacctcagatgggggaccccgccagcttggagccccagatcgctgaaaccctgagcaacattgaacggctgaaattggaagtgcagaagtatgaggcgtggctggcagaagctgaaagtcgagtccttagcaaccggggagacagcctgagccggcacgcccggcctcccgacccccccgctagcgccccgccagacagcagcagcaacagcgcatcacaggacaccaaggagagctctgaagagcctccctcagaagagagccaggacacccccatttacacggagtttgatgaggatttcgaggaggaacccacatcccccataggtcactgtgtggccatctaccactttgaagggtccagcgagggcactatctctatggccgagggtgaagacctcagtcttatggaagaagacaaaggggacggctggacccgggtcaggcggaaagagggaggcgagggctacgtgcccacctcctacctccgagtcacgctcaattgaaccctgccagagacgggaagaggggggctgtcggctgctgcttctgggccacggggagccccaggacctatgcactttatttctgaccccgtggcttcggctgagacctgtgtaacctgctgccccctccacccccaacccagtcctacctgtcacaccggacggacccgctgtgccttctaccatcgttccaccattgatgtacatactcatgttttacatcttttctttctgccgctcggctccggccattttgttttatacaaaaatgggaaaaaaaaaaaagaaattatataaagttcctagagtcggtgtcttattagaggatttaaatactgggactggaagtatctaacaccacgtttcttacaggccacacagggaatgaggaaggggaggtgatcttgggcacaccttgggtcaaccctgcccctttctggaagttggcctatgtcattgtcagtgggtgtctgcttgtgactcaggtagggagaaggataccaagtttcttttttttttctttttgagacagtctcacccagttgcccaggctggagtgcagtggcgtacgtgatctcagctcactgcagactccatctcccgagt

SEQ ID NO: 456284 - DNA, 2355 bp, Homo sapiens
gtctccccggggagggcggcgggcggcgggcggcggggaccgggtgcggtggtggctgcggcggcggcggcgggagcagcatggattggggcactgagctgtgggatcagttcgaggtgctcgagcgccacacgcagtgggggctggacctgttggacagatatgtaaagttcgtgaaagaacgcaccgaagtggaacaggcttacgccaaacaactgcggagcctggtgaaaaaatatctgcccaagagacctgccaaggatgatcctgagtccaaattcagccagcaacagtccttcgtacagattctccaggaggtgaatgactttgcaggccagcgggagctggtggctgagaacctcagtgtccgtgtatgtcttgagctgaccaagtactcacaagagatgaaacaggagaggaagatgcacttccaagaagggcggcgggcccagcagcagctggaaaatggctttaaacagctggagaatagtaagcgtaaatttgagcgggactgccgggaggcagagaaggcagcccagactgctgaacggctagaccaggatatcaacgccaccaaggctgatgtggagaaggccaagcagcaagcccaccttcggagtcacatggccgaagaaagcaaaaacgaatatgcggctcaactgcagcgcttcaaccgagaccaagcccacttctatttttcacagatgccccagatattcgataagctccaagacatggatgaacgcagggccacccgcctgggtgccgggtatgggctcctgtcggaggccgagctggaggtggtgcccataatagccaagtgcttggagggcatgaaggtggctgcaaatgctgtggatcccaagaacgactcccacgtccttatagagctgcacaagtcaggttttgcccgcccgggcgacgtggaattcgaggacttcagccagcccatgaaccgtgcaccctccgacagcagtctgggcaccccctcggatggacggcctgaactccgaggcccgggtcgcagccgcaccaagcgctggccttttggcaagaagaacaagacagtggtgaccgaggattttagccacttgcccccagagcagcagcgaaaacggcttcaacagcagttggaagaacgcagtcgtgaacttcagaaggaggttgaccagagggaagccctaaagaaaatgaaggatgtctatgagaagacacctcagatgggggaccccgccagcttggagccccagatcgctgaaaccctgagcaacattgaacggctgaaattggaagtgcagaagtatgaggcgtggctggcagaagctgaaagtcgagtccttagcaaccggggagacagcctgagccggcacgcccggcctcccgacccccccgctagcgccccgccagacagcagcagcaacagcgcatcacaggacaccaaggagagctctgaagagcctccctcagaagagagccaggacacccccatttacacggagtttgatgaggatttcgaggaggaacccacatcccccataggtcactgtgtggccatctaccactttgaagatctgggcccacccccacccccatcacagggggtccagcgagggcactatctctatggccgagggtgaagacctcagtcttatggaagaagacaaaggggacggctggacccgggtcaggcggaaagagggaggcgagggctacgtgcccacctcctacctccgagtcacgctcaattgaaccctgccagagacgggaagaggggggctgtcggctgctgcttctgggccacggggagccccaggacctatgcactttatttctgaccccgtggcttcggctgagacctgtgtaacctgctgccccctccacccccaacccagtcctacctgtcacaccggacggacccgctgtgccttctaccatcgttccaccattgatgtacatactcatgttttacatcttttctttctgccgctcggctccggccattttgttttatacaaaaatgggaaaaaaaaaaaagaaattatataaagttcctagagtcggtgtcttattagaggatttaaatactgggactggaagtatctaacaccacgtttcttacaggccacacagggaatgaggaaggggaggtgatcttgggcacaccttgggtcaaccctgcccctttctggaagttggcctatgtcattgtcagtgggtgtctgcttgtgactcaggtagggagaaggataccaagtttcttttttttttctttttgagacagtctcacccagttgcccaggctggagtgcagtggcgtacgtgatctcagctcactgcagactccatctcccgagt

SEQ ID NO: 456285 - DNA, 1332 bp, Homo sapiens
atctcagacgggtgcagagtctggcaggctagactccttgatcccaaattcagccctctacccaccttgcagacagtggtgaccgaggattttagccacttgcccccagagcagcagcgaaaacggcttcaacagcagttggaagaacgcagtcgtgaacttcagaaggaggttgaccagagggaagccctaaagaaaatgaaggatgtctatgagaagacacctcagatgggggaccccgccagcttggagccccagatcgctgaaaccctgagcaacattgaacggctgaaattggaagtgcagaagtatgaggcgtggctggcagaagctgaaagtcgagtccttagcaaccggggagacagcctgagccggcacgcccggcctcccgacccccccgctagcgccccgccagacagcagcagcaacagcgcatcacaggacaccaaggagagctctgaagagcctccctcagaagagagccaggacacccccatttacacggagtttgatgaggatttcgaggaggaacccacatcccccataggtcactgtgtggccatctaccactttgaagggtccagcgagggcactatctctatggccgagggtgaagacctcagtcttatggaagaagacaaaggggacggctggacccgggtcaggcggaaagagggaggcgagggctacgtgcccacctcctacctccgagtcacgctcaattgaaccctgccagagacgggaagaggggggctgtcggctgctgcttctgggccacggggagccccaggacctatgcactttatttctgaccccgtggcttcggctgagacctgtgtaacctgctgccccctccacccccaacccagtcctacctgtcacaccggacggacccgctgtgccttctaccatcgttccaccattgatgtacatactcatgttttacatcttttctttctgccgctcggctccggccattttgttttatacaaaaatgggaaaaaaaaaaaagaaattatataaagttcctagagtcggtgtcttattagaggatttaaatactgggactggaagtatctaacaccacgtttcttacaggccacacagggaatgaggaaggggaggtgatcttgggcacaccttgggtcaaccctgcccctttctggaagttggcctatgtcattgtcagtgggtgtctgcttgtgactcaggtagggagaaggataccaagtttcttttttttttctttttgagacagtctcacccagttgcccaggctggagtgcagtggcgtacgtgatctcagctcactgcagactccatctcccgagt

SEQ ID NO: 456286 - DNA, 933 bp, Homo sapiens
  misc_feature (38)..(38): n is a, c, g, or t
  misc_feature (47)..(47): n is a, c, g, or t
tgacctagcaggatcttttagcagcccgacagcgcatnacaggacancaaggagagctctgaagagcctccctcagaagagagccaggacacccccatttacacggagtttgatgaggatttcgaggaggaacccacatcccccataggtcactgtgtggccatctaccactttgaagggtccagcgagggcactatctctatggccgagggtgaagacctcagtcttatggaagaagacaaaggggacggctggacccgggtcaggcggaaagagggaggcgagggctacgtgcccacctcctacctccgagtcacgctcaattgaaccctgccagagacgggaagaggggggctgtcggctgctgcttctgggccacggggagccccaggacctatgcactttatttctgaccccgtggcttcggctgagacctgtgtaacctgctgccccctccacccccaacccagtcctacctgtcacaccggacggacccgctgtgccttctaccatcgttccaccattgatgtacatactcatgttttacatcttttctttctgccgctcggctccggccattttgttttatacaaaaatgggaaaaaaaaaaaagaaattatataaagttcctagagtcggtgtcttattagaggatttaaatactgggactggaagtatctaacaccacgtttcttacaggccacacagggaatgaggaaggggaggtgatcttgggcacaccttgggtcaaccctgcccctttctggaagttggcctatgtcattgtcagtgggtgtctgcttgtgactcaggtagggagaaggataccaagtttcttttttttttctttttgagacagtctcacccagttgcccaggctggagtgcagtggcgtacgtgatctcagctcactgcagactccatctcccgagt

SEQ ID NO: 456287 - DNA, 1070 bp, Homo sapiens
gtctccccggggagggcggcgggcggcgggcggcggggaccgggtgcggtggtggctgcggcggcggcggcgggagcagcatggattggggcactgagctgtgggatcagttcgaggtgctcgagcgccacacgcagtgggggctggacctgttggacagatatgtaaagttcgtgaaagaacgcaccgaagtggaacaggcttacgccaaacaactgcggagcctggtgaaaaaatatctgcccaagagacctgccaaggatgatcctgagtccaaattcagccagcaacagtccttcgtacagattctccaggaggtgaatgactttgcaggccagcgggagctggtggctgagaacctcagtgtccgtgtatgtcttgagctgaccaagtactcacaagagatgaaacaggagaggaagatgcacttccaagaagggcggcgggcccagcagcagctggaaaatggctttaaacagctggagaatagtaagcgtaaatttgagcgggactgccgggaggcagagaaggcagcccagactgctgaacggctagaccaggatatcaacgccaccaaggctgatgtggagaaggccaagcagcaagcccaccttcggagtcacatggccgaagaaagcaaaaacgaatatgcggctcaactgcagcgcttcaaccgagaccaagcccacttctatttttcacagatgccccagatattcgataagctccaagacatggatgaacgcagggccacccgcctgggtgccgggtatgggctcctgtcggaggccgagctggaggtggtgcccataatagccaagtgcttggagggcatgaaggtggctgcaaatgctgtggatcccaagaacgactcccacgtccttatagagctgcacaagtcaggttttgcccgcccgggcgacgtggaattcgaggacttcagccagcccatgaaccgtgcaccctccgacagcagtctgggcaccccctcggatggacggcctgaactccgaggcccgggtcgcagccgcaccaagcgctggcctacagcacatgccggtaccgagctg

SEQ ID NO: 456288 - DNA, 732 bp, Homo sapiens
gctctgaagggagctttcatgtggccgaccaactctactccttgactcctcccttctctcattgaaaaaaaatgtttaaggggacatttctctctcctaaactttttatgttccattgaagacctggaaaacatgttaaataaaaatgctttgccacagctgacctatgtcttctggcttgtaccccacaacatcttatctaatggagccagtcttggtgctctgtgttcacctggttcatctgaggagctgcatctaccctgcccatgccatagatcctgccctgtttgcttctcctgttgctgctagtggacatgagaaggacagaataacgggctcccagattcacaagccccaccaagaggatcaccccaggaacgcttggaggctgaggagttcactgaggctactgcatcttgagactcaggatgaagacccagcttggggctgtcaaaggttttttgcatgtctgacacccatgactccacctggaccttatggctccacccagaagcaattcagcccaacaggaggacagcttcaacccattacgatttcatctctgccccaaccactcagcagcaagcacctgttacctgtccacccccaccccttcccccaaactgcctttgaaaaatccctaacctatgagctttgaataagatgagtacgaacttcatcgcccatgtggcgtggccggcctcgtgtctattaaattctttttctactaca

SEQ ID NO: 456289 - DNA, 1134 bp, Homo sapiens
gctctgaagggagctttcatgtggccgaccaactctactccttgactcctcccttctctcattgaaaaaaaatgtttaaggggacatttctctctcctaaactttttatgttccattgaagacctggaaaacatgttaaataaaaatgctttgccacagctgacctatgtcttctggcttgtaccccacaacatcttatctaatggagccagtcttggtgctctgtgttcacctggttcatctgaggagctgcatctaccctgcccatgccatagatcctgccctgtttgcttctcctgttgctgctagtggacatgagaaggacagaataacgggctcccagattcacaagccccaccaagaggatcaccccaggaacgcttggaggctgaggagttcactgaggctactgcatcttgagactcaggatgaagacccagcttggggctgtcaaaggttttttgcatgtctgacacccatgactccacctggaccttatggctccacccagaagcaattcagcccaacaggaggacagcttcaacccattacgatttcatctctgccccaaccactcagcagcaagcacctgttacctgtccacccccaccccttcccccaaactgcctttgaaaaatccctaacctatgagctttgaataagatgagtacgaacttcatcgcccatgtggcgtggccggcctcgtgtctattaaattctttttctactacagaacaagaaaaaacaactggcctccactggtctaaaagatggagatctccgaccccttcgctttagtgcggcacacacagtgaccctgcgtcactgctgaaatagccctcacacccctgcatcgcccagacgcaccatccccacataggaccatctcacccgatccgcttaattatccgtcgccccctattacccgttctcgtccattctatccaccgaccacccccacccagacgccacactagcccccacgcgtcacggacgcggctagccctccaccaccccccactcacaccatagacaccagcccccctgagactactacgccacaacacgaggacaccctccctccgatacctccctttcagttcgcctacgtctctactccacgcccactatgct

SEQ ID NO: 456290 - DNA, 1132 bp, Homo sapiens
cgccagccccgcgctcctccgggcagagcgcgtgtggcggccgagcacatgggcccgcgggccgggcgggctcggggcggccgggacgaggaggggcgacgacgagctgcgagcaaagatgtgccccgggacccccggcaccttccagtggatttccttgcggaaaggatgttggcggtccctgtgacctgtggagacacggccagatctgccctccaatggcatcaccagaaaccaagaagatggtaaggcctggaggtggcagagctgaagagagtacatgacccagcagaagaaataagcacaaatacaaatggtgacagaaaaataagatgtgtcacaactgacttagattccaacaaccacaacagcacagaggaggaagcgaggtggtgctccctggaatgacccaaacacaacaatatctgagcttgctcttgaaggactagcagtttaccaagcaaaatggaaaacagaaattgagtccaggtctagatatcaagaagcacaaagagatccacaaaagaccatggagaattcaaagaccagcaacaggcttcaaaagccttctatgaatagggcatgcatggacccttctcctctcaccccccagcacatatgaaggggtatggacagtgttggaacaagatggtcttggattcagaaataaaaggagtcagaagctgaagacctaagggtaacacaagacttccgggttctggccgggcgcggtggctcacgcctgtaatcccagcactttgggaggccgaggcgggcggatcacgaggtcaggagatcgagaccatcccggctaaaacggcgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaagacttccgggttctgaaagcagtgcagcttggaattttcagaaagtgaattgacttcctgtagctgattgttttttattttaggaaaataaaaattattactttttgtttaaatg

SEQ ID NO: 456291 - DNA, 1034 bp, Homo sapiens
tctttatgtaaatatgcactcatttaaatatcatgtgggcacctcctctgagtggccctgagcttggttcttggatgtagcactgcacaagagaaaccaggtctctgctctcctggagatcgatgcatccagtgtggggcacagactcaaatcaaggcaatagaccaaaacctaagcaggccactaacttgtgtttaagtacaacatccacatggacgggaatgagaattacagggggagcacacttgagctgcggtccagcaaagccctctctggggaggtgacagtcaagcccagacctaaaggaacctgctgcagggaggatgggaaagatgttctgacaaaggccttgagatggggaaggctatggtttagatgaggaacttcagttggtcatcccctctctcatccatcctgttgaaaccacctttgcaaaaggtgtgtcaatgagaaaattataacagtaagctaagccaacccaacctccatcttgcttttctcttaattattcctgggctattgggtcaagctaactttggaagacatttaggctacagtttaaatgataataggccttgcccaaaactcagccacttttgtaaagctgttagggggccatgagggtgcggggaggagaagagcctgaatcctactaagctgcagacattattccgaaggttataagatatgcaactttcccaattgctcctgtgaataacactactattacagattggccttttgaaatatctttccaggttttttgcatgtctgacacccatgactccacctggaccttatggctccacccagaagcaattcagcccaacaggaggacagcttcaacccattacgatttcatctctgccccaaccactcagcagcaagcacctgttacctgtccacccccaccccttcccccaaactgcctttgaaaaatccctaacctatgagctttgaataagatgagtacgaacttcatcgcccatgtggcgtggccggcctcgtgtctattaaattctttttctactaca

SEQ ID NO: 456292 - DNA, 528 bp, Homo sapiens
cgccagccccgcgctcctccgggcagagcgcgtgtggcggccgagcacatgggcccgcgggccgggcgggctcggggcggccgggacgaggaggggcgacgacgagctgcgagcaaagatgtgccccgggacccccggcaccttccagtggatttccttgcggaaaggatgttggcggtccctgtgacctgtggagacacggccagatctgccctccagatttattaggagaaaaaccttcccggaagctgcagaaggacaaatacagaatccgtgtctgggagaaacctcgtggcctggtctccattatttgagatgagttacatcttggaggaccatagctgtctgcagtgcaggaagccaactataaggggaaacaaaagtgttcttaggagtcctgctgtcactgtggattgagccggtgaagccctgagggatttcatcgctgaggtggatggagaagcagctgggggccttggctgtaaggacccctaagggaactgtggctgcaccatctgtcttcatctt

SEQ ID NO: 456293 - DNA, 857 bp, Homo sapiens
acgtaatatactccagtttgcaaatgaaggaatcttcctgcggaacgtatgtgaagcgcatattggtgctctgggcttttgcataatttcaaatgtcctttttttttttaaacttaaggctaatgtttagaagcttttgctaatgagaggaccatttgctaaatcggtataagtgctacacatttgggtatctccatcccaacatacctcttattgccattccccaaagcagacaccttctcctccctccctcaaggacctctgagcttgcactccaattcctctcccacactcacctttctcctttctgttcctcttgggatccaggtttatttgaggagataggaaaagctcctgatccagcaggttttattcttaaatttgtaacaaagtaaatcacagaacctccacccagcatccaggcctctggttctctccctccttcccaggtataggccggctttcagaaaccctgcaccacatagaccctgggcctgaattgctgtgagtaataatgactctgctggtaatttgtgtccttctgcttggaactgtttcctttttagtttggtcaccctcccagagctggtttcaatgggggcatacccattatgggatgcagggcatcctgcatcctgaggaattttttttcctccaaaaatgaaaccttgaaatgaggacattgtcctgtccacggactgcacaacaacactgagcctcaaggactcatactggcatttttcttcttttgcagagtgtgggcaccctggcttcaagctcacgagaaaccaggtcgggatttaaacaatgttgggttaaagcaaagtttcataaagacagaatcaagaaaaaaaaaa

SEQ ID NO: 456294 - DNA, 1401 bp, Homo sapiens
cgccagccccgcgctcctccgggcagagcgcgtgtggcggccgagcacatgggcccgcgggccgggcgggctcggggcggccgggacgaggaggggcgacgacgagctgcgagcaaagatgtgccccgggacccccggcaccttccagtggatttccttgcggaaaggatgttggcggtccctgtgacctgtggagacacggccagatctgccctccataacacaaggaagtgaagcaatttgctcaagataatgtgtctagtcatcaaaaggactggtcagtgcctcgatcttgatgatgatggatactgcttattggatactctcacatctcaacaatccaaacaccttccacaatgacctgcttaatctgacccctggcacatctcaaatcacagtctctgtctgtagtagataaaaaaaaatggacacacactttgcaataccacccatcaagagattaagtaactttcttcatcccttgaatctagtgggctcttgtgactaccaatagaatttggtggaagtgacactctgccttctgcaacaaggcacctgtgctgaaggagacttttagcctctgcccttgcctccctgaatagtgcctccatgtgaagaagaccaagctaacctactagagacatggctccaccaagaaccagtagcagctgcctggacaaggccatcttagaccacccaaccctagtcaagacagcagaatgactgcagctcggtgaattgtgttttaagctgctaagttttcagtggtttattaggcagcaatacataactgaaataccctttcaccctcccgactttaggctccagcctttctgatcttctcttaagccttggaacatgccattgacttttccaccctgagactttgcatgttattccttatgcataaaatacattcctctttccacctgtcaaatggtttaactcccttttatcatttaggccactagcttaaaattcacatgcagagagaattctttactgagcaaccatataccccagatttcttattcttcatatcaggcttttcttattttttcattgcgcatatcacaaagggcaattaattaattaattgtttgtttgtttgttattgcctattttccccctatccagatgtaagctccatgagagtggttggaggcaatgtttattctgttttccacttcaccttaagagagtgcgggaagagggtctcatccatatttctttggatccttttatcattttcctgcatactttcactgagagtgctctcatgtccatcagccagcacttgcttctcttttctgagggctgccccaggctcctgaagtccagcttggattgcctgcatgaaaacatagagagctaaaggctgggaacttgcatagccttagc

SEQ ID NO: 456295 - DNA, 413 bp, Homo sapiens
cgccagccccgcgctcctccgggcagagcgcgtgtggcggccgagcacatgggcccgcgggccgggcgggctcggggcggccgggacgaggaggggcgacgacgagctgcgagcaaagatgtgccccgggacccccggcaccttccagtggatttccttgcggaaaggatgttggcggtccctgtgacctgtggagacacggccagatctgccctccagaccatagctgtctgcagtgcaggaagccaactataaggggaaacaaaagtgttcttaggagtcctgctgtcactgtggattgagccggtgaagccctgagggatttcatcgctgaggtggatggagaagcagctgggggccttggctgtaaggacccctaagggaactgtggctgcaccatctgtcttcatctt

SEQ ID NO: 456296 - DNA, 743 bp, Homo sapiens
cgccagccccgcgctcctccgggcagagcgcgtgtggcggccgagcacatgggcccgcgggccgggcgggctcggggcggccgggacgaggaggggcgacgacgagctgcgagcaaagatgtgccccgggacccccggcaccttccagtggatttccttgcggaaaggatgttggcggtccctgtgacctgtggagacacggccagatctgccctccagatttattaggagaaaaaccttcccggaagctgcagaaggacaaatacagaatccgtgtctgggagaaacctcgtggcctggtctccattatttgagatgagttacatcttggagatggcatcaccagaaaccaagaagatggtaaggcctggaggtggcagagctgaagagagtacatgacccagcagaagaaataagcacaaatacaaatggtgacagaaaaataagatgtgtcacaactgacttagattccaacaaccacaacagcacagaggaggaagcgaggtggtgctccctggaatgacccaaacacaacaatatctgagcttgctcttgaaggactagcagtttaccaagcaaaatggaaaacagaaattgagtccaggtctagatatcaagaagcacaaagagatccacaaaagaccatggagaattcaaagaccagcaacaggcttcaaaagccttctatgaatagggcatgtaaggatttgctgggggcaagggtgggtttgagagctggagat

SEQ ID NO: 456297 - DNA, 1890 bp, Homo sapiens
cgccagccccgcgctcctccgggcagagcgcgtgtggcggccgagcacatgggcccgcgggccgggcgggctcggggcggccgggacgaggaggggcgacgacgagctgcgagcaaagatgtgccccgggacccccggcaccttccagtggatttccttgcggaaaggatgttggcggtccctgtgacctgtggagacacggccagatctgccctccagcctgatcttttggccagaaggagattaaaaagatgcccctcaagatggctgtgcctgtcagctgcatggagcttcgttcaagtattttctgagcctgatggatttacagtgatcttcagtggtctggggaataacgctggtggaaccatgcactggaatgacacacgcccggcacatttcaggatactaaaagtggttttaagggaggctgtggctgaatgcctcatggattcttacagcttggatgtccatgggggacgaaggactgcagctggctgagagggttgagatctctgtttacttagatctctgccaacttcctttgggtctccctatggaatgtaagaccccgactcttcctggtgaagcatctgatgcacgttccatccggcgctcagctgggcttgagctgaccatactccctggagccttctcccgaggtgcgcgggtgaccttggcacatacagccatcatgatggtactttaagtggaggctgaatcatctcccctttgagctgcttggcacgtggctcccttggtgttccccttttactgccaggacactgagatttggagagaatcctgttacacctgggatttaggcactttcaatctgaaaaaatacatatcctttcagcactctggacggacttgagaactgtccttacgtgacctaaagctggagtattttgagattggagaattaagagtgtgggcaccctggcttcaagctcacgagaaaccagaaggaagtcactgtgcatagccatcccctaagaagagggcattcctgctcttccttctccatggctagaggatctacatgaactatttagattttttctacctgggagatttaactcctctctcctatttatttatttatatatcagcatggacttgcaggccaacagagattttgagaaacacattgaaggatctgttaacacttgatatacccaataaaagcagtggttgtgccagtgctgatctgtcttgatgtgaatgtgaacaatgggaacctgagctgagcagttaatgctagggtgacagaaactggacctctcccaagacatgtgacagagtaatacagcagccaacttcttcgccaaattaaagttttacaagatttaacctgtcatcaagacctgggattttggtgatcttggacatgatacctggatgtgcagcagccatctggtaattatgaggtgacaagtcaatagactgagatggtggagcagcaaagatagaaaagaaggacagaataacgggctcccagattcacaagccccaccaagaggatcaccccaggaacgcttggaggctgaggagttcactgaggctactgcatcttgagactcaggatgaagacccagcttggggctgtcaaaggttttttgcatgtctgacacccatgactccacctggaccttatggctccacccagaagcaattcagcccaacaggaggacagcttcaacccattacgatttcatctctgccccaaccactcagcagcaagcacctgttacctgtccacccccaccccttcccccaaactgcctttgaaaaatccctaacctatgagctttgaataagatgagtacgaacttcatcgcccatgtggcgtggccggcctcgtgtctattaaattctttttctactaca

SEQ ID NO: 456298 - DNA, 1704 bp, Homo sapiens
cgccagccccgcgctcctccgggcagagcgcgtgtggcggccgagcacatgggcccgcgggccgggcgggctcggggcggccgggacgaggaggggcgacgacgagctgcgagcaaagatgtgccccgggacccccggcaccttccagtggatttccttgcggaaaggatgttggcggtccctgtgacctgtggagacacggccagatctgccctccagcctgatcttttggccagaaggagattaaaaagatgcccctcaagatggctgtgcctgtcagctgcatggagcttcgttcaagtattttctgagcctgatggatttacagtgatcttcagtggtctggggaataacgctggtggaaccatgcactggaatgacacacgcccggcacatttcaggatactaaaagtggttttaagggaggctgtggctgaatgcctcatggattcttacagcttggatgtccatgggggacgaaggactgcagctggctgagagggttgagatctctgtttacttagatctctgccaacttcctttgggtctccctatggaatgtaagaccccgactcttcctggtgaagcatctgatgcacgttccatccggcgctcagctgggcttgagctgaccatactccctggagccttctcccgaggtgcgcgggtgaccttggcacatacagccatcatgatggtactttaagtggaggctgaatcatctcccctttgagctgcttggcacgtggctcccttggtgttccccttttactgccaggacactgagatttggagagaatcctgttacacctgggatttaggcactttcaatctgaaaaaatacatatcctttcagcactctggacggacttgagaactgtccttacgtgacctaaagctggagtattttgagattggagaattaaggctacagagaaacaaggagacgggagagccttgaaatggaccttcaagattacaatgtgtagctgacattgtcagttaagttgggcagatctgacttcgctgattaagtggatgtatgagccgatcctccccagaagctgggatcagcttccccatctgatgagccagtcttggtgctctgtgttcacctggttcatctgaggagctgcatctaccctgcccatgccatagatcctgccctgtttgcttctcctgttgctgctagtggacatgaggtaaccacagcctagttctgtgataagctcttcacacctgtacccatatggactgtgggagagtttctctgatatggactgtgatgcggaaggacagaataacgggctcccagattcacaagccccaccaagaggatcaccccaggaacgcttggaggctgaggagttcactgaggctactgcatcttgagactcaggatgaagacccagcttggggctgtcaaaggttttttgcatgtctgacacccatgactccacctggaccttatggctccacccagaagcaattcagcccaacaggaggacagcttcaacccattacgatttcatctctgccccaaccactcagcagcaagcacctgttacctgtccacccccaccccttcccccaaactgcctttgaaaaatccctaacctatgagctttgaataagatgagtacgaacttcatcgcccatgtggcgtggccggcctcgtgtctattaaattctttttctactaca

SEQ ID NO: 456299 - DNA, 1704 bp, Homo sapiens
cgccagccccgcgctcctccgggcagagcgcgtgtggcggccgagcacatgggcccgcgggccgggcgggctcggggcggccgggacgaggaggggcgacgacgagctgcgagcaaagatgtgccccgggacccccggcaccttccagtggatttccttgcggaaaggatgttggcggtccctgtgacctgtggagacacggccagatctgccctccagcctgatcttttggccagaaggagattaaaaagatgcccctcaagatggctgtgcctgtcagctgcatggagcttcgttcaagtattttctgagcctgatggatttacagtgatcttcagtggtctggggaataacgctggtggaaccatgcactggaatgacacacgcccggcacatttcaggatactaaaagtggttttaagggaggctgtggctgaatgcctcatggattcttacagcttggatgtccatgggggacgaaggactgcagctggctgagagggttgagatctctgtttacttagatctctgccaacttcctttgggtctccctatggaatgtaagaccccgactcttcctggtgaagcatctgatgcacgttccatccggcgctcagctgggcttgagctgaccatactccctggagccttctcccgaggtgcgcgggtgaccttggcacatacagccatcatgatggtactttaagtggaggctgaatcatctcccctttgagctgcttggcacgtggctcccttggtgttccccttttactgccaggacactgagatttggagagaatcctgttacacctgggatttaggcactttcaatctgaaaaaatacatatcctttcagcactctggacggacttgagaactgtccttacgtgacctaaagctggagtattttgagattggagaattaaggctacagagaaacaaggagacgggagagccttgaaatggaccttcaagattacaatgtgtagctgacattgtcagttaagttgggcagatctgacttcgctgattaagtgaatgtatgagccgatcctccccagaagctgggatcagcttccccatctgatgagccagtcttggtgctctgtgttcacctggttcatctgaggagctgcatctaccctgcccatgccatagatcctgccctgtttgcttctcctgttgctgctagtggacatgaggtaaccacagcctagttctgtgataagctcttcacacctgtacccatatggactgtgggagagtttctctgatatggactgtgatgcggaaggacagaataacgggctcccagattcacaagccccaccaagaggatcaccccaggaacgcttggaggctgaggagttcactgaggctactgcatcttgagactcaggatgaagacccagcttggggctgtcaaaggttttttgcatgtctgacacccatgactccacctggaccttatggctccacccagaagcaattcagcccaacaggaggacagcttcaacccattacgatttcatctctgccccaaccactcagcagcaagcacctgttacctgtccacccccaccccttcccccaaactgcctttgaaaaatccctaacctatgagctttgaataagatgagtacgaacttcatcgcccatgtggcgtggccggcctcgtgtctattaaattctttttctactaca

SEQ ID NO: 456300 - DNA, 2269 bp, Homo sapiens
cgccagccccgcgctcctccgggcagagcgcgtgtggcggccgagcacatgggcccgcgggccgggcgggctcggggcggccgggacgaggaggggcgacgacgagctgcgagcaaagatgtgccccgggacccccggcaccttccagtggatttccttgcggaaaggatgttggcggtccctgtgacctgtggagacacggccagatctgccctccagcctgatcttttggccagaaggagattaaaaagatgcccctcaagatggctgtgcctgtcagctgcatggagcttcgttcaagtattttctgagcctgatggatttacagtgatcttcagtggtctggggaataacgctggtggaaccatgcactggaatgacacacgcccggcacatttcaggatactaaaagtggttttaagggaggctgtggctgaatgcctcatggattcttacagcttggatgtccatgggggacgaaggactgcagctggctgagagggttgagatctctgtttacttagatctctgccaacttcctttgggtctccctatggaatgtaagaccccgactcttcctggtgaagcatctgatgcacgttccatccggcgctcagctgggcttgagctgaccatactccctggagccttctcccgaggtgcgcgggtgaccttggcacatacagccatcatgatggtactttaagtggaggctgaatcatctcccctttgagctgcttggcacgtggctcccttggtgttccccttttactgccaggacactgagatttggagagaatcctgttacacctgggatttaggcactttcaatctgaaaaaatacatatcctttcagcactctggacggacttgagaactgtccttacgtgacctaaagctggagtattttgagattggagaattaagagtgtgggcaccctggcttcaagctcacgagaaaccagaaggaagtcactgtgcatagccatcccctaagaagagggcattcctgctcttccttctccatggctagaggatctacatgaactatttagattttttctacctgggagatttaactcctctctcctatttatttatttatatatcagcatggacttgcaggccaacagagattttgagaaacacattgaaggatctgttaacacttgatatacccaataaaagcagtggttgtgccagtgctgatctgtcttgatgtgaatgtgaacaatgggaacctgagctgagcagttaatgctagggtgacagaaactggacctctcccaagacatgtgacagagtaatacagcagccaacttcttcgccaaattaaagttttacaagatttaacctgtcatcaagacctgggattttggtggacaaccatgtcgtgatgatgatgatgacgacgatgacagcgatggcggtggtgaaagaggaagacatcccttcatttcatgtagcaatctgcttcttgctgggatttcaaatccattttcattgttgatcctgagaacaagccttggaggcggaatcattttgaaatcccaggaaaccgggccttaagagacggctgaagacccgagcagtcattcggtggagtctgtgaggcccagagctgaggaggaggacatgggtgtagaaacggtcgcagcccacactgctgtgcctacagctctggatcctgactgtgtgagtgggcccagggctgctggaacctgtggagctatagcaagaaggagccagtcttggtgctctgtgttcacctggttcatctgaggagctgcatctaccctgcccatgccatagatcctgccctgtttgcttctcctgttgctgctagtggacatgagaaggacagaataacgggctcccagattcacaagccccaccaagaggatcaccccaggaacgcttggaggctgaggagttcactgaggctactgcatcttgagactcaggatgaagacccagcttggggctgtcaaaggttttttgcatgtctgacacccatgactccacctggaccttatggctccacccagaagcaattcagcccaacaggaggacagcttcaacccattacgatttcatctctgccccaaccactcagcagcaagcacctgttacctgtccacccccaccccttcccccaaactgcctttgaaaaatccctaacctatgagctttgaataagatgagtacgaacttcatcgcccatgtggcgtggccggcctcgtgtctattaaattctttttctactaca

SEQ ID NO: 456301 - DNA, 1808 bp, Homo sapiens
gtgttaccagttatggaggattatcgttagggagttacactctgttaggtccaaacacaaggaggaaagagtgactgaatactgctctgagtcagtgactgtgacaagactgtttttttcttcttccctgttgcaggcctgatcttttggccagaaggagattaaaaagatgcccctcaagatggctgtgcctgtcagctgcatggagcttcgttcaagtattttctgagcctgatggatttacagtgatcttcagtggtctggggaataacgctggtggaaccatgcactggaatgacacacgcccggcacatttcaggatactaaaagtggttttaagggaggctgtggctgaatgcctcatggattcttacagcttggatgtccatgggggacgaaggactgcagctggctgagagggttgagatctctgtttacttagatctctgccaacttcctttgggtctccctatggaatgtaagaccccgactcttcctggtgaagcatctgatgcacgttccatccggcgctcagctgggcttgagctgaccatactccctggagccttctcccgaggtgcgcgggtgaccttggcacatacagccatcatgatggtactttaagtggaggctgaatcatctcccctttgagctgcttggcacgtggctcccttggtgttccccttttactgccaggacactgagatttggagagaatcctgttacacctgggatttaggcactttcaatctgaaaaaatacatatcctttcagcactctggacggacttgagaactgtccttacgtgacctaaagctggagtattttgagattggagaattaagagtgtgggcaccctggcttcaagctcacgagaaaccagaaggaagtcactgtgcatagccatcccctaagaagagggcattcctgctcttccttctccatggctagaggatctacatgaactatttagattttttctacctgggagatttaactcctctctcctatttatttatttatatatcagcatggacttgcaggccaacagagattttgagaaacacattgaaggatctgttaacacttgatatacccaataaaagcagtggttgtgccagtgctgatctgtcttgatgtgaatgtgaacaatgggaacctgagctgagcagttaatgctagggtgacagaaactggacctctcccaagacatgtgacagagtaatacagcagccaacttcttcgccaaattaaagttttacaagatttaacctgtcatcaagacctgggattttggtgatcttggacatgatacctggatgtgcagcagccatctggtaattatgaggtgacaagtcaatagactgagatggtggagcagcaaagatagaaaagaaggacagaataacgggctcccagattcacaagccccaccaagaggatcaccccaggaacgcttggaggctgaggagttcactgaggctactgcatcttgagactcaggatgaagacccagcttggggctgtcaaaggttttttgcatgtctgacacccatgactccacctggaccttatggctccacccagaagcaattcagcccaacaggaggacagcttcaacccattacgatttcatctctgccccaaccactcagcagcaagcacctgttacctgtccacccccaccccttcccccaaactgcctttgaaaaatccctaacctatgagctttgaataagatgagtacgaacttcatcgcccatgtggcgtggccggcctcgtgtctattaaattctttttctactaca

SEQ ID NO: 456302 - DNA, 1171 bp, Homo sapiens
cgccagccccgcgctcctccgggcagagcgcgtgtggcggccgagcacatgggcccgcgggccgggcgggctcggggcggccgggacgaggaggggcgacgacgagctgcgagcaaagatgtgccccgggacccccggcaccttccagtggatttccttgcggaaaggatgttggcggtccctgtgacctgtggagacacggccagatctgccctccagcctgatcttttggccagaaggagattaaaaagatgcccctcaagatggctgtgcctgtcagctgcatggagcttcgttcaagtattttctgagcctgatggatttacagtgatcttcagtggtctggggaataacgctggtggaaccatgcactggaatgacacacgcccggcacatttcaggatactaaaagtggttttaagggaggctgtggctgaatgcctcatggattcttacagcttggatgtccatgggggacgaaggactgcagctggctgagagggttgagatctctgtttacttagatctctgccaacttcctttgggtctccctatggaatgtaagaccccgactcttcctggtgaagcatctgatgcacgttccatccggcgctcagctgggcttgagaatcctgttacacctgggatttaggcactttcaatctgaaaaaatacatatcctttcagcactctggacggacttgagaactgtccttacgtgacctaaagctggagtattttgagattggagaattaagaaggacagaataacgggctcccagattcacaagccccaccaagaggatcaccccaggaacgcttggaggctgaggagttcactgaggctactgcatcttgagactcaggatgaagacccagcttggggctgtcaaaggttttttgcatgtctgacacccatgactccacctggaccttatggctccacccagaagcaattcagcccaacaggaggacagcttcaacccattacgatttcatctctgccccaaccactcagcagcaagcacctgttacctgtccacccccaccccttcccccaaactgcctttgaaaaatccctaacctatgagctttgaataagatgagtacgaacttcatcgcccatgtggcgtggccggcctcgtgtctattaaattctttttctactaca

SEQ ID NO: 456303 - DNA, 2121 bp, Homo sapiens
agcttcggcacaagggcccaactggaattccacttacggacggagtctccttctgtcgcccaggctggagtgcagtggcgagatctcggctcactgcaagctccgcctcccgggttcacgccattctcctgcctcagcctcccgagtagctgggactacaggcacccgcccaccacgcccggctaagtttttgtatttttagtagagacgaggtttcaccatgttagccaggatggtttcgatctcctgacctcgtgatccgcccgccttggcctcccaaagtgctgggattacaggcgtgagccgccgcgcccagccccaggcggaaattatttcaactgggtcctgagaactgggcacttttcaaggattgtcagcaaggagcaacttcccaaatatacatctaaaaagatgacaaactcatgtggaatgtggatttaaggaggaaggcctgatcttttggccagaaggagattaaaaagatgcccctcaagatggctgtgcctgtcagctgcatggagcttcgttcaagtattttctgagcctgatggatttacagtgatcttcagtggtctggggaataacgctggtggaaccatgcactggaatgacacacgcccggcacatttcaggatactaaaagtggttttaagggaggctgtggctgaatgcctcatggattcttacagcttggatgtccatgggggacgaaggactgcagctggctgagagggttgagatctctgtttacttagatctctgccaacttcctttgggtctccctatggaatgtaagaccccgactcttcctggtgaagcatctgatgcacgttccatccggcgctcagctgggcttgagctgaccatactccctggagccttctcccgaggtgcgcgggtgaccttggcacatacagccatcatgatggtactttaagtggaggctgaatcatctcccctttgagctgcttggcacgtggctcccttggtgttccccttttactgccaggacactgagatttggagagaatcctgttacacctgggatttaggcactttcaatctgaaaaaatacatatcctttcagcactctggacggacttgagaactgtccttacgtgacctaaagctggagtattttgagattggagaattaagagtgtgggcaccctggcttcaagctcacgagaaaccagaaggaagtcactgtgcatagccatcccctaagaagagggcattcctgctcttccttctccatggctagaggatctacatgaactatttagattttttctacctgggagatttaactcctctctcctatttatttatttatatatcagcatggacttgcaggccaacagagattttgagaaacacattgaaggatctgttaacacttgatatacccaataaaagcagtggttgtgccagtgctgatctgtcttgatgtgaatgtgaacaatgggaacctgagctgagcagttaatgctagggtgacagaaactggacctctcccaagacatgtgacagagtaatacagcagccaacttcttcgccaaattaaagttttacaagatttaacctgtcatcaagacctgggattttggtgatcttggacatgatacctggatgtgcagcagccatctggtaattatgaggtgacaagtcaatagactgagatggtggagcagcaaagatagaaaagaaggacagaataacgggctcccagattcacaagccccaccaagaggatcaccccaggaacgcttggaggctgaggagttcactgaggctactgcatcttgagactcaggatgaagacccagcttggggctgtcaaaggttttttgcatgtctgacacccatgactccacctggaccttatggctccacccagaagcaattcagcccaacaggaggacagcttcaacccattacgatttcatctctgccccaaccactcagcagcaagcacctgttacctgtccacccccaccccttcccccaaactgcctttgaaaaatccctaacctatgagctttgaataagatgagtacgaacttcatcgcccatgtggcgtggccggcctcgtgtctattaaattctttttctactaca

SEQ ID NO: 456304 - DNA, 1842 bp, Homo sapiens
cagtcaagaagggggttgtatcaatcctcagaaccctgagtggaactttctacaggatttattaggagaaaaaccttcccggaagctgcagaaggacaaatacagaatccgtgtctgggagaaacctcgtggcctggtctccattatttgagatgagttacatcttggaggcctgatcttttggccagaaggagattaaaaagatgcccctcaagatggctgtgcctgtcagctgcatggagcttcgttcaagtattttctgagcctgatggatttacagtgatcttcagtggtctggggaataacgctggtggaaccatgcactggaatgacacacgcccggcacatttcaggatactaaaagtggttttaagggaggctgtggctgaatgcctcatggattcttacagcttggatgtccatgggggacgaaggactgcagctggctgagagggttgagatctctgtttacttagatctctgccaacttcctttgggtctccctatggaatgtaagaccccgactcttcctggtgaagcatctgatgcacgttccatccggcgctcagctgggcttgagctgaccatactccctggagccttctcccgaggtgcgcgggtgaccttggcacatacagccatcatgatggtactttaagtggaggctgaatcatctcccctttgagctgcttggcacgtggctcccttggtgttccccttttactgccaggacactgagatttggagagaatcctgttacacctgggatttaggcactttcaatctgaaaaaatacatatcctttcagcactctggacggacttgagaactgtccttacgtgacctaaagctggagtattttgagattggagaattaagagtgtgggcaccctggcttcaagctcacgagaaaccagaaggaagtcactgtgcatagccatcccctaagaagagggcattcctgctcttccttctccatggctagaggatctacatgaactatttagattttttctacctgggagatttaactcctctctcctatttatttatttatatatcagcatggacttgcaggccaacagagattttgagaaacacattgaaggatctgttaacacttgatatacccaataaaagcagtggttgtgccagtgctgatctgtcttgatgtgaatgtgaacaatgggaacctgagctgagcagttaatgctagggtgacagaaactggacctctcccaagacatgtgacagagtaatacagcagccaacttcttcgccaaattaaagttttacaagatttaacctgtcatcaagacctgggattttggtgatcttggacatgatacctggatgtgcagcagccatctggtaattatgaggtgacaagtcaatagactgagatggtggagcagcaaagatagaaaagaaggacagaataacgggctcccagattcacaagccccaccaagaggatcaccccaggaacgcttggaggctgaggagttcactgaggctactgcatcttgagactcaggatgaagacccagcttggggctgtcaaaggttttttgcatgtctgacacccatgactccacctggaccttatggctccacccagaagcaattcagcccaacaggaggacagcttcaacccattacgatttcatctctgccccaaccactcagcagcaagcacctgttacctgtccacccccaccccttcccccaaactgcctttgaaaaatccctaacctatgagctttgaataagatgagtacgaacttcatcgcccatgtggcgtggccggcctcgtgtctattaaattctttttctactaca

SEQ ID NO: 456305 - DNA, 1184 bp, Homo sapiens
agtgatccactcactttggcctttcaacgtgctgggattacaggcgagagtcaccgcacccggacgactctgacatttttgaagagtccagaatcctgttacacctgggatttaggcactttcaatctgaaaaaatacatatcctttcagcactctggacggacttgagaactgtccttacgtgacctaaagctggagtattttgagattggagaattaagagtgtgggcaccctggcttcaagctcacgagaaaccagaaggaagtcactgtgcatagccatcccctaagaagagggcattcctgctcttccttctccatggctagaggatctacatgaactatttagattttttctacctgggagatttaactcctctctcctatttatttatttatatatcagcatggacttgcaggccaacagagattttgagaaacacattgaaggatctgttaacacttgatatacccaataaaagcagtggttgtgccagtgctgatctgtcttgatgtgaatgtgaacaatgggaacctgagctgagcagttaatgctagggtgacagaaactggacctctcccaagacatgtgacagagtaatacagcagccaacttcttcgccaaattaaagttttacaagatttaacctgtcatcaagacctgggattttggtgatcttggacatgatacctggatgtgcagcagccatctggtaattatgaggtgacaagtcaatagactgagatggtggagcagcaaagatagaaaagaaggacagaataacgggctcccagattcacaagccccaccaagaggatcaccccaggaacgcttggaggctgaggagttcactgaggctactgcatcttgagactcaggatgaagacccagcttggggctgtcaaaggttttttgcatgtctgacacccatgactccacctggaccttatggctccacccagaagcaattcagcccaacaggaggacagcttcaacccattacgatttcatctctgccccaaccactcagcagcaagcacctgttacctgtccacccccaccccttcccccaaactgcctttgaaaaatccctaacctatgagctttgaataagatgagtacgaacttcatcgcccatgtggcgtggccggcctcgtgtctattaaattctttttctactaca

SEQ ID NO: 456306 - DNA, 1261 bp, Homo sapiens
tcccttcttttttctttctttttttgacggagtcctgctctttgcccaggctggagtgcagtggtgcaatctcggcttgctgcaacctccatctcccaggcaggttcaagtaattctcctgcctaagcctcccgagtagctgggactacaggcacctaccaccacacctttttttttttttagtagagacaggatttcactgtgttagacaatcctgcctccctccctccctccctttcttccttccttccttctttccttccttccttctttccctccttccttcctctcttctcctctcctctcttaccctcccctccccttctgtctcctctgctcccctgccctcccttctcctccttctccttctcctttttcttcttctctttgttgtccaggctggagtacagtggaaggatcatggcccactgtagcctagacatcccaggctgaaatgatcctctctcctcagcctcccaagtacctgggactacaggccaacagagattttgagaaacacattgaaggatctgttaacacttgatatacccaataaaagcagtggttgtgccagtgctgatctgtcttgatgtgaatgtgaacaatgggaacctgagctgagcagttaatgctagggtgacagaaactggacctctcccaagacatgtgacagagtaatacagcagccaacttcttcgccaaattaaagttttacaagatttaacctgtcatcaagacctgggattttggtgatcttggacatgatacctggatgtgcagcagccatctggtaattatgaggtgacaagtcaatagactgagatggtggagcagcaaagatagaaaagaaggacagaataacgggctcccagattcacaagccccaccaagaggatcaccccaggaacgcttggaggctgaggagttcactgaggctactgcatcttgagactcaggatgaagacccagcttggggctgtcaaaggttttttgcatgtctgacacccatgactccacctggaccttatggctccacccagaagcaattcagcccaacaggaggacagcttcaacccattacgatttcatctctgccccaaccactcagcagcaagcacctgttacctgtccacccccaccccttcccccaaactgcctttgaaaaatccctaacctatgagctttgaataagatgagtacgaacttcatcgcccatgtggcgtggccggcctcgtgtctattaaattctttttctactaca

SEQ ID NO: 456307 - DNA, 1717 bp, Homo sapiens
acgtaatatactccagtttgcaaatgaaggaatcttcctgcggaacgtatgtgaagcgcatattggtgctctgggcttttgcataatttcaaatgtcctttttttttttaaacttaaggctaatgtttagaagcttttgctaatgagaggaccatttgctaaatcggtataagtgctacacatttgggtatctccatcccaacatacctcttattgccattccccaaagcagacaccttctcctccctccctcaaggacctctgagcttgcactccaattcctctcccacactcacctttctcctttctgttcctcttgggatccaggtttatttgaggagataggaaaagctcctgatccagcaggttttattcttaaatttgtaacaaagtaaatcacagaacctccacccagcatccaggcctctggttctctccctccttcccaggtataggccggctttcagaaaccctgcaccacatagaccctgggcctgaattgctgtgagtaataatgactctgctggtaatttgtgtccttctgcttggaactgtttcctttttagtttggtcaccctcccagagctggtttcaatgggggcatacccattatgggatgcagggcatcctgcatcctgaggaattttttttcctccaaaaatgaaaccttgaaatgaggacattgtcctgtccacggactgcacaacaacactgagcctcaaggactcatactggcatttttcttcttttgcagagtgtgggcaccctggcttcaagctcacgagaaaccagaaggaagtcactgtgcatagccatcccctaagaagagggcattcctgctcttccttctccatggctagaggatctacatgaactatttagattttttctacctgggagatttaactcctctctcctatttatttatttatatatcagcatggacttgcaggccaacagagattttgagaaacacattgaaggatctgttaacacttgatatacccaataaaagcagtggttgtgccagtgctgatctgtcttgatgtgaatgtgaacaatgggaacctgagctgagcagttaatgctagggtgacagaaactggacctctcccaagacatgtgacagagtaatacagcagccaacttcttcgccaaattaaagttttacaagatttaacctgtcatcaagacctgggattttggtgatcttggacatgatacctggatgtgcagcagccatctggtaattatgaggtgacaagtcaatagactgagatggtggagcagcaaagatagaaaagaaggacagaataacgggctcccagattcacaagccccaccaagaggatcaccccaggaacgcttggaggctgaggagttcactgaggctactgcatcttgagactcaggatgaagacccagcttggggctgtcaaaggttttttgcatgtctgacacccatgactccacctggaccttatggctccacccagaagcaattcagcccaacaggaggacagcttcaacccattacgatttcatctctgccccaaccactcagcagcaagcacctgttacctgtccacccccaccccttcccccaaactgcctttgaaaaatccctaacctatgagctttgaataagatgagtacgaacttcatcgcccatgtggcgtggccggcctcgtgtctattaaattctttttctactaca

SEQ ID NO: 456308 - DNA, 2017 bp, Homo sapiens
cgccagccccgcgctcctccgggcagagcgcgtgtggcggccgagcacatgggcccgcgggccgggcgggctcggggcggccgggacgaggaggggcgacgacgagctgcgagcaaagatgtgccccgggacccccggcaccttccagtggatttccttgcggaaaggatgttggcggtccctgtgacctgtggagacacggccagatctgccctccagcctgatcttttggccagaaggagattaaaaagatgcccctcaagatggctgtgcctgtcagctgcatggagcttcgttcaagtattttctgagcctgatggatttacagtgatcttcagtggtctggggaataacgctggtggaaccatgcactggaatgacacacgcccggcacatttcaggatactaaaagtggttttaagggaggctgtggctgaatgcctcatggattcttacagcttggatgtccatgggggacgaaggactgcagctggctgagagggttgagatctctgtttacttagatctctgccaacttcctttgggtctccctatggaatgtaagaccccgactcttcctggtgaagcatctgatgcacgttccatccggcgctcagctgggcttgagctgaccatactccctggagccttctcccgaggtgcgcgggtgaccttggcacatacagccatcatgatggtactttaagtggaggctgaatcatctcccctttgagctgcttggcacgtggctcccttggtgttccccttttactgccaggacactgagatttggagagaatcctgttacacctgggatttaggcactttcaatctgaaaaaatacatatcctttcagcactctggacggacttgagaactgtccttacgtgacctaaagctggagtattttgagattggagaattaaggctacagagaaacaaggagacgggagagccttgaaatggaccttcaagattacaatgtgtagctgacattgtcagttaagttgggcagatctgacttcgctgattaagtgaatgtatgagccgatcctccccagaagctgggatcagcttccccatctgatgagccagtcttggtgctctgtgttcacctggttcatctgaggagctgcatctaccctgcccatgccatagatcctgccctgtttgcttctcctgttgctgctagtggacatgagaaggacagaataacgggctcccagattcacaagccccaccaagaggatcaccccaggaacgcttggaggctgaggagttcactgaggctactgcatcttgagactcaggatgaagacccagcttggggctgtcaaaggttttttgcatgtctgacacccatgactccacctggaccttatggctccacccagaagcaattcagcccaacaggaggacagcttcaacccattacgatttcatctctgccccaaccactcagcagcaagcacctgttacctgtccacccccaccccttcccccaaactgcctttgaaaaatccctaacctatgagctttgaataagatgagtacgaacttcatcgcccatgtggcgtggccggcctcgtgtctattaaattctttttctactacagaacaagaaaaaacaactggcctccactggtctaaaagatggagatctccgaccccttcgctttagtgcggcacacacagtgaccctgcgtcactgctgaaatagccctcacacccctgcatcgcccagacgcaccatccccacataggaccatctcacccgatccgcttaattatccgtcgccccctattacccgttctcgtccattctatccaccgaccacccccacccagacgccacactagcccccacgcgtcacggacgcggctagccctccaccaccccccactcacaccatagacaccagcccccctgagactactacgccacaacacgaggacaccctccctccgatacctccctttcagttcgcctacgtctctactccacgcccactatgct

SEQ ID NO: 456309 - DNA, 1819 bp, Homo sapiens
cgccagccccgcgctcctccgggcagagcgcgtgtggcggccgagcacatgggcccgcgggccgggcgggctcggggcggccgggacgaggaggggcgacgacgagctgcgagcaaagatgtgccccgggacccccggcaccttccagtggatttccttgcggaaaggatgttggcggtccctgtgacctgtggagacacggccagatctgccctccagcctgatcttttggccagaaggagattaaaaagatgcccctcaagatggctgtgcctgtcagctgcatggagcttcgttcaagtattttctgagcctgatggatttacagtgatcttcagtggtctggggaataacgctggtggaaccatgcactggaatgacacacgcccggcacatttcaggatactaaaagtggttttaagggaggctgtggctgaatgcctcatggattcttacagcttggatgtccatgggggacgaaggactgcagctggctgagagggttgagatctctgtttacttagatctctgccaacttcctttgggtctccctatggaatgtaagaccccgactcttcctggtgaagcatctgatgcacgttccatccggcgctcagctgggcttgagctgaccatactccctggagccttctcccgaggtgcgcgggtgaccttggcacatacagccatcatgatggtactttaagtggaggctgaatcatctcccctttgagctgcttggcacgtggctcccttggtgttccccttttactgccaggacactgagatttggagagaatcctgttacacctgggatttaggcactttcaatctgaaaaaatacatatcctttcagcactctggacggacttgagaactgtccttacgtgacctaaagctggagtattttgagattggagaattaaggctacagagaaacaaggagacgggagagccttgaaatggaccttcaagattacaatgtgtagctgacattgtcagttaagttgggcagatctgacttcgctgattaagtgaatgtatgagccgatcctccccagaagctgggatcagcttccccatctgatgagccagtcttggtgctctgtgttcacctggttcatctgaggagctgcatctaccctgcccatgccatagatcctgccctgtttgcttctcctgttgctgctagtggacatgagaaggacagaataacgggctcccagattcacaagccccaccaagaggatcaccccaggaacgcttggaggctgaggagttcactgaggctactgcatcttgagactcaggatgaagacccagcttggggctgtcaaagaggcctgaagaggcagaacaccccagaggagcctggggccaccacccagcatcactgtgggaaaacggcagcaggaaatgtcctctcgcctgcgtgctccacctcggtccacgccttccctccttctggaagccttgcctgaccactggcctgccccttctatgggaatcactactgaccttgcagcttattatagacttatatgttttttgcatgtctgacacccatgactccacctggaccttatggctccacccagaagcaattcagcccaacaggaggacagcttcaacccattacgatttcatctctgccccaaccactcagcagcaagcacctgttacctgtccacccccaccccttcccccaaactgcctttgaaaaatccctaacctatgagctttgaataagatgagtacgaacttcatcgcccatgtggcgtggccggcctcgtgtctattaaattctttttctactaca

SEQ ID NO: 456310 - DNA, 1826 bp, Homo sapiens
cgccagccccgcgctcctccgggcagagcgcgtgtggcggccgagcacatgggcccgcgggccgggcgggctcggggcggccgggacgaggaggggcgacgacgagctgcgagcaaagatgtgccccgggacccccggcaccttccagtggatttccttgcggaaaggatgttggcggtccctgtgacctgtggagacacggccagatctgccctccagcctgatcttttggccagaaggagattaaaaagatgcccctcaagatggctgtgcctgtcagctgcatggagcttcgttcaagtattttctgagcctgatggatttacagtgatcttcagtggtctggggaataacgctggtggaaccatgcactggaatgacacacgcccggcacatttcaggatactaaaagtggttttaagggaggctgtggctgaatgcctcatggattcttacagcttggatgtccatgggggacgaaggactgcagctggctgagagggttgagatctctgtttacttagatctctgccaacttcctttgggtctccctatggaatgtaagaccccgactcttcctggtgaagcatctgatgcacgttccatccggcgctcagctgggcttgagctgaccatactccctggagccttctcccgaggtgcgcgggtgaccttggcacatacagccatcatgatggtactttaagtggaggctgaatcatctcccctttgagctgcttggcacgtggctcccttggtgttccccttttactgccaggacactgagatttggagagaatcctgttacacctgggatttaggcactttcaatctgaaaaaatacatatcctttcagcactctggacggacttgagaactgtccttacgtgacctaaagctggagtattttgagattggagaattaaggctacagagaaacaaggagacgggagagccttgaaatggaccttcaagattacaatgtgtagctgacattgtcagttaagttgggcagatctgacttcgctgattaagtgaatgtatgagccgatcctccccagaagctgggatcagcttccccatctgatgagccagtcttggtgctctgtgttcacctggttcatctgaggagctgcatctaccctgcccatgccatagatcctgccctgtttgcttctcctgttgctgctagtggacatgagaaggacagaataacgggctcccagattcacaagccccaccaagaggatcaccccaggaacgcttggaggctgaggagttcactgaggctactgcatcttgagactcaggatgaagacccagcttggggctgtcaaagaggcctgaagaggcagaacaccccagaggagcctggggccaccacccagcatcactgtgggaaaacggcagcaggaaatgtcctctcgcctgcgtgctccacctcggtccacgccttccctccttctggaagccttgcctgaccactggcctgccccttctatgggaatcactactgaccttgcagcttattatagacttatatgtatgcagaaatataattttaattacttttatattgctccgagagtgataccaaatcatgatagaaaatttaaataaacaaaatagccaaattaataccagtaatcaccccagtcaaatatacccagctcacatttcgatgtaaaatcttccagtacagtttctatgtacatatatatatttttaggaaggagattatattttacatgctgttttctagaacgttcttttaaaactgtatcataaacatcttgccctataattcaatagtcttctacaacaaa

SEQ ID NO: 456311 - DNA, 1278 bp, Homo sapiens
tcccttcttttttctttctttttttgacggagtcctgctctttgcccaggctggagtgcagtggtgcaatctcggcttgctgcaacctccatctcccaggcaggttcaagtaattctcctgcctaagcctcccgagtagctgggactacaggcacctaccaccacacctttttttttttttagtagagacaggatttcactgtgttagacaatcctgcctccctccctccctccctttcttccttccttccttctttccttccttccttctttccctccttccttcctctcttctcctctcctctcttaccctcccctccccttctgtctcctctgctcccctgccctcccttctcctccttctccttctcctttttcttcttctctttgttgtccaggctggagtacagtggaaggatcatggcccactgtagcctagacatcccaggctgaaatgatcctctctcctcagcctcccaagtacctgggactacaggccaacagagattttgagaaacacattgaaggatctgttaacacttgatatacccaataaaagcagtggttgtgccagtgctgatctgtcttgatgtgaatgtgaacaatgggaacctgagctgagcagttaatgctagggtgacagaaactggacctctcccaagacatgtgacagagtaatacagcagccaacttcttcgccaaattaaagttttacaagatttaacctgtcatcaagacctgggattttggtgagccagtcttggtgctctgtgttcacctggttcatctgaggagctgcatctaccctgcccatgccatagatcctgccctgtttgcttctcctgttgctgctagtggacatgagaaggacagaataacgggctcccagattcacaagccccaccaagaggatcaccccaggaacgcttggaggctgaggagttcactgaggctactgcatcttgagactcaggatgaagacccagcttggggctgtcaaaggttttttgcatgtctgacacccatgactccacctggaccttatggctccacccagaagcaattcagcccaacaggaggacagcttcaacccattacgatttcatctctgccccaaccactcagcagcaagcacctgttacctgtccacccccaccccttcccccaaactgcctttgaaaaatccctaacctatgagctttgaataagatgagtacgaacttcatcgcccatgtggcgtggccggcctcgtgtctattaaattctttttctactaca

SEQ ID NO: 456312 - DNA, 692 bp, Homo sapiens
gaagggcactggagacctaccaggggctgggccattggagtggtgggtgctggggagcttccgtgggcccctccaggtccactccttgctcttctctgccttgttttgtgcccagaaggctgacctgtgtggatgcattatcagggtggatgcaacacagggctgccatgctctctggtatcagtttggaaggcactggcaggatgggaaggcaggcggggagtgaggtcagggggcctatccttccactgcctccctgctgctccctgactgattcagaaggacagaataacgggctcccagattcacaagccccaccaagaggatcaccccaggaacgcttggaggctgaggagttcactgaggctactgcatcttgagactcaggatgaagacccagcttggggctgtcaaaggttttttgcatgtctgacacccatgactccacctggaccttatggctccacccagaagcaattcagcccaacaggaggacagcttcaacccattacgatttcatctctgccccaaccactcagcagcaagcacctgttacctgtccacccccaccccttcccccaaactgcctttgaaaaatccctaacctatgagctttgaataagatgagtacgaacttcatcgcccatgtggcgtggccggcctcgtgtctattaaattctttttctactaca

SEQ ID NO: 456313 - DNA, 619 bp, Homo sapiens
gctctgaagggagctttcatgtggccgaccaactctactccttgactcctcccttctctcattgaaaaaaaatgtttaaggggacatttctctctcctaaactttttatgttccattgaagacctggaaaacatgttaaataaaaatgctttgccacagctgacctatgtcttctggcttgtaccccacaacatcttatctaatggaaggacagaataacgggctcccagattcacaagccccaccaagaggatcaccccaggaacgcttggaggctgaggagttcactgaggctactgcatcttgagactcaggatgaagacccagcttggggctgtcaaaggttttttgcatgtctgacacccatgactccacctggaccttatggctccacccagaagcaattcagcccaacaggaggacagcttcaacccattacgatttcatctctgccccaaccactcagcagcaagcacctgttacctgtccacccccaccccttcccccaaactgcctttgaaaaatccctaacctatgagctttgaataagatgagtacgaacttcatcgcccatgtggcgtggccggcctcgtgtctattaaattctttttctactaca

SEQ ID NO: 456314 - DNA, 472 bp, Homo sapiens
ccgccactccaccttacgcacctccgttcctcttcaccgcgtatctgccccgcttgattaaggacagaataacgggctcccagattcacaagccccaccaagaggatcaccccaggaacgcttggaggctgaggagttcactgaggctactgcatcttgagactcaggatgaagacccagcttggggctgtcaaaggttttttgcatgtctgacacccatgactccacctggaccttatggctccacccagaagcaattcagcccaacaggaggacagcttcaacccattacgatttcatctctgccccaaccactcagcagcaagcacctgttacctgtccacccccaccccttcccccaaactgcctttgaaaaatccctaacctatgagctttgaataagatgagtacgaacttcatcgcccatgtggcgtggccggcctcgtgtctattaaattctttttctactaca

SEQ ID NO: 456315 - DNA, 471 bp, Homo sapiens
gagtcgcgatggtatgcagtgaagaaggcgcacgggcaaagggtgttggcgaggtacaaaggacagaataacgggctcccagattcacaagccccaccaagaggatcaccccaggaacgcttggaggctgaggagttcactgaggctactgcatcttgagactcaggatgaagacccagcttggggctgtcaaaggttttttgcatgtctgacacccatgactccacctggaccttatggctccacccagaagcaattcagcccaacaggaggacagcttcaacccattacgatttcatctctgccccaaccactcagcagcaagcacctgttacctgtccacccccaccccttcccccaaactgcctttgaaaaatccctaacctatgagctttgaataagatgagtacgaacttcatcgcccatgtggcgtggccggcctcgtgtctattaaattctttttctactaca

SEQ ID NO: 456316 - DNA, 1628 bp, Homo sapiens
cgccagccccgcgctcctccgggcagagcgcgtgtggcggccgagcacatgggcccgcgggccgggcgggctcggggcggccgggacgaggaggggcgacgacgagctgcgagcaaagatgtgccccgggacccccggcaccttccagtggatttccttgcggaaaggatgttggcggtccctgtgacctgtggagacacggccagatctgccctccagcctgatcttttggccagaaggagattaaaaagatgcccctcaagatggctgtgcctgtcagctgcatggagcttcgttcaagtattttctgagcctgatggatttacagtgatcttcagtggtctggggaataacgctggtggaaccatgcactggaatgacacacgcccggcacatttcaggatactaaaagtggttttaagggaggctgtggctgaatgcctcatggattcttacagcttggatgtccatgggggacgaaggactgcagctggctgagagggttgagatctctgtttacttagatctctgccaacttcctttgggtctccctatggaatgtaagaccccgactcttcctggtgaagcatctgatgcacgttccatccggcgctcagctgggcttgagctgaccatactccctggagccttctcccgaggtgcgcgggtgaccttggcacatacagccatcatgatggtactttaagtggaggctgaatcatctcccctttgagctgcttggcacgtggctcccttggtgttccccttttactgccaggacactgagatttggagagaatcctgttacacctgggatttaggcactttcaatctgaaaaaatacatatcctttcagcactctggacggacttgagaactgtccttacgtgacctaaagctggagtattttgagattggagaattaagtagtgtgggcacccgtggcttcaagctcacgagaaaccaggccaacagagattttgagaaacacattgaaggatctgttaacacttgatatacccaataaaagcagtggttgtgccagtgctgatctgtcttgatgtgaatgtgaacaatgggaacctgagctgagcagttaatgctagggtgacagaaactggacctctcccaagacatgtgacagagtaatacagcagccaacttcttcgccaaattaaagttttacaagatttaacctgtcatcaagacctgggattttggtgagccagtcttggtgctctgtgttcacctggttcatctgaggagctgcatctaccctgcccatgccatagatcctgccctgtttgcttctcctgttgctgctagtggacatgaggtaaccacagcctagttctgtgataagctcttcacacctgtacccatatggactgtgggagagtttctctgatatggactgtgatgcggaagacagtgatgcactgtattcaagtgatagccccagcagtaacattgatgcagagaaaatggaatactttttacaagagaccagaagacacatgaagctagaaaaaggagcccagaaaactgccacattttgcccatatagaaaagcatatcccgaccgggcacagtggctcacgcctgtaatcccaggactttggaagccc

SEQ ID NO: 456317 - DNA, 1643 bp, Homo sapiens
cgccagccccgcgctcctccgggcagagcgcgtgtggcggccgagcacatgggcccgcgggccgggcgggctcggggcggccgggacgaggaggggcgacgacgagctgcgagcaaagatgtgccccgggacccccggcaccttccagtggatttccttgcggaaaggatgttggcggtccctgtgacctgtggagacacggccagatctgccctccagcctgatcttttggccagaaggagattaaaaagatgcccctcaagatggctgtgcctgtcagctgcatggagcttcgttcaagtattttctgagcctgatggatttacagtgatcttcagtggtctggggaataacgctggtggaaccatgcactggaatgacacacgcccggcacatttcaggatactaaaagtggttttaagggaggctgtggctgaatgcctcatggattcttacagcttggatgtccatgggggacgaaggactgcagctggctgagagggttgagatctctgtttacttagatctctgccaacttcctttgggtctccctatggaatgtaagaccccgactcttcctggtgaagcatctgatgcacgttccatccggcgctcagctgggcttgagctgaccatactccctggagccttctcccgaggtgcgcgggtgaccttggcacatacagccatcatgatggtactttaagtggaggctgaatcatctcccctttgagctgcttggcacgtggctcccttggtgttccccttttactgccaggacactgagatttggagagaatcctgttacacctgggatttaggcactttcaatctgaaaaaatacatatcctttcagcactctggacggacttgagaactgtccttacgtgacctaaagctggagtattttgagattggagaattaagagtgtgggcaccctggcttcaagctcacgagaaaccagaaggaagtcactgtgcatagccatcccctaagaagagggcattcctgctcttccttctccatggctagaggatctacatgaactatttagattttttctacctgggagatttaactcctctctcctatttatttatttatatatcagcatggacttgcaggccaacagagattttgagaaacacattgaaggatctgttaacacttgatatacccaataaaagcagtggttgtgccagtgctgatctgtcttgatgtgaatgtgaacaatgggaacctgagctgagcagttaatgctagggtgacagaaactggacctctcccaagacatgtgacagagtaatacagcagccaacttcttcgccaaattaaagttttacaagatttaacctgtcatcaagacctgggattttggtggtgagtcatcttcaaaagccaagttcggtccctggtttgccttcttttccgcacaagaacaagggttttgatggctctggtctccaggaccatctgtggctttctattagcaataatcgcacctcggtgaaacctcattggctacgatactgccactgcgcaaagctcatggctttctttaatagcaaatggcctctgacttttaagaagccatgtggctacccctcaccaaagcccataaaaataaaaaattaaaaaaaaa

SEQ ID NO: 456318 - DNA, 863 bp, Homo sapiens
cgccagccccgcgctcctccgggcagagcgcgtgtggcggccgagcacatgggcccgcgggccgggcgggctcggggcggccgggacgaggaggggcgacgacgagctgcgagcaaagatgtgccccgggacccccggcaccttccagtggatttccttgcggaaaggatgttggcggtccctgtgacctgtggagacacggccagatctgccctccagcctgatcttttggccagaaggagattaaaaagatgcccctcaagatggctgtgcctgtcagctgcatggagcttcgttcaagtattttctgagcctgatggatttacagtgatcttcagtggtctggggaataacgctggtggaaccatgcactggaatgacacacgcccggcacatttcaggatactaaaagtggttttaagggaggctgtggctgaatgcctcatggattcttacagcttggatgtccatgggggacgaaggactgcagctggctgagagggttgagatctctgtttacttagatctctgccaacttcctttgggtctccctatggaatgtaagaccccgactcttcctggtgaagcatctgatgcacgttccatccggcgctcagctgggcttgagacttcgcaggtgagcagtaacggaaatcagccccgtttattcctcccagcacctgccttatccaactccccacgctgtggctgagtcccagcctgctatggaagcatcactggactcccattgaactctgtgcagattcgctgttcgtagacatggtacctgatggacaccaagctacgtacagcttcaaggccccttctttctttgctaataaaaaataaaaattaaaaactta

SEQ ID NO: 456319 - DNA, 2544 bp, Homo sapiens
cgccagccccgcgctcctccgggcagagcgcgtgtggcggccgagcacatgggcccgcgggccgggcgggctcggggcggccgggacgaggaggggcgacgacgagctgcgagcaaagatgtgccccgggacccccggcaccttccagtggatttccttgcggaaaggatgttggcggtccctgtgacctgtggagacacggccagatctgccctccaatggcatcaccagaaaccaagaagatggtaaggcctggaggtggcagagctgaagaggttgaactggtttgttgaactttatggatggagccagccaacaggatgacattgtggcagagaaagaagcttgcagcttcttgcatcagaaaatcagatagagcctctctggcaagaagctgcagacacaaaagaagcttgcattgaaggtgactcagctctggcttttcagcaatgccctaacattggctatttaaaaagaggcaaagtagcttcagtgagacctcaaaccaattgcacagctagccactgcccataaagaagctactggtcagaaatgctggctccttcatagacaaaacggcaaagtacattgataggggctgctggtccaggaggatctttatatcctggccaagtatggcatttgtctctgtcacctggaaaatggccctggagcaggcatgtgactgactcgttctgcaaggcctccagacagctaaatgaagatggcttctagctaagaaacagaggggttcatacacatgcaaagataacttccccacttgtctctgatggaaactcaagggccatgtggaaatggcgtggattgggactcagctgatgaacttggaagcccagcccagccagtcagcagtttggtccagaacctgtctgcacctcagtgtctagtaaatggaggaagggagaaggagatgaaactaattgacattgggcctcttttatgaaccaggcactttgctattctcatccagtcttaccttgacggcaggaatgcaaaatggcaagaggctccatccttgaatcaccatttggagaagagttaactgacaaacaagatctgcactgaattatatgccacagggagccaggataggaggacaacatggtggatccagcatggaacttacaactgaggctagtttgatggacatggcaccaaatctcatgagagtgacaataagctagaacagaagttttggaaagccaaagaaaagactgtaactgcacacaataagcagaaaacatttgtgctttctgtctccatctatcacccaaacagtcaaacctggagaaaactacttttcctctctacaccaacatgcatgctatttgcataacacataacacaaggaagtgaagcaatttgctcaagataatgtgtctagtcatcaaaaggactggtcagtgcctcgatcttgatgatgatggatactgcttattggatactctcacatctcaacaatccaaacaccttccacaatgacctgcttaatctgacccctggcacatctcaaatcacagtctctgtctgtagtagataaaaaaaaatggacacacactttgcaataccacccatcaagagattaagtaactttcttcatcccttgaatctagtgggctcttgtgactaccaatagaatttggtggaagtgacactctgccttctgcaacaaggcacctgtgctgaaggagacttttagcctctgcccttgcctccctgaatagtgcctccatgtgaagaagaccaagctaacctactagagacatggctccaccaagaaccagtagcagctgcctggacaaggccatcttagaccacccaaccctagtcaagacagcagaatgactgcagctcggtgaattgtgttttaagctgctaagttttcagtggtttattaggcagcaatacataactgaaataccctttcaccctcccgactttaggctccagcctttctgatcttctcttaagccttggaacatgccattgacttttccaccctgagactttgcatgttattccttatgcataaaatacattcctctttccacctgtcaaatggtttaactcccttttatcatttaggccactagcttaaaattcacatgcagagagaattctttactgagcaaccatataccccagatttcttattcttcatatcaggcttttcttattttttcattgcgcatatcacaaagggcaattaattaattaattgtttgtttgtttgttattgcctattttccccctatccagatgtaagctccatgagagtggttggaggcaatgtttattctgttttccacttcaccttaagagagtgcgggaagagggtctcatccatatttctttggatccttttatcattttcctgcatactttcactgagagtgctctcatgtccatcagccagcacttgcttctcttttctgagggctgccccaggctcctgaagtccagcttggattgcctgcatgaaaacatagagagctaaaggctgggaacttgcatagccttagc

SEQ ID NO: 456320 - DNA, 2487 bp, Homo sapiens
cgccagccccgcgctcctccgggcagagcgcgtgtggcggccgagcacatgggcccgcgggccgggcgggctcggggcggccgggacgaggaggggcgacgacgagctgcgagcaaagatgtgccccgggacccccggcaccttccagtggatttccttgcggaaaggatgttggcggtccctgtgacctgtggagacacggccagatctgccctccagttgaactggtttgttgaactttatggatggagccagccaacaggatgacattgtggcagagaaagaagcttgcagcttcttgcatcagaaaatcagatagagcctctctggcaagaagctgcagacacaaaagaagcttgcattgaaggtgactcagctctggcttttcagcaatgccctaacattggctatttaaaaagaggcaaagtagcttcagtgagacctcaaaccaattgcacagctagccactgcccataaagaagctactggtcagaaatgctggctccttcatagacaaaacggcaaagtacattgataggggctgctggtccaggaggatctttatatcctggccaagtatggcatttgtctctgtcacctggaaaatggccctggagcaggcatgtgactgactcgttctgcaaggcctccagacagctaaatgaagatggcttctagctaagaaacagaggggttcatacacatgcaaagataacttccccacttgtctctgatggaaactcaagggccatgtggaaatggcgtggattgggactcagctgatgaacttggaagcccagcccagccagtcagcagtttggtccagaacctgtctgcacctcagtgtctagtaaatggaggaagggagaaggagatgaaactaattgacattgggcctcttttatgaaccaggcactttgctattctcatccagtcttaccttgacggcaggaatgcaaaatggcaagaggctccatccttgaatcaccatttggagaagagttaactgacaaacaagatctgcactgaattatatgccacagggagccaggataggaggacaacatggtggatccagcatggaacttacaactgaggctagtttgatggacatggcaccaaatctcatgagagtgacaataagctagaacagaagttttggaaagccaaagaaaagactgtaactgcacacaataagcagaaaacatttgtgctttctgtctccatctatcacccaaacagtcaaacctggagaaaactacttttcctctctacaccaacatgcatgctatttgcataacacataacacaaggaagtgaagcaatttgctcaagataatgtgtctagtcatcaaaaggactggtcagtgcctcgatcttgatgatgatggatactgcttattggatactctcacatctcaacaatccaaacaccttccacaatgacctgcttaatctgacccctggcacatctcaaatcacagtctctgtctgtagtagataaaaaaaaatggacacacactttgcaataccacccatcaagagattaagtaactttcttcatcccttgaatctagtgggctcttgtgactaccaatagaatttggtggaagtgacactctgccttctgcaacaaggcacctgtgctgaaggagacttttagcctctgcccttgcctccctgaatagtgcctccatgtgaagaagaccaagctaacctactagagacatggctccaccaagaaccagtagcagctgcctggacaaggccatcttagaccacccaaccctagtcaagacagcagaatgactgcagctcggtgaattgtgttttaagctgctaagttttcagtggtttattaggcagcaatacataactgaaataccctttcaccctcccgactttaggctccagcctttctgatcttctcttaagccttggaacatgccattgacttttccaccctgagactttgcatgttattccttatgcataaaatacattcctctttccacctgtcaaatggtttaactcccttttatcatttaggccactagcttaaaattcacatgcagagagaattctttactgagcaaccatataccccagatttcttattcttcatatcaggcttttcttattttttcattgcgcatatcacaaagggcaattaattaattaattgtttgtttgtttgttattgcctattttccccctatccagatgtaagctccatgagagtggttggaggcaatgtttattctgttttccacttcaccttaagagagtgcgggaagagggtctcatccatatttctttggatccttttatcattttcctgcatactttcactgagagtgctctcatgtccatcagccagcacttgcttctcttttctgagggctgccccaggctcctgaagtccagcttggattgcctgcatgaaaacatagagagctaaaggctgggaacttgcatagccttagc

SEQ ID NO: 456321 - DNA, 580 bp, Homo sapiens
ctttggaatgaaggcagtggaggccaagagacctctaggtcaaagccaggcgggagggtcctctcaggggcccagccgacaagttgcatttctccctcagaggcctgaagaggcagaacaccccagaggagcctggggccaccacccagcatcactgtgggaaaacggcagcaggaaatgtcctctcgcctgcgtgctccacctcggtccacgccttccctccttctggaagccttgcctgaccactggcctgccccttctatgggaatcactactgaccttgcagcttattatagacttatatgttttttgcatgtctgacacccatgactccacctggaccttatggctccacccagaagcaattcagcccaacaggaggacagcttcaacccattacgatttcatctctgccccaaccactcagcagcaagcacctgttacctgtccacccccaccccttcccccaaactgcctttgaaaaatccctaacctatgagctttgaataagatgagtacgaacttcatcgcccatgtggcgtggccggcctcgtgtctattaaattctttttctactaca

SEQ ID NO: 456322 - DNA, 437 bp, Homo sapiens
cgaggcctctcgctcagcgaacagcagcagcgtctattttacaccaacccccctactaagctgcagacattattccgaaggttataagatatgcaactttcccaattgctcctgtgaataacactactattacagattggccttttgaaatatctttccaggttttttgcatgtctgacacccatgactccacctggaccttatggctccacccagaagcaattcagcccaacaggaggacagcttcaacccattacgatttcatctctgccccaaccactcagcagcaagcacctgttacctgtccacccccaccccttcccccaaactgcctttgaaaaatccctaacctatgagctttgaataagatgagtacgaacttcatcgcccatgtggcgtggccggcctcgtgtctattaaattctttttctactaca

SEQ ID NO: 456323 - DNA, 481 bp, Homo sapiens
cctgcccatttgcattggtatctccaaggccaagctagagaaggcacacaataggctttccactaatatttgtgaatgaatgaatgaacagagagaggagttttctttccacagtttccttctacctgctactccttgagcatatgaggctggaatctaagccctgaggtcactcactgctctcctgggtactatccctggcctcccgtccttttccttgagcttctgtgctctgcaaggctttctcattatcctttaggctacagagaaacaaggagacgggagagccttgaaatggaccttcaagattacaatgtgtagctgacattgtcagttaagttgggcagatctgacttcgctgattaagtggatgtatgagccgatcctccccagaagctgggatcagcttccccatctgatggtgagtcagacctgctggggtttgggtcctcgctccagcatggctgcctgtgtgaccttg

SEQ ID NO: 456324 - DNA, 559 bp, Homo sapiens
tcgttagggagttacactctgttaggtccaaacacaaggaggaaagagtgactgaatactgctctgagtcagtgactgtgacaagactgtttttttcttcttccctgttgcaggcctgatcttttggccagaaggagattaaaaagatgcccctcaagatggctgtgcctgtcagctgcatggagcttcgttcaagtattttctgagcctgatggatttacagtgatcttcagtggtctggggaataacgctggtggaaccatgcactggaatgacacacgcccggcacatttcaggatactaaaagtggttttaagggaggctgtggctgaatgcctcatggattcttacagcttggatgtccatgggggacgaaggactgcagctggctgagagggttgagatctctgtttacttagatctctgccaacttcctttgggtctccctatggaatgtaagaccccgactcttcctggtgaagcatctgatgcacgttccatccggcgctcagctgggcttgaggtgaggctgtcctggctggtcacggagggttcactg

SEQ ID NO: 456325 - DNA, 600 bp, Homo sapiens
ttttaatttagacaaatgggattctgctatagatctcaatttggttcttttgcttactcaacactctttttcagagccagtcttggtgctctgtgttcacctggttcatctgaggagctgcatctaccctgcccatgccatagatcctgccctgtttgcttctcctgttgctgctagtggacatgagaaggacagaataacgggctcccagattcacaagccccaccaagaggatcaccccaggaacgcttggaggctgaggagttcactgaggctactgcatcttgagactcaggatgaagacccagcttggggctgtcaaaggttttttgcatgtctgacacccatgactccacctggaccttatggctccacccagaagcaattcagcccaacaggaggacagcttcaacccattacgatttcatctctgccccaaccactcagcagcaagcacctgttacctgtccacccccaccccttcccccaaactgcctttgaaaaatccctaacctatgagctttgaataagatgagtacgaacttcatcgcccatgtggcgtggccggcctcgtgtctattaaattctttttctactaca

SEQ ID NO: 456326 - DNA, 1579 bp, Homo sapiens
cgccagccccgcgctcctccgggcagagcgcgtgtggcggccgagcacatgggcccgcgggccgggcgggctcggggcggccgggacgaggaggggcgacgacgagctgcgagcaaagatgtgccccgggacccccggcaccttccagtggatttccttgcggaaaggatgttggcggtccctgtgacctgtggagacacggccagatctgccctccagcctgatcttttggccagaaggagattaaaaagatgcccctcaagatggctgtgcctgtcagctgcatggagcttcgttcaagtattttctgagcctgatggatttacagtgatcttcagtggtctggggaataacgctggtggaaccatgcactggaatgacacacgcccggcacatttcaggatactaaaagtggttttaagggaggctgtggctgaatgcctcatggattcttacagcttggatgtccatgggggacgaaggactgcagctggctgagagggttgagatctctgtttacttagatctctgccaacttcctttgggtctccctatggaatgtaagaccccgactcttcctggtgaagcatctgatgcacgttccatccggcgctcagctgggcttgagctgaccatactccctggagccttctcccgaggtgcgcgggtgaccttggcacatacagccatcatgatggtactttaagtggaggctgaatcatctcccctttgagctgcttggcacgtggctcccttggtgttccccttttactgccaggacactgagatttggagaggtaagtggcttacctgaggccatgtgctaacagagaagatgaagagatgattgaaacaggcctaagaccagacctaagggtctgtacattttccacatactttccatatctttagaggcctgaccaaagcagatcttttcctttcttctaggtaagtccaaaggcacctgcctgctgggcccactgttttctaactttcctaactttctgatcccttggaggtgataatcaaatattctagtctgaggcattgggatacatggtgctaggttctgagactctgcgtcaggcctgaaccctgcattttgtggaggtgggtgggagaatgttcccctggggaacatgcctagacacgggggacaacagttgccctcatggggaggtacctgtttactcgctgttatgggaccgctttcacaaaaccactgcaggtgagtgagttcctgctgaatatcaggcctggtgtctctagactcattatttcccccacccaacccctatgttagttcatctcgagccacatttttattgccataatccaggcctggacaggccaagatcttttaacaattttaattactgaaaataataactgcatttttttttaaagcccaactttttggtagagtcagcccaaaatacagtctttgtgttgccatctgggaactggatttggaattgttcttccatgagactgcagagcagaacggcagggccagaggtcccacgagctggtcagacccggttctgctccttgctggctgagtgaccttgggcattgt

SEQ ID NO: 456327 - DNA, 694 bp, Homo sapiens
cgccagccccgcgctcctccgggcagagcgcgtgtggcggccgagcacatgggcccgcgggccgggcgggctcggggcggccgggacgaggaggggcgacgacgagctgcgagcaaagatgtgccccgggacccccggcaccttccagtggatttccttgcggaaaggatgttggcggtccctgtgacctgtggagacacggccagatctgccctccagcctgatcttttggccagaaggagattaaaaagatgcccctcaagatggctgtgcctgtcagctgcatggagcttcgttcaagtattttctgagcctgatggatttacagtgatcttcagtggtctggggaataacgctggtggaaccatgcactggaatgacacacgcccggcacatttcaggatactaaaagtggttttaagggaggctgtggctgaatgcctcatggattcttacagcttggatgtccatgggggacgaaggactgcagctggctgagagggttgagatctctgtttacttagatctctgccaacttcctttgggtctccctatggaatgtaagaccccgactcttcctggtgaagcatctgatgcacgttccatccggcgctcagctgggcttgagattcctgggaacaccaccatggagggcctggcctttggcggtggacagtctgtggctgggtgggac

SEQ ID NO: 456328 - DNA, 1543 bp, Homo sapiens
cccctctgctatcagaaaacaagaatggaagattgggaagagatggcatagtgtggatctgcctgaaaaacatgcacaagaccactttgcctccaaactcaatttcaaaatctatggaagctgaatcccaagaatgcctgcagactcaagggttatccatgggaggacatggcaccaaatctcatgagagtgacaataagctagaacagaagttttggaaagccaaagaaaagactgtaactgcacacaataagcagaaaacatttgtgctttctgtctccatctatcacccaaacagtcaaacctggagaaaactacttttcctctctacaccaacatgcatgctatttgcataacacataacacaaggaagtgaagcaatttgctcaagataatgtgtctagtcatcaaaaggactggtcagtgcctcgatcttgatgatgatggatactgcttattggatactctcacatctcaacaatccaaacaccttccacaatgacctgcttaatctgacccctggcacatctcaaatcacagtctctgtctgtagtagataaaaaaaaatggacacacactttgcaataccacccatcaagagattaagtaactttcttcatcccttgaatctagtgggctcttgtgactaccaatagaatttggtggaagtgacactctgccttctgcaacaaggcacctgtgctgaaggagacttttagcctctgcccttgcctccctgaatagtgcctccatgtgaagaagaccaagctaacctactagagacatggctccaccaagaaccagtagcagctgcctggacaaggccatcttagaccacccaaccctagtcaagacagcagaatgactgcagctcggtgaattgtgttttaagctgctaagttttcagtggtttattaggcagcaatacataactgaaataccctttcaccctcccgactttaggctccagcctttctgatcttctcttaagccttggaacatgccattgacttttccaccctgagactttgcatgttattccttatgcataaaatacattcctctttccacctgtcaaatggtttaactcccttttatcatttaggccactagcttaaaattcacatgcagagagaattctttactgagcaaccatataccccagatttcttattcttcatatcaggcttttcttattttttcattgcgcatatcacaaagggcaattaattaattaattgtttgtttgtttgttattgcctattttccccctatccagatgtaagctccatgagagtggttggaggcaatgtttattctgttttccacttcaccttaagagagtgcgggaagagggtctcatccatatttctttggatccttttatcattttcctgcatactttcactgagagtgctctcatgtccatcagccagcacttgcttctcttttctgagggctgccccaggctcctgaagtccagcttggattgcctgcatgaaaacatagagagctaaaggctgggaacttgcatagccttagc

SEQ ID NO: 456329 - DNA, 716 bp, Homo sapiens
cgccagccccgcgctcctccgggcagagcgcgtgtggcggccgagcacatgggcccgcgggccgggcgggctcggggcggccgggacgaggaggggcgacgacgagctgcgagcaaagatgtgccccgggacccccggcaccttccagtggatttccttgcggaaaggatgttggcggtccctgtgacctgtggagacacggccagatctgccctccaatggggaagggtggaagagaggaggagaaacatagggcaccagagtatttgaggacctacagaacagcaggagctcaagacggtctaccactggatacaaaaaaagagccaccaggctggctggatgcagaagagagagatacaagaccacatgatggaaggggccatcctcactgacttcaccacctggaaggaagctatggaggagaattgcccaaacaaatacaactgcatcaaattttgcctctgtaagaaatagatctttgttatgctacaataggtccctgagatttgggattttatttgttatagtagctagcattatttttacttaataaatggttcttaataaatggtttacttaataaatggttctcacggttctgtaaagctgcaacatgcttttaaaatgttcagacacaatgatcaaacaacaggaagccaataccgggactttataaactctacaaaacaccattcggataataacaaaacggg

SEQ ID NO: 456330 - DNA, 1542 bp, Homo sapiens
cgccagccccgcgctcctccgggcagagcgcgtgtggcggccgagcacatgggcccgcgggccgggcgggctcggggcggccgggacgaggaggggcgacgacgagctgcgagcaaagatgtgccccgggacccccggcaccttccagtggatttccttgcggaaaggatgttggcggtccctgtgacctgtggagacacggccagatctgccctccagcctgatcttttggccagaaggagattaaaaagatgcccctcaagatggctgtgcctgtcagctgcatggagcttcgttcaagtattttctgagcctgatggatttacagtgatcttcagtggtctggggaataacgctggtggaaccatgcactggaatgacacacgcccggcacatttcaggatactaaaagtggttttaagggaggctgtggctgaatgcctcatggattcttacagcttggatgtccatgggggacgaaggactgcagctggctgagagggttgagatctctgtttacttagatctctgccaacttcctttgggtctccctatggaatgtaagaccccgactcttcctggtgaagcatctgatgcacgttccatccggcgctcagctgggcttgagctgaccatactccctggagccttctcccgaggtgcgcgggtgaccttggcacatacagccatcatgatggtactttaagtggaggctgaatcatctcccctttgagctgcttggcacgtggctcccttggtgttccccttttactgccaggacactgagatttggagagaatcctgttacacctgggatttaggcactttcaatctgaaaaaatacatatcctttcagcactctggacggacttgagaactgtccttacgtgacctaaagctggagtattttgagattggagaattaagagccagtcttggtgctctgtgttcacctggttcatctgaggagctgcatctaccctgcccatgccatagatcctgccctgtttgcttctcctgttgctgctagtggacatgaggtaaccacagcctagttctgtgataagctcttcacacctgtacccatatggactgtgggagagtttctctgatatggactgtgatgcggaaggacagaataacgggctcccagattcacaagccccaccaagaggatcaccccaggaacgcttggaggctgaggagttcactgaggctactgcatcttgagactcaggatgaagacccagcttggggctgtcaaaggttttttgcatgtctgacacccatgactccacctggaccttatggctccacccagaagcaattcagcccaacaggaggacagcttcaacccattacgatttcatctctgccccaaccactcagcagcaagcacctgttacctgtccacccccaccccttcccccaaactgcctttgaaaaatccctaacctatgagctttgaataagatgagtacgaacttcatcgcccatgtggcgtggccggcctcgtgtctattaaattctttttctactaca

SEQ ID NO: 456331 - DNA, 1615 bp, Homo sapiens
cgccagccccgcgctcctccgggcagagcgcgtgtggcggccgagcacatgggcccgcgggccgggcgggctcggggcggccgggacgaggaggggcgacgacgagctgcgagcaaagatgtgccccgggacccccggcaccttccagtggatttccttgcggaaaggatgttggcggtccctgtgacctgtggagacacggccagatctgccctccagcctgatcttttggccagaaggagattaaaaagatgcccctcaagatggctgtgcctgtcagctgcatggagcttcgttcaagtattttctgagcctgatggatttacagtgatcttcagtggtctggggaataacgctggtggaaccatgcactggaatgacacacgcccggcacatttcaggatactaaaagtggttttaagggaggctgtggctgaatgcctcatggattcttacagcttggatgtccatgggggacgaaggactgcagctggctgagagggttgagatctctgtttacttagatctctgccaacttcctttgggtctccctatggaatgtaagaccccgactcttcctggtgaagcatctgatgcacgttccatccggcgctcagctgggcttgagctgaccatactccctggagccttctcccgaggtgcgcgggtgaccttggcacatacagccatcatgatggtactttaagtggaggctgaatcatctcccctttgagctgcttggcacgtggctcccttggtgttccccttttactgccaggacactgagatttggagagaatcctgttacacctgggatttaggcactttcaatctgaaaaaatacatatcctttcagcactctggacggacttgagaactgtccttacgtgacctaaagctggagtattttgagattggagaattaaggctacagagaaacaaggagacgggagagccttgaaatggaccttcaagattacaatgtgtagctgacattgtcagttaagttgggcagatctgacttcgctgattaagtgaatgtatgagccgatcctccccagaagctgggatcagcttccccatctgatgagccagtcttggtgctctgtgttcacctggttcatctgaggagctgcatctaccctgcccatgccatagatcctgccctgtttgcttctcctgttgctgctagtggacatgagaaggacagaataacgggctcccagattcacaagccccaccaagaggatcaccccaggaacgcttggaggctgaggagttcactgaggctactgcatcttgagactcaggatgaagacccagcttggggctgtcaaaggttttttgcatgtctgacacccatgactccacctggaccttatggctccacccagaagcaattcagcccaacaggaggacagcttcaacccattacgatttcatctctgccccaaccactcagcagcaagcacctgttacctgtccacccccaccccttcccccaaactgcctttgaaaaatccctaacctatgagctttgaataagatgagtacgaacttcatcgcccatgtggcgtggccggcctcgtgtctattaaattctttttctactaca

SEQ ID NO: 456332 - DNA, 1794 bp, Homo sapiens
cgccagccccgcgctcctccgggcagagcgcgtgtggcggccgagcacatgggcccgcgggccgggcgggctcggggcggccgggacgaggaggggcgacgacgagctgcgagcaaagatgtgccccgggacccccggcaccttccagtggatttccttgcggaaaggatgttggcggtccctgtgacctgtggagacacggccagatctgccctccagcctgatcttttggccagaaggagattaaaaagatgcccctcaagatggctgtgcctgtcagctgcatggagcttcgttcaagtattttctgagcctgatggatttacagtgatcttcagtggtctggggaataacgctggtggaaccatgcactggaatgacacacgcccggcacatttcaggatactaaaagtggttttaagggaggctgtggctgaatgcctcatggattcttacagcttggatgtccatgggggacgaaggactgcagctggctgagagggttgagatctctgtttacttagatctctgccaacttcctttgggtctccctatggaatgtaagaccccgactcttcctggtgaagcatctgatgcacgttccatccggcgctcagctgggcttgagctgaccatactccctggagccttctcccgaggtgcgcgggtgaccttggcacatacagccatcatgatggtactttaagtggaggctgaatcatctcccctttgagctgcttggcacgtggctcccttggtgttccccttttactgccaggacactgagatttggagagaatcctgttacacctgggatttaggcactttcaatctgaaaaaatacatatcctttcagcactctggacggacttgagaactgtccttacgtgacctaaagctggagtattttgagattggagaattaagagtgtgggcaccctggcttcaagctcacgagaaaccagaaggaagtcactgtgcatagccatcccctaagaagagggcattcctgctcttccttctccatggctagaggatctacatgaactatttagattttttctacctgggagatttaactcctctctcctatttatttatttatatatcagcatggacttgcaggccaacagagattttgagaaacacattgaaggatctgttaacacttgatatacccaataaaagcagtggttgtgccagtgctgatctgtcttgatgtgaatgtgaacaatgggaacctgagctgagcagttaatgctagggtgacagaaactggacctctcccaagacatgtgacagagtaatacagcagccaacttcttcgccaaattaaagttttacaagatttaacctgtcatcaagacctgggattttggtgaaggacagaataacgggctcccagattcacaagccccaccaagaggatcaccccaggaacgcttggaggctgaggagttcactgaggctactgcatcttgagactcaggatgaagacccagcttggggctgtcaaaggttttttgcatgtctgacacccatgactccacctggaccttatggctccacccagaagcaattcagcccaacaggaggacagcttcaacccattacgatttcatctctgccccaaccactcagcagcaagcacctgttacctgtccacccccaccccttcccccaaactgcctttgaaaaatccctaacctatgagctttgaataagatgagtacgaacttcatcgcccatgtggcgtggccggcctcgtgtctattaaattctttttctactaca

SEQ ID NO: 456333 - DNA, 1944 bp, Homo sapiens
cgccagccccgcgctcctccgggcagagcgcgtgtggcggccgagcacatgggcccgcgggccgggcgggctcggggcggccgggacgaggaggggcgacgacgagctgcgagcaaagatgtgccccgggacccccggcaccttccagtggatttccttgcggaaaggatgttggcggtccctgtgacctgtggagacacggccagatctgccctccagcctgatcttttggccagaaggagattaaaaagatgcccctcaagatggctgtgcctgtcagctgcatggagcttcgttcaagtattttctgagcctgatggatttacagtgatcttcagtggtctggggaataacgctggtggaaccatgcactggaatgacacacgcccggcacatttcaggatactaaaagtggttttaagggaggctgtggctgaatgcctcatggattcttacagcttggatgtccatgggggacgaaggactgcagctggctgagagggttgagatctctgtttacttagatctctgccaacttcctttgggtctccctatggaatgtaagaccccgactcttcctggtgaagcatctgatgcacgttccatccggcgctcagctgggcttgagctgaccatactccctggagccttctcccgaggtgcgcgggtgaccttggcacatacagccatcatgatggtactttaagtggaggctgaatcatctcccctttgagctgcttggcacgtggctcccttggtgttccccttttactgccaggacactgagatttggagagaatcctgttacacctgggatttaggcactttcaatctgaaaaaatacatatcctttcagcactctggacggacttgagaactgtccttacgtgacctaaagctggagtattttgagattggagaattaagagccagtcttggtgctctgtgttcacctggttcatctgaggagctgcatctaccctgcccatgccatagatcctgccctgtttgcttctcctgttgctgctagtggacatgaggtaaccacagcctagttctgtgataagctcttcacacctgtacccatatggactgtgggagagtttctctgatatggactgtgatgcggaaggacagaataacgggctcccagattcacaagccccaccaagaggatcaccccaggaacgcttggaggctgaggagttcactgaggctactgcatcttgagactcaggatgaagacccagcttggggctgtcaaaggttttttgcatgtctgacacccatgactccacctggaccttatggctccacccagaagcaattcagcccaacaggaggacagcttcaacccattacgatttcatctctgccccaaccactcagcagcaagcacctgttacctgtccacccccaccccttcccccaaactgcctttgaaaaatccctaacctatgagctttgaataagatgagtacgaacttcatcgcccatgtggcgtggccggcctcgtgtctattaaattctttttctactacagaacaagaaaaaacaactggcctccactggtctaaaagatggagatctccgaccccttcgctttagtgcggcacacacagtgaccctgcgtcactgctgaaatagccctcacacccctgcatcgcccagacgcaccatccccacataggaccatctcacccgatccgcttaattatccgtcgccccctattacccgttctcgtccattctatccaccgaccacccccacccagacgccacactagcccccacgcgtcacggacgcggctagccctccaccaccccccactcacaccatagacaccagcccccctgagactactacgccacaacacgaggacaccctccctccgatacctccctttcagttcgcctacgtctctactccacgcccactatgct

SEQ ID NO: 456334 - DNA, 826 bp, Homo sapiens
  misc_feature (3)..(3): n is a, c, g, or t
  misc_feature (8)..(8): n is a, c, g, or t
  misc_feature (12)..(12): n is a, c, g, or t
  misc_feature (20)..(20): n is a, c, g, or t
  misc_feature (43)..(43): n is a, c, g, or t
agntcgcngggnctgtcctngtgcctaagctgggtattggatnggattagctacagagaaacaaggagacgggagagccttgaaatggaccttcaagattacaatgtgtagctgacattgtcagttaagttgggcagatctgacttcgctgattaagtgaatgtatgagccgatcctccccagaagctgggatcagcttccccatctgatgagccagtcttggtgctctgtgttcacctggttcatctgaggagctgcatctaccctgcccatgccatagatcctgccctgtttgcttctcctgttgctgctagtggacatgaggtaaccacagcctagttctgtgataagctcttcacacctgtacccatatggactgtgggagagtttctctgatatggactgtgatgcggaaggacagaataacgggctcccagattcacaagccccaccaagaggatcaccccaggaacgcttggaggctgaggagttcactgaggctactgcatcttgagactcaggatgaagacccagcttggggctgtcaaaggttttttgcatgtctgacacccatgactccacctggaccttatggctccacccagaagcaattcagcccaacaggaggacagcttcaacccattacgatttcatctctgccccaaccactcagcagcaagcacctgttacctgtccacccccaccccttcccccaaactgcctttgaaaaatccctaacctatgagctttgaataagatgagtacgaacttcatcgcccatgtggcgtggccggcctcgtgtctattaaattctttttctactaca

SEQ ID NO: 456335 - DNA, 805 bp, Homo sapiens
gaagggcactggagacctaccaggggctgggccattggagtggtgggtgctggggagcttccgtgggcccctccaggtccactccttgctcttctctgccttgttttgtgcccagaaggctgacctgtgtggatgcattatcagggtggatgcaacacagggctgccatgctctctggtatcagtttggaaggcactggcaggatgggaaggcaggcggggagtgaggtcagggggcctatccttccactgcctccctgctgctccctgactgattcagagccagtcttggtgctctgtgttcacctggttcatctgaggagctgcatctaccctgcccatgccatagatcctgccctgtttgcttctcctgttgctgctagtggacatgagaaggacagaataacgggctcccagattcacaagccccaccaagaggatcaccccaggaacgcttggaggctgaggagttcactgaggctactgcatcttgagactcaggatgaagacccagcttggggctgtcaaaggttttttgcatgtctgacacccatgactccacctggaccttatggctccacccagaagcaattcagcccaacaggaggacagcttcaacccattacgatttcatctctgccccaaccactcagcagcaagcacctgttacctgtccacccccaccccttcccccaaactgcctttgaaaaatccctaacctatgagctttgaataagatgagtacgaacttcatcgcccatgtggcgtggccggcctcgtgtctattaaattctttttctactaca

SEQ ID NO: 456336 - DNA, 1030 bp, Homo sapiens
cgccagccccgcgctcctccgggcagagcgcgtgtggcggccgagcacatgggcccgcgggccgggcgggctcggggcggccgggacgaggaggggcgacgacgagctgcgagcaaagatgtgccccgggacccccggcaccttccagtggatttccttgcggaaaggatgttggcggtccctgtgacctgtggagacacggccagatctgccctccagcctgatcttttggccagaaggagattaaaaagatgcccctcaagatggctgtgcctgtcagctgcatggagcttcgttcaagtattttctgagcctgatggatttacagtgatcttcagtggtctggggaataacgctggtggaaccatgcactggaatgacacacgcccggcacatttcaggatactaaaagtggttttaagggaggctgtggctgaatgcctcatggattcttacagcttggatgtccatgggggacgaaggactgcagctggctgagagggttgagatctctgtttacttagatctctgccaacttcctttgggtctccctatggaatgtaagaccccgactcttcctggtgaagcatctgatgcacgttccatccggcgctcagctgggcttgagctgaccatactccctggagccttctcccgaggtgcgcgggtgaccttggcacatacagccatcatgatggtactttaagtggaggctgaatcatctcccctttgagctgcttggcacgtggctcccttggtgttccccttttactgccaggacactgagatttggagagaatcctgttacacctgggatttaggcactttcaatctgaaaaaatacatatcctttcagcactctggacggacttgagaactgtccttacgtgacctaaagctggagtattttgagattggagaattaagagtgtgggcaccctggcttcaagctcacgagaaaccaggtcgggatttaaacaatgttgggttaaagcaaagtttcataaagacagaatcaagaaaaaaaaaa

SEQ ID NO: 456337 - DNA, 1200 bp, Homo sapiens
cgccagccccgcgctcctccgggcagagcgcgtgtggcggccgagcacatgggcccgcgggccgggcgggctcggggcggccgggacgaggaggggcgacgacgagctgcgagcaaagatgtgccccgggacccccggcaccttccagtggatttccttgcggaaaggatgttggcggtccctgtgacctgtggagacacggccagatctgccctccagcctgatcttttggccagaaggagattaaaaagatgcccctcaagatggctgtgcctgtcagctgcatggagcttcgttcaagtattttctgagcctgatggatttacagtgatcttcagtggtctggggaataacgctggtggaaccatgcactggaatgacacacgcccggcacatttcaggatactaaaagtggttttaagggaggctgtggctgaatgcctcatggattcttacagcttggatgtccatgggggacgaaggactgcagctggctgagagggttgagatctctgtttacttagatctctgccaacttcctttgggtctccctatggaatgtaagaccccgactcttcctggtgaagcatctgatgcacgttccatccggcgctcagctgggcttgagctgaccatactccctggagccttctcccgaggtgcgcgggtgaccttggcacatacagccatcatgatggtactttaagtggaggctgaatcatctcccctttgagctgcttggcacgtggctcccttggtgttccccttttactgccaggacactgagatttggagagaatcctgttacacctgggatttaggcactttcaatctgaaaaaatacatatcctttcagcactctggacggacttgagaactgtccttacgtgacctaaagctggagtattttgagattggagaattaagagccagtcttggtgctctgtgttcacctggttcatctgaggagctgcatctaccctgcccatgccatagatcctgccctgtttgcttctcctgttgctgctagtggacatgagaaggacagaataacgggctcccagattcacaagccccaccaagaggatcaccccaggaacgcttggaggctgaggagttcactgaggctactgcatcttgagactcaggatgaagacccagcttggggctgtcaaaggtgcgacctgccagctgagacct

SEQ ID NO: 456338 - DNA, 861 bp, Homo sapiens
cgccagccccgcgctcctccgggcagagcgcgtgtggcggccgagcacatgggcccgcgggccgggcgggctcggggcggccgggacgaggaggggcgacgacgagctgcgagcaaagatgtgccccgggacccccggcaccttccagtggatttccttgcggaaaggatgttggcggtccctgtgacctgtggagacacggccagatctgccctccagcctgatcttttggccagaaggagattaaaaagatgcccctcaagatggctgtgcctgtcagctgcatggagcttcgttcaagtattttctgagcctgatggatttacagtgatcttcagtggtctggggaataacgctggtggaaccatgcactggaatgacacacgcccggcacatttcaggatactaaaagtggttttaagggaggctgtggctgaatgcctcatggattcttacagcttggatgtccatgggggacgaaggactgcagctggctgagagggttgagatctctgtttacttagatctctgccaacttcctttgggtctccctatggaatgtaagaccccgactcttcctggtgaagcatctgatgcacgttccatccggcgctcagctgggcttgagaatcctgttacacctgggatttaggcactttcaatctgaaaaaatacatatcctttcagcactctggacggacttgagaactgtccttacgtgacctaaagctggagtattttgagattggagaattaagagtgtgggcaccctggcttcaagctcacgagaaaccaggtcgggatttaaacaatgttgggttaaagcaaagtttcataaagacagaatcaagaaaaaaaaaa

SEQ ID NO: 456339 - DNA, 783 bp, Homo sapiens
cgccagccccgcgctcctccgggcagagcgcgtgtggcggccgagcacatgggcccgcgggccgggcgggctcggggcggccgggacgaggaggggcgacgacgagctgcgagcaaagatgtgccccgggacccccggcaccttccagtggatttccttgcggaaaggatgttggcggtccctgtgacctgtggagacacggccagatctgccctccagcctgatcttttggccagaaggagattaaaaagatgcccctcaagatggctgtgcctgtcagctgcatggagcttcgttcaagtattttctgagcctgatggatttacagtgatcttcagtggtctggggaataacgctggtggaaccatgcactggaatgacacacgcccggcacatttcaggatactaaaagtggttttaagggaggctgtggctgaatgcctcatggattcttacagcttggatgtccatgggggacgaaggactgcagctggctgagagggttgagatctctgtttacttagatctctgccaacttcctttgggtctccctatggaatgtaagaccccgactcttcctggtgaagcatctgatgcacgttccatccggcgctcagctgggcttgagacttcgcaggtgagcagtaacggaaatcagccccgtttattcctcccagcacctgccttatccaactccccacgctgtggctgagtcccagcctgctatggaagcatcactggactctcgccagggtctggcagtcacgccgttgtgcacgacgg

SEQ ID NO: 456340 - DNA, 1772 bp, Homo sapiens
cgccagccccgcgctcctccgggcagagcgcgtgtggcggccgagcacatgggcccgcgggccgggcgggctcggggcggccgggacgaggaggggcgacgacgagctgcgagcaaagatgtgccccgggacccccggcaccttccagtggatttccttgcggaaaggatgttggcggtccctgtgacctgtggagacacggccagatctgccctccaatggcatcaccagaaaccaagaagatggtaaggcctggaggtggcagagctgaagaggttgaactggtttgttgaactttatggatggagccagccaacaggatgacattgtggcagagaaagaagcttgcagcttcttgcatcagaaaatcagatagagcctctctggcaagaagctgcagacacaaaagaagcttgcattgaagacggcaggaatgcaaaatggcaagaggctccatccttgaatcaccatttggagaagagttaactgacaaacaagatctgcactgaattatatgccacagggagccaggataggaggacaacatggtggatccagcatggaacttacaactgaggctagtttgatgtaacacaaggaagtgaagcaatttgctcaagataatgtgtctagtcatcaaaaggactggtcagtgcctcgatcttgatgatgatggatactgcttattggatactctcacatctcaacaatccaaacaccttccacaatgacctgcttaatctgacccctggcacatctcaaatcacagtctctgtctgtagtagataaaaaaaaatggacacacactttgcaataccacccatcaagagattaagtaactttcttcatcccttgaatctagtgggctcttgtgactaccaatagaatttggtggaagtgacactctgccttctgcaacaaggcacctgtgctgaaggagacttttagcctctgcccttgcctccctgaatagtgcctccatgtgaagaagaccaagctaacctactagagacatggctccaccaagaaccagtagcagctgcctggacaaggccatcttagaccacccaaccctagtcaagacagcagaatgactgcagctcggtgaattgtgttttaagctgctaagttttcagtggtttattaggcagcaatacataactgaaataccctttcaccctcccgactttaggctccagcctttctgatcttctcttaagccttggaacatgccattgacttttccaccctgagactttgcatgttattccttatgcataaaatacattcctctttccacctgtcaaatggtttaactcccttttatcatttaggccactagcttaaaattcacatgcagagagaattctttactgagcaaccatataccccagatttcttattcttcatatcaggcttttcttattttttcattgcgcatatcacaaagggcaattaattaattaattgtttgtttgtttgttattgcctattttccccctatccagatgtaagctccatgagagtggttggaggcaatgtttattctgttttccacttcaccttaagagagtgcgggaagagggtctcatccatatttctttggatccttttatcattttcctgcatactttcactgagagtgctctcatgtccatcagccagcacttgcttctcttttctgagggctgccccaggctcctgaagtccagcttggattgcctgcatgaaaacatagagagctaaaggctgggaacttgcatagccttagc

SEQ ID NO: 456341 - DNA, 823 bp, Homo sapiens
cgccagccccgcgctcctccgggcagagcgcgtgtggcggccgagcacatgggcccgcgggccgggcgggctcggggcggccgggacgaggaggggcgacgacgagctgcgagcaaagatgtgccccgggacccccggcaccttccagtggatttccttgcggaaaggatgttggcggtccctgtgacctgtggagacacggccagatctgccctccaatggcatcaccagaaaccaagaagatggtaaggcctggaggtggcagagctgaagaggcatggacccttctcctctcaccccccagcacatatgaaggggtatggacagtgttggaacaagatggtcttggattcagaaataaaaggagtcagaagctgaagacctaagggtaacacaagacttccgggttctggccgggcgcggtggctcacgcctgtaatcccagcactttgggaggccgaggcgggcggatcacgaggtcaggagatcgagaccatcccggctaaaacggcgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaagacttccgggttctgaaagcagtgcagcttggaattttcagaaagtgaattgacttcctgtagctgattgttttttattttaggaaaataaaaattattactttttgtttaaatg

SEQ ID NO: 456342 - DNA, 938 bp, Homo sapiens
cgccagccccgcgctcctccgggcagagcgcgtgtggcggccgagcacatgggcccgcgggccgggcgggctcggggcggccgggacgaggaggggcgacgacgagctgcgagcaaagatgtgccccgggacccccggcaccttccagtggatttccttgcggaaaggatgttggcggtccctgtgacctgtggagacacggccagatctgccctccagatttattaggagaaaaaccttcccggaagctgcagaaggacaaatacagaatccgtgtctgggagaaacctcgtggcctggtctccattatttgagatgagttacatcttggagatggcatcaccagaaaccaagaagatggtaaggcctggaggtggcagagctgaagaggcatggacccttctcctctcaccccccagcacatatgaaggggtatggacagtgttggaacaagatggtcttggattcagaaataaaaggagtcagaagctgaagacctaagggtaacacaagacttccgggttctggccgggcgcggtggctcacgcctgtaatcccagcactttgggaggccgaggcgggcggatcacgaggtcaggagatcgagaccatcccggctaaaacggcgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaagacttccgggttctgaaagcagtgcagcttggaattttcagaaagtgaattgacttcctgtagctgattgttttttattttaggaaaataaaaattattactttttgtttaaatg

SEQ ID NO: 456343 - DNA, 1979 bp, Homo sapiens
tctttttagttgttttgtctttttaagcaagatgaaaacctttctattagggattttggggttgggaggggatgggcagagatataaaccccagcctttaagactttgacaattgtacgtaaatacagatgtgtataaatataggcacatgcatatttttatgtgaaagttgattttaaaaaactaaaaaaatctaaactgcactcttattgataccatcataacgcaagtgggaaaaataagagtacgcagtctaatttaatttcatgcagtgggaaaatatatatgtgtgcttctgtaacatcctgaaaacatagctttccatcccctgttggctttgaatggtgggccgagcacccaggtcgtctgtattttggttttcttttgctaagcagagatcttgaattcttcaaggtgctgatagcaactgctggctcctttctgtagtcacacacctaatgctagtttagtgattcaaaatgcatcacatttttaggcaggacctagattttccctgtcaacctaagatgaaaataatttcagtgttgattcagaactgaacattaagtaggccctcgtcctgcagttggccacttgagtgttttgttttgtttttattttttaaggtgggcattttcctttaacctctactttttcaaaagcaacaaaggggcctcaacctgagtttcctatgggcctctcttctgcatccccaaagcggccaagagcaaatcctggggggataagaaaaaagtgtaaactaggtaggattgtgatgctcaaaataaccatctagcaatatcttggagcttgagaatagattttgtgggcttatttcttcttgcctcttccccatcctttcaagagagaacttatttttgaaaagtatctatatatacacacacacacacacacacacatattattatttaggtttttataccatactgtattggcgagaataccactatcattgtcctttacagtctatttcttcccccaagtcttggtctttttttattttctattttttcatgaaccacacaggagactttaacatcctggtcttttctgtttcttctttgtttccccaagtttgtctgtccccctttgccttccctgagtgttgaacatcaggtagtaaaaggctaaacgcaatttcttgcatgtcaatctattctttttctatgtttgactctgatgcagtgtgtttagcgtgtctagtagctggctactcctatttaaaaactcttcctggtagaagacaacccaaagacccttttcgatgaggtggtttctcattctacatcctctgatctctatagactgtaggatgctttgctttcaaagataactgggttagagggtggggtgtgcaataggtgatttatcatggtttttttcattatcaatattacatggatgattttctcagattcttctgaaagaagaaattgacaggcactgctagattcagctattgaatggctgaagagattgagtatttgaccttctctcaaaatcataaagtgagaattcataaggcacccaatgttaagatttatccagatttttacattttgatttcttctctctgtggggtggcaagttgagggagcattcttcattttagcttttacctgacaaccaaacttgcctttaccccatccctagaattggtgctcttggaatattgctgttaccatcatttttggggggccatcttcctaatgctacacacagcctgacaggggagcagcagatgaaagggtatgctattctgtttccagatgtttctttatgtaaatatgacgccaatgtaaatcctgtgtcaagatcatagagaatggtgctttttactacagttagcacatgcatttttagaaactactacatgttttagagaatctttgctgtgtatatgtaaactgtattgttcaactgttaacaaataataaattatttcattattaaagaaa

SEQ ID NO: 456344 - DNA, 575 bp, Homo sapiens
  misc_feature (407)..(407): n is a, c, g, or t
  misc_feature (422)..(423): n is a, c, g, or t
  misc_feature (434)..(436): n is a, c, g, or t
  misc_feature (499)..(500): n is a, c, g, or t
  misc_feature (538)..(538): n is a, c, g, or t
cccggagttgttgcacagttgtttccgggaagcgggactccaaatgggtcgcagtcgcagccgctctccacggagggaacgtaggcgttcccggtccacatcccgggagagagaacgcaggcgccgagaaaggtccaggtctcgggagagagatcggagaaggagccgctcgcgatccccgcaccgaagacgctcccgatctccaagacgacatagatccacatctccttccccttctcgactgaaagaaagaagagatgaggaaaagaaagaaacaaaagaaacaaagagcaaagaacggcagattactgaggaagacttagagggcaaaacagaggaagaaatagaaatgatgaagttaatgggatttgcctcctttgactccacaaaaaaggtggatggctctngtaaatgcccctatnngccataatgtnnnctctcagaaaagagggaagctacagggcagctaccacccccctccccccccccgccccccctnnaaccagtacccttgtgggattttcaattgccatgaaanaaaattgaaagttgtttgaaaggcattgaattttttt

SEQ ID NO: 456345 - DNA, 1792 bp, Homo sapiens
cccggagttgttgcacagttgtttccgggaagcgggactccaaatgggtcgcagtcgcagccgctctccacggagggaacgtaggcgttcccggtccacatcccgggagagagaacgcaggcgccgagaaaggtccaggtctcgggagagagatcggagaaggagccgctcgcgatccccgcaccgaagacgctcccgatctccaagacgacatagatccacatctccttccccttctcgactgaaagaaagaagagatgaggaaaagaaagaaacaaaagaaacaaagagcaaagaacggcagattactgaggaagacttagagggcaaaacagaggaagaaatagaaatgatgaagttaatgggatttgcctcctttgactccacaaaaggtaagaaggtggatggctctgtaaatgcctatgccataaatgtctctcagaagaggaagtacaggcagtacatgaatcgaaaaggtggattcaacagacctttggatttcattgcatgagaattgaagtgttgaaggatgattttttttcccctcatcttggtcagagagtggatttgtattttgtatttaacttgcattcaaaaaacaggatctcagttctcctttcttgtaaagtaagaaaatcttatttatgatatatgcagttaacttaccttgcctcaacagaagaaaggttaaatattacatttttttcttttaggaaatatcatttgtggcaggaccccattttatttgtccttattcctgtggaagcagtatatgttttcttcctgaatgctcattaggacttcttaaaaaacatgaaagtaatttggaagtaagtttatccaataaagcagtatttctacccttttagatttgataaatatttttattactaaagaatctccccagacattttcttttttttttcacacatagatttaagtatcttgattgttagtagtctaaaaatgggaagaatgaaaaagcataactagatttttctatcttctgtggtcgcccgcccccccccaaaaaaataccatttatggttctctccgcaagtataaaagcattacatgcaaaaaaaagatctcagagaaaacaaaagtaaaagaaaagcagaaaatcacctgttatctactcccagaaataatcaatttcaacattttggtatatgtttttccaggcttctttgggttgatcccacctatgagatcagaatatgtatgcagttctttctttaacccttttttctcctatgtactgtgaacatttaaaaagtacttttaaatattctttggaaacttagcttttagtaactacttggttgtatcataatttattaactaatgttttattggtaaacattggcttgcctcccatgacttgccattataattaaaactgtgactactatctgtctccattacatacatatttttgtatgtttccattatttcctcagggtccgtacttagacgtggcattgctgagtgagattaaaagggccatgtatacatgttttaagacatttggtatctctggctaaaaggtaacagccaactctatccagtaaagtatgagcattcttgtttcagatacatgtacaaatattaagtgtaaaatttgttttaaagtttcctacctgatgggtaaaataatggtactatttggttttgtatttttgtttcatttctagggaggatgaatattttttaaatgtattagccatatttcttttgtaacatgctaattttaaatcttggatctattaatatttgtcttttggcaagc

SEQ ID NO: 456346 - DNA, 1152 bp, Homo sapiens
cccggagttgttgcacagttgtttccgggaagcgggactccaaatgggtcgcagtcgcagccgctctccacggagggaacgtaggcgttcccggtccacatcccgggagagagaacgcaggcgccgagaaaggtccaggtctcgggagagagatcggagaaggagccgctcgcgatccccgcaccgaagacgctcccgatctccaagacgacatagatccacatctccttccccttctcgactgaaagaaagaagagatgaggaaaagaaagaaacaaaagaaacaaagagcaaagaacggcagattactgaggaagacttagagggcaaaacagaggaagaaatagaaatgatgaagttaatgggatttgcctcctttgactccacaaaaggtaagaaggtggatggctctgtaaatgcctatgccataaatgtctctcagaagaggaagtacaggcagtacatgaatcgaaaaggtggattcaacagacctttggatttcattgcatgagaattgaagtgttgaaggatgattttttttcccctcatcttggtcagagagtggatttgtattttgtatttaacttgcattcaaaaaacaggatctcagttctcctttcttgtaaagtaagaaaatcttatttatgatatatgcagttaacttaccttgcctcaacagaagaaaggttaaatattacatttttttcttttaggaaatatcatttgtggcaggaccccattttatttgtccttattcctgtggaagcagtatatgttttcttcctgaatgctcattaggacttcttaaaaaacatgaaagtaaggtccgtacttagacgtggcattgctgagtgagattaaaagggccatgtatacatgttttaagacatttggtatctctggctaaaaggtaacagccaactctatccagtaaagtatgagcattcttgtttcagatacatgtacaaatattaagtgtaaaatttgttttaaagtttcctacctgatgggtaaaataatggtactatttggttttgtatttttgtttcatttctagggaggatgaatattttttaaatgtattagccatatttcttttgtaacatgctaattttaaatcttggatctattaatatttgtcttttggcaagc

SEQ ID NO: 456347 - DNA, 1708 bp, Homo sapiens
cccggagttgttgcacagttgtttccgggaagcgggactccaaatgggtcgcagtcgcagccgctctccacggagggaacgtaggcgttcccggtccacatcccgggagagagaacgcaggcgccgagaaaggtccaggtctcgggagagagatcggagaaggagccgctcgcgatccccgcaccgaagacgctcccgatctccaagacgacatagatccacatctccttccccttctcgactgaaagaaagaagagatgaggaaaagaaagaaacaaaagaaacaaagagcaaagaacggcagattactgaggaagacttagagggcaaaacagaggaagaaatagaaatgatgaagttaatgggatttgcctcctttgactccacaaaaggtaagaaggtggatggctctgtaaatgcctatgccataaatgtctctcagaagaggaagtacaggcagtacatgaatcgaaaaggtggattcaacagacctttggatttcattgcatgagaattgaagtgttgaaggatgattttttttcccctcatcttggtcagagagtggatttgtattttgtatttaacttgcattcaaaaaacaggatctcagttctcctttcttgtaaagtgaaatatcatttgtggcaggaccccattttatttgtccttattcctgtggaagcagtatatgttttcttcctgaatgctcattaggacttcttaaaaaacatgaaagtaatttggaagtaagtttatccaataaagcagtatttctacccttttagatttgataaatatttttattactaaagaatctccccagacattttcttttttttttcacacatagatttaagtatcttgattgttagtagtctaaaaatgggaagaatgaaaaagcataactagatttttctatcttctgtggtcgcccgcccccccccaaaaaaataccatttatggttctctccgcaagtataaaagcattacatgcaaaaaaaagatctcagagaaaacaaaagtaaaagaaaagcagaaaatcacctgttatctactcccagaaataatcaatttcaacattttggtatatgtttttccaggcttctttgggttgatcccacctatgagatcagaatatgtatgcagttctttctttaacccttttttctcctatgtactgtgaacatttaaaaagtacttttaaatattctttggaaacttagcttttagtaactacttggttgtatcataatttattaactaatgttttattggtaaacattggcttgcctcccatgacttgccattataattaaaactgtgactactatctgtctccattacatacatatttttgtatgtttccattatttcctcagggtccgtacttagacgtggcattgctgagtgagattaaaagggccatgtatacatgttttaagacatttggtatctctggctaaaaggtaacagccaactctatccagtaaagtatgagcattcttgtttcagatacatgtacaaatattaagtgtaaaatttgttttaaagtttcctacctgatgggtaaaataatggtactatttggttttgtatttttgtttcatttctagggaggatgaatattttttaaatgtattagccatatttcttttgtaacatgctaattttaaatcttggatctattaatatttgtcttttggcaagc

SEQ ID NO: 456348 - DNA, 1735 bp, Homo sapiens
cccggagttgttgcacagttgtttccgggaagcgggactccaaatgggtcgcagtcgcagccgctctccacggagggaacgtaggcgttcccggtccacatcccgggagagagaacgcaggcgccgagaaaggtccaggtctcgggagagagatcggagaaggagccgctcgcgatccccgcaccgaagacgctcccgatctccaagacgacatagatccacatctccttccccttctcgactgaaagaaagaagagatgaggaaaagaaagaaacaaaagaaacaaagagcaaagaacggcagattactgaggaagacttagagggcaaaacagaggaagaaatagaaatgatgaagttaatgggatttgcctcctttgactccacaaaaggtaagaaggtggatggctctgtaaatgcctatgccataaatgtctctcagaagaggaagtacaggcagtacatgaatcgaaaaggtggattcaacagacctttggatttcattgcatgagaattgaagtgttgaaggatgattttttttcccctcatcttggtcagagagtggatttgtattttgtatttaacttgcattcaaaaaacaggatctcagttctcctttcttgtaaagtgttaaatattacatttttttcttttaggaaatatcatttgtggcaggaccccattttatttgtccttattcctgtggaagcagtatatgttttcttcctgaatgctcattaggacttcttaaaaaacatgaaagtaatttggaagtaagtttatccaataaagcagtatttctacccttttagatttgataaatatttttattactaaagaatctccccagacattttcttttttttttcacacatagatttaagtatcttgattgttagtagtctaaaaatgggaagaatgaaaaagcataactagatttttctatcttctgtggtcgcccgcccccccccaaaaaaataccatttatggttctctccgcaagtataaaagcattacatgcaaaaaaaagatctcagagaaaacaaaagtaaaagaaaagcagaaaatcacctgttatctactcccagaaataatcaatttcaacattttggtatatgtttttccaggcttctttgggttgatcccacctatgagatcagaatatgtatgcagttctttctttaacccttttttctcctatgtactgtgaacatttaaaaagtacttttaaatattctttggaaacttagcttttagtaactacttggttgtatcataatttattaactaatgttttattggtaaacattggcttgcctcccatgacttgccattataattaaaactgtgactactatctgtctccattacatacatatttttgtatgtttccattatttcctcagggtccgtacttagacgtggcattgctgagtgagattaaaagggccatgtatacatgttttaagacatttggtatctctggctaaaaggtaacagccaactctatccagtaaagtatgagcattcttgtttcagatacatgtacaaatattaagtgtaaaatttgttttaaagtttcctacctgatgggtaaaataatggtactatttggttttgtatttttgtttcatttctagggaggatgaatattttttaaatgtattagccatatttcttttgtaacatgctaattttaaatcttggatctattaatatttgtcttttggcaagc

SEQ ID NO: 456349 - DNA, 1409 bp, Homo sapiens
gtggctgtgaatgttataattaaggagatttctagggagaatattatagagaggtagagtttttttcgtgattcccgacctggaatttccctgaaaccgtcgacggcttcaacggaactttcatgttttttaagaagtgttgaaggatgattttttttcccctcatcttggtcagagagtggatttgtattttgtatttaacttgcattcaaaaaacaggatctcagttctcctttcttgtaaagtaagaaaatcttatttatgatatatgcagttaacttaccttgcctcaacagaagaaaggttaaatattacatttttttcttttaggaaatatcatttgtggcaggaccccattttatttgtccttattcctgtggaagcagtatatgttttcttcctgaatgctcattaggacttcttaaaaaacatgaaagtaatttggaagtaagtttatccaataaagcagtatttctacccttttagatttgataaatatttttattactaaagaatctccccagacattttcttttttttttcacacatagatttaagtatcttgattgttagtagtctaaaaatgggaagaatgaaaaagcataactagatttttctatcttctgtggtcgcccgcccccccccaaaaaaataccatttatggttctctccgcaagtataaaagcattacatgcaaaaaaaagatctcagagaaaacaaaagtaaaagaaaagcagaaaatcacctgttatctactcccagaaataatcaatttcaacattttggtatatgtttttccaggcttctttgggttgatcccacctatgagatcagaatatgtatgcagttctttctttaacccttttttctcctatgtactgtgaacatttaaaaagtacttttaaatattctttggaaacttagcttttagtaactacttggttgtatcataatttattaactaatgttttattggtaaacattggcttgcctcccatgacttgccattataattaaaactgtgactactatctgtctccattacatacatatttttgtatgtttccattatttcctcagggtccgtacttagacgtggcattgctgagtgagattaaaagggccatgtatacatgttttaagacatttggtatctctggctaaaaggtaacagccaactctatccagtaaagtatgagcattcttgtttcagatacatgtacaaatattaagtgtaaaatttgttttaaagtttcctacctgatgggtaaaataatggtactatttggttttgtatttttgtttcatttctagggaggatgaatattttttaaatgtattagccatatttcttttgtaacatgctaattttaaatcttggatctattaatatttgtcttttggcaagc

SEQ ID NO: 456350 - DNA, 3594 bp, Homo sapiens
cccggagttgttgcacagttgtttccgggaagcgggactccaaatgggtcgcagtcgcagccgctctccacggagggaacgtaggcgttcccggtccacatcccgggagagagaacgcaggcgccgagaaaggtccaggtctcgggagagagatcggagaaggagccgctcgcgatccccgcaccgaagacgctcccgatctccaagacgacatagatccacatctccttccccttctcgactgaaagaaagaagagatgaggaaaagaaagaaacaaaagaaacaaagagcaaagaacggcagattactgaggaagacttagagggcaaaacagaggaagaaatagaaatgatgaagttaatgggatttgcctcctttgactccacaaaaggtaagaaggtggatggctctgtaaatgcctatgccataaatgtctctcagaagaggaagtacaggcagtacatgaatcgaaaaggtggattcaacagacctttggatttcattgcatgagaattgaagtgttgaaggatgattttttttcccctcatcttggtcagagagtggatttgtattttgtatttaacttgcattcaaaaaacaggatctcagttctcctttcttgtaaagtaagctgaacatggttatgcctccatgttaccatacaataacaaggacagagatgccttaaaacggaggaacaaatccaaaaagaataacagcagtagcagatcaactcacaatgaaatggagaagaatagacgggctcatcttcgcttgtgcctggagaagttgaaggggctggtgccactgggacccgaatcaagtcgacacactacgttgagtttattaacaaaagccaaattgcacataaagaaacttgaagattgtgacagaaaagccgttcaccaaatcgaccagcttcagcgagagcagcgacacctgaagaggcagctggagaagctgggcattgagaggatccggatggacagcatcggctccaccgtctcctcggagcgctccgactccgacagggaagaaatcgacgttgacgtggagagcacggactatctcacaggtgatctggactggagcagcagcagtgtgagcgactctgacgagcggggcagcatgcagagcctcggcagtgatgagggctattccagcaccagcatcaagagaataaagctgcaggacagtcacaaggcgtgtcttggtctctaagagagtgggcactgcggctgtctccttgaaggttctccctgttggttctgattaggtaacgtattggacctgcccacaactcccttgcacgtaaacttcagtgtcccaccttgaccaaaatcagctttgtaactgttttcaaggaggtgcttaggattgtgggtttctgattgcatccactagcttctctttttctcgccataaaaatttgtctctgagagactatacattccaatcaatttgaagcatccaagaattcttagaccgaataagcaatgtccacatctcagcaatccccctctttgctctcctcgtgtcctctcccagacctttcttccagttttctggcttactgtgttacttgcctaggaggaatgtccaagtgtgtcttgtacttaggaaactgaaggaaacaaacttttgaaattgagatcctgatctcagaactccaaagtaagctttgaaagcagcatttaagagcacttaaccatggacctcaccaccagtgaggaagtcaggaatacctctagaaaacacgcccttcacaccgcgcatgctcattcccccgacgcgccgcgtgtggatgggagcagtatttctcactttaaaatggacaccttgatagtgtgtctctggggttgcacagctcatcaaagttccaaattgtttgttctcacaaacaaaacggtacaatctatttttgtgcgatgttcttgggacctcgctgtgttctgctatctcgaggcacattctcccctccaactttgttaatgctacttgtctctggaacatttttttttcctacctcagagataaatgagatctccatttcccacttaacacagtgattatccttttttccccccccaaaatagtgacatttggtccaattataatctattttcctattgaactttcagcaataactgagctgtggcactagcagagctagtagccattatcagtgaaagaaaaagtccacatttctactctctgttgcaggtgaacaggagaggatggtacactgttactagaactcctctccttattgattatttttggacacacccagaaacttctttatggaggcttttgggttgatagtttaaaaggctgatttttctttttggttatgatttctcccttaagtggtctccgactttgtagcatttttatttaagctaaaacagagcacatgtatatgtacataagacacattaaatctataaatactatttattcattttatataaactaatgtaatggaaaacaaattcttatgactttgtggttttatagatgttctagaaactttgtatgtaggtatctacaaaattagttcattcccctgaatatttttgcattcatatttttgaggtcttgatgttttcagcctctggcgaatctttttcattgaatttgaaccatttgtaaaatctgtgatgctgaagcagagtgtgtcacaaagtgatgagaacattactaaaatccacggacgcactgcgacctaagggctcaacggctgactcggcagcgggcagccaccccacgctcccctgcggtcactcgcacaccacagcctgaagctcccccagcgcctgcacctcgcacacagctaaggtcaaagttcaaacgcactccacacggaagctcattctatacccgaagagcagtctcagaaagcaagattacttttgtgttttttaaaaaatgattctttaatgtatttttctaaacattctgattggaagtagtggattcctaaatgattccaaagtcacctgtaattcttctgtttttgttttgttctgtcttttcttcattttggctttgggtggggggaggggcaggtgacacaaaggattttttttttttttttaatttttggaatcttttccaataaccagctaaagatttgcactgaaatacaacttgtatgccttttgcatttttaaagcctgcttcctggatttaagcagagtgatagtgttcaaagagccagttcagcctgtaacatatttgaaaaagatatgtctgcactttgaggtcccttttgaatgccattcactagacctctcaagcattttgtttcattgctacatccaagcgcctcacaagtccacaatgcgggacagcatcaaaagctcaagactttggaaaaagcttgtgggcttgcactgggggagggaagggaacaaaatttgtgtacttctttgtttaatttagaaataaggcatccaagagatgccattattttctgtgtttcaattgttgtgcctttgagttaaactgcatttttgtcttttggttgaaatctgaaatgtactgtcccaatataaaacagtaattatttgaccttcagcactgtttgt

SEQ ID NO: 456351 - DNA, 3258 bp, Homo sapiens
aaagaagaggaagaagattatttcaggtagagggaagagctcatgaaaatgccatggtaagaaggtggatggctctgtaaatgcctatgccataaatgtctctcagaagaggaagtacaggcagtacatgaatcgaaaaggtggattcaacagacctttggatttcattgcatgagaattgaagtgttgaaggatgattttttttcccctcatcttggtcagagagtggatttgtattttgtatttaacttgcattcaaaaaacaggatctcagttctcctttcttgtaaagtaagctgaacatggttatgcctccatgttaccatacaataacaaggacagagatgccttaaaacggaggaacaaatccaaaaagaataacagcagtagcagatcaactcacaatgaaatggagaagaatagacgggctcatcttcgcttgtgcctggagaagttgaaggggctggtgccactgggacccgaatcaagtcgacacactacgttgagtttattaacaaaagccaaattgcacataaagaaacttgaagattgtgacagaaaagccgttcaccaaatcgaccagcttcagcgagagcagcgacacctgaagaggcagctggagaagctgggcattgagaggatccggatggacagcatcggctccaccgtctcctcggagcgctccgactccgacagggaagaaatcgacgttgacgtggagagcacggactatctcacaggtgatctggactggagcagcagcagtgtgagcgactctgacgagcggggcagcatgcagagcctcggcagtgatgagggctattccagcaccagcatcaagagaataaagctgcaggacagtcacaaggcgtgtcttggtctctaagagagtgggcactgcggctgtctccttgaaggttctccctgttggttctgattaggtaacgtattggacctgcccacaactcccttgcacgtaaacttcagtgtcccaccttgaccaaaatcagctttgtaactgttttcaaggaggtgcttaggattgtgggtttctgattgcatccactagcttctctttttctcgccataaaaatttgtctctgagagactatacattccaatcaatttgaagcatccaagaattcttagaccgaataagcaatgtccacatctcagcaatccccctctttgctctcctcgtgtcctctcccagacctttcttccagttttctggcttactgtgttacttgcctaggaggaatgtccaagtgtgtcttgtacttaggaaactgaaggaaacaaacttttgaaattgagatcctgatctcagaactccaaagtaagctttgaaagcagcatttaagagcacttaaccatggacctcaccaccagtgaggaagtcaggaatacctctagaaaacacgcccttcacaccgcgcatgctcattcccccgacgcgccgcgtgtggatgggagcagtatttctcactttaaaatggacaccttgatagtgtgtctctggggttgcacagctcatcaaagttccaaattgtttgttctcacaaacaaaacggtacaatctatttttgtgcgatgttcttgggacctcgctgtgttctgctatctcgaggcacattctcccctccaactttgttaatgctacttgtctctggaacatttttttttcctacctcagagataaatgagatctccatttcccacttaacacagtgattatccttttttccccccccaaaatagtgacatttggtccaattataatctattttcctattgaactttcagcaataactgagctgtggcactagcagagctagtagccattatcagtgaaagaaaaagtccacatttctactctctgttgcaggtgaacaggagaggatggtacactgttactagaactcctctccttattgattatttttggacacacccagaaacttctttatggaggcttttgggttgatagtttaaaaggctgatttttctttttggttatgatttctcccttaagtggtctccgactttgtagcatttttatttaagctaaaacagagcacatgtatatgtacataagacacattaaatctataaatactatttattcattttatataaactaatgtaatggaaaacaaattcttatgactttgtggttttatagatgttctagaaactttgtatgtaggtatctacaaaattagttcattcccctgaatatttttgcattcatatttttgaggtcttgatgttttcagcctctggcgaatctttttcattgaatttgaaccatttgtaaaatctgtgatgctgaagcagagtgtgtcacaaagtgatgagaacattactaaaatccacggacgcactgcgacctaagggctcaacggctgactcggcagcgggcagccaccccacgctcccctgcggtcactcgcacaccacagcctgaagctcccccagcgcctgcacctcgcacacagctaaggtcaaagttcaaacgcactccacacggaagctcattctatacccgaagagcagtctcagaaagcaagattacttttgtgttttttaaaaaatgattctttaatgtatttttctaaacattctgattggaagtagtggattcctaaatgattccaaagtcacctgtaattcttctgtttttgttttgttctgtcttttcttcattttggctttgggtggggggaggggcaggtgacacaaaggattttttttttttttttaatttttggaatcttttccaataaccagctaaagatttgcactgaaatacaacttgtatgccttttgcatttttaaagcctgcttcctggatttaagcagagtgatagtgttcaaagagccagttcagcctgtaacatatttgaaaaagatatgtctgcactttgaggtcccttttgaatgccattcactagacctctcaagcattttgtttcattgctacatccaagcgcctcacaagtccacaatgcgggacagcatcaaaagctcaagactttggaaaaagcttgtgggcttgcactgggggagggaagggaacaaaatttgtgtacttctttgtttaatttagaaataaggcatccaagagatgccattattttctgtgtttcaattgttgtgcctttgagttaaactgcatttttgtcttttggttgaaatctgaaatgtactgtcccaatataaaacagtaattatttgaccttcagcactgtttgt

SEQ ID NO: 456352 - DNA, 1068 bp, Homo sapiens
cccggagttgttgcacagttgtttccgggaagcgggactccaaatgggtcgcagtcgcagccgctctccacggagggaacgtaggcgttcccggtccacatcccgggagagagaacgcaggcgccgagaaaggtccaggtctcgggagagagatcggagaaggagccgctcgcgatccccgcaccgaagacgctcccgatctccaagacgacatagatccacatctccttccccttctcgactgaaagaaagaagagatgaggaaaagaaagaaacaaaagaaacaaagagcaaagaacggcagattactgaggaagacttagagggcaaaacagaggaagaaatagaaatgatgaagttaatgggatttgcctcctttgactccacaaaaggtaagaaggtggatggctctgtaaatgcctatgccataaatgtctctcagaagaggaagtacaggcagtacatgaatcgaaaaggtggattcaacagacctttggatttcattgcatgagaattgaagtgttgaaggatgattttttttcccctcatcttggtcagagagtggatttgtattttgtatttaacttgcattcaaaaaacaggatctcagttctcctttcttgtaaagtgaaatatcatttgtggcaggaccccattttatttgtccttattcctgtggaagcagtatatgttttcttcctgaatgctcattaggacttcttaaaaaacatgaaagtaaggtccgtacttagacgtggcattgctgagtgagattaaaagggccatgtatacatgttttaagacatttggtatctctggctaaaaggtaacagccaactctatccagtaaagtatgagcattcttgtttcagatacatgtacaaatattaagtgtaaaatttgttttaaagtttcctacctgatgggtaaaataatggtactatttggttttgtatttttgtttcatttctagggaggatgaatattttttaaatgtattagccatatttcttttgtaacatgctaattttaaatcttggatctattaatatttgtcttttggcaagc

SEQ ID NO: 456353 - DNA, 2190 bp, Homo sapiens
agccgggcatggtggtgcatggctgtaatcctagcaactcaggatgcttcttgacgtcaagaagcatccaagaattcttagaccgaataagcaatgtccacatctcagcaatccccctctttgctctcctcgtgtcctctcccagacctttcttccagttttctggcttactgtgttacttgcctaggaggaatgtccaagtgtgtcttgtacttaggaaactgaaggaaacaaacttttgaaattgagatcctgatctcagaactccaaagtaagctttgaaagcagcatttaagagcacttaaccatggacctcaccaccagtgaggaagtcaggaatacctctagaaaacacgcccttcacaccgcgcatgctcattcccccgacgcgccgcgtgtggatgggagcagtatttctcactttaaaatggacaccttgatagtgtgtctctggggttgcacagctcatcaaagttccaaattgtttgttctcacaaacaaaacggtacaatctatttttgtgcgatgttcttgggacctcgctgtgttctgctatctcgaggcacattctcccctccaactttgttaatgctacttgtctctggaacatttttttttcctacctcagagataaatgagatctccatttcccacttaacacagtgattatccttttttccccccccaaaatagtgacatttggtccaattataatctattttcctattgaactttcagcaataactgagctgtggcactagcagagctagtagccattatcagtgaaagaaaaagtccacatttctactctctgttgcaggtgaacaggagaggatggtacactgttactagaactcctctccttattgattatttttggacacacccagaaacttctttatggaggcttttgggttgatagtttaaaaggctgatttttctttttggttatgatttctcccttaagtggtctccgactttgtagcatttttatttaagctaaaacagagcacatgtatatgtacataagacacattaaatctataaatactatttattcattttatataaactaatgtaatggaaaacaaattcttatgactttgtggttttatagatgttctagaaactttgtatgtaggtatctacaaaattagttcattcccctgaatatttttgcattcatatttttgaggtcttgatgttttcagcctctggcgaatctttttcattgaatttgaaccatttgtaaaatctgtgatgctgaagcagagtgtgtcacaaagtgatgagaacattactaaaatccacggacgcactgcgacctaagggctcaacggctgactcggcagcgggcagccaccccacgctcccctgcggtcactcgcacaccacagcctgaagctcccccagcgcctgcacctcgcacacagctaaggtcaaagttcaaacgcactccacacggaagctcattctatacccgaagagcagtctcagaaagcaagattacttttgtgttttttaaaaaatgattctttaatgtatttttctaaacattctgattggaagtagtggattcctaaatgattccaaagtcacctgtaattcttctgtttttgttttgttctgtcttttcttcattttggctttgggtggggggaggggcaggtgacacaaaggattttttttttttttttaatttttggaatcttttccaataaccagctaaagatttgcactgaaatacaacttgtatgccttttgcatttttaaagcctgcttcctggatttaagcagagtgatagtgttcaaagagccagttcagcctgtaacatatttgaaaaagatatgtctgcactttgaggtcccttttgaatgccattcactagacctctcaagcattttgtttcattgctacatccaagcgcctcacaagtccacaatgcgggacagcatcaaaagctcaagactttggaaaaagcttgtgggcttgcactgggggagggaagggaacaaaatttgtgtacttctttgtttaatttagaaataaggcatccaagagatgccattattttctgtgtttcaattgttgtgcctttgagttaaactgcatttttgtcttttggttgaaatctgaaatgtactgtcccaatataaaacagtaattatttgaccttcagcactgtttgt

SEQ ID NO: 456354 - DNA, 1496 bp, Homo sapiens
cccggagttgttgcacagttgtttccgggaagcgggactccaaatgggtcgcagtcgcagccgctctccacggagggaacgtaggcgttcccggtccacatcccgggagagagaacgcaggcgccgagaaaggtccaggtctcgggagagagatcggagaaggagccgctcgcgatccccgcaccgaagacgctcccgatctccaagacgacatagatccacatctccttccccttctcgactgaaagaaagaagagatgaggaaaagaaagaaacaaaagaaacaaagagcaaagaacggcagattactgaggaagacttagagggcaaaacagaggaagaaatagaaatgatgaagttaatgggatttgcctcctttgactccacaaaaggtaagaaggtggatggctctgtaaatgcctatgccataaatgtctctcagaagaggaagtacaggcagtacatgaatcgaaaaggtggattcaacagacctttggatttcattgcatgagaattgaagtgttgaaggatgattttttttcccctcatcttggtcagagagtggatttgtattttgtatttaacttgcattcaaaaaacaggatctcagttctcctttcttgtaaagtaagctgaacatggttatgcctccatgttaccatacaataacaaggacagagatgccttaaaacggaggaacaaatccaaaaagaataacagcagtagcagatcaactcacaatgaaatggagaagaatagacgggctcatcttcgcttgtgcctggagaagttgaaggggctggtgccactgggacccgaatcaagtcgacacactacgttgagtttattaacaaaagccaaattgcacataaagaaacttgaagattgtgacagaaaagccgttcaccaaatcgaccagcttcagcgagagcagcgacacctgaagaggcagctggagaagctgggcattgagaggatccggatggacagcatcggctccaccgtctcctcggagcgctccgactccgacagggaagaaatcgacgttgacgtggagagcacggactatctcacaggtgatctggactggagcagcagcagtgtgagcgactctgacgagcggggcagcatgcagagcctcggcagtgatgagggctattccagcaccagcatcaagagaataaagctgcaggacagtcacaaggcgtgtcttggtctctaagagagtgggcactgcggctgtctccttgaaggttctccctgttggttctgattagaattggtgctcttggaatattgctgttaccatcatttttggggggccatcttcctaatgctacacacagcctgacaggggagcagcagatgaaagggtatgctattctgtttactgaacgatttcataaacttaaatggaaaaagccaatgacaatcaattagccccggagcgagactcacatagcgtaaacgggaaccatctagagacgaggaaaacc

SEQ ID NO: 456355 - DNA, 576 bp, Homo sapiens
cccggagttgttgcacagttgtttccgggaagcgggactccaaatgggtcgcagtcgcagccgctctccacggagggaacgtaggcgttcccggtccacatcccgggagagagaacgcaggcgccgagaaaggtccaggtctcgggagagagatcggagaaggagccgctcgcgatccccgcaccgaagacgctcccgatctccaagacgacatagatccacatctccttccccttctcgactgaaagaaagaagagatgaggaaaagaaagaaacaaaagaaacaaagagcaaagaacggcagattactgaggaagacttagagggcaaaacagaggaagaaggagaggaatactaaagttaaaacgtcacaaaggtgctgcttttacagggaagcttattctgttttaaacattgaaaagttgtggtctgatcagttaatttgtatgtagcagtgtatgctctcatatacaattactgacctatgctctaaaacatgaatgctttgttacagacccaagctgtccatttctgtgatgggttttgaataaagtattccctgtcttaaaaaaaaaa

SEQ ID NO: 456356 - DNA, 725 bp, Homo sapiens
catcatgagtcagggaccattactgtatatagtatttacacatgtgaatgactatataatagcagatattattccctaccccagcacttgtattatcaatagacttagcttcgaaaaccttggattttgcttctcattggttttcaccagagttgtctggttcaaaatatgtttattcagcaaaaggtcattggtagcatttgccatcgcaaggcctgggcaacttcacactctttgagaactcattctgcctggggtgcttctggcccactgtgaaactctcaaatgctactgtggtcttgttttcatagacgggctcatcttcgcttgtgcctggagaagttgaaggggctggtgccactgggacccgaatcaagtcgacacactacgttgagtttattaacaaaagccaaattgcacataaaggtaagtgtattgttgggatgctgctttatctttacctgttcagtgagggtttgtctgttgttacatctccaggacagtcctctcccctgaactcctccagtctagctattggatgaatcacaggtacctcaaatgcaacatattcaaaacccaactgagtgtttctcactcccatgcaccagaggttaaatggtccatccaactctccatccagttgtacaagccagaattcaggagtccgtgatagctcctgctccttaaccatatatctaggccatctccaaggcctaaatattttg

SEQ ID NO: 456357 - DNA, 561 bp, Homo sapiens
tttttctactggacggcgcagctctagatatttgaggtaattatcagttctgcaatttgtgtgcgtttgcattagaacgtaggcgttcccggtccacatcccgggagagagaacgcaggcgccgagaaaggtccaggtctcgggagagagatcggagaaggagccgctcgcgatccccgcaccgaagacgctcccggtaagggcagaaaataagccaagagttttatttaccgaaagtccctaagaaactggtcgcagctcttaactttgttttcatcgcttataaggggatttacggtttcctgaaatggaggaaacttaatccaaccttattctaaagctaacattcaccttggttaaatggtgctaatagtactctacatcacaaagttgtcttgaaagagtaagtaagaaataatgcatgcaaaccccagagcatggtgcttggcaagaaaaagaaataagtattttatatttttgtttctttcttccgttcctttcctttccttttcttttccttttcctttcttttcctcttttttgagacggagtctcgctctg

SEQ ID NO: 456358 - DNA, 258 bp, Homo sapiens
cccaccttagccttccgccaagtagctgggagtacaggtacatgccactgccaccacacctgctttcatgtatcctgatttaatgtatccttcctgttttttgtctgtttgtttattgtttttcttcagggtaagaaggtggatggctctgtaaatgcctatgccataaatgtctctcagaagaggaagtacaggtatgcatagcccccattattatgtttgaactaataaatcagttttttacttcaaactttatta

SEQ ID NO: 456359 - DNA, 1092 bp, Homo sapiens
cccggagttgttgcacagttgtttccgggaagcgggactccaaatgggtcgcagtcgcagccgctctccacggagggaacgtaggcgttcccggtccacatcccgggagagagaacgcaggcgccgagaaaggtccagatctccaagacgacatagatccacatctccttccccttctcgactgaaagaaagaagagatgaggaaaagaaagaaacaaaagaaacaaagagcaaagaacggcagattactgaggaagacttagagggcaaaacagaggaagaaatagaaatgatgaagttaatgggatttgcctcctttgactccacaaaaggtaagaaggtggatggctctgtaaatgcctatgccataaatgtctctcagaagaggaagtacaggcagtacatgaatcgaaaaggtggattcaacagacctttggatttcattgcatgagaattgaagtgttgaaggatgattttttttcccctcatcttggtcagagagtggatttgtattttgtatttaacttgcattcaaaaaacaggatctcagttctcctttcttgtaaagtaagaaaatcttatttatgatatatgcagttaacttaccttgcctcaacagaagaaaggttaaatattacatttttttcttttaggaaatatcatttgtggcaggaccccattttatttgtccttattcctgtggaagcagtatatgttttcttcctgaatgctcattaggacttcttaaaaaacatgaaagtaaggtccgtacttagacgtggcattgctgagtgagattaaaagggccatgtatacatgttttaagacatttggtatctctggctaaaaggtaacagccaactctatccagtaaagtatgagcattcttgtttcagatacatgtacaaatattaagtgtaaaatttgttttaaagtttcctacctgatgggtaaaataatggtactatttggttttgtatttttgtttcatttctagggaggatgaatattttttaaatgtattagccatatttcttttgtaacatgctaattttaaatcttggatctattaatatttgtcttttggcaagc

SEQ ID NO: 456360 - DNA, 1673 bp, Homo sapiens
cccggagttgttgcacagttgtttccgggaagcgggactccaaatgggtcgcagtcgcagccgctctccacggagggaacgtaggcgttcccggtccacatcccgggagagagaacgcaggcgccgagaaaggtccaggtctcgggagagagatcggagaaggagccgctcgcgatccccgcaccgaagacgctcccgatctccaagacgacatagatccacatctccttccccttctcgactgaaagaaagaagagatgaggaaaagaaagaaacaaaagaaacaaagagcaaagaacggcagattactgaggaagacttagagggcaaaacagaggaagaaatagaaatgatgaagttaatgggatttgcctcctttgactccacaaaaggtaagaaggtggatggctctgtaaatgcctatgccataaatgtctctcagaagaggaagtacaggcagtacatgaatcgaaaaggtggattcaacagacctttggatttcattgcatgagaattgaagtgttgaaggatgattttttttcccctcatcttggtcagagagtggatttgtattttgtatttaacttgcattcaaaaaacaggatctcagttctcctttcttgtaaagtaagaaaatcttatttatgatatatgcagttaacttaccttgcctcaacagaagaaaggttaaatattacatttttttcttttaggaaatatcatttgtggcaggaccccattttatttgtccttattcctgtggaagcagtatatgttttcttcctgaatgctcattaggacttcttaaaaaacatgaaagtaatttggaagtaagtttatccaataaagcagtatttctacccttttagatttgataaatatttttattactaaagaatgcccccccccaaaaaaataccatttatggttctctccgcaagtataaaagcattacatgcaaaaaaaagatctcagagaaaacaaaagtaaaagaaaagcagaaaatcacctgttatctactcccagaaataatcaatttcaacattttggtatatgtttttccaggcttctttgggttgatcccacctatgagatcagaatatgtatgcagttctttctttaacccttttttctcctatgtactgtgaacatttaaaaagtacttttaaatattctttggaaacttagcttttagtaactacttggttgtatcataatttattaactaatgttttattggtaaacattggcttgcctcccatgacttgccattataattaaaactgtgactactatctgtctccattacatacatatttttgtatgtttccattatttcctcagggtccgtacttagacgtggcattgctgagtgagattaaaagggccatgtatacatgttttaagacatttggtatctctggctaaaaggtaacagccaactctatccagtaaagtatgagcattcttgtttcagatacatgtacaaatattaagtgtaaaatttgttttaaagtttcctacctgatgggtaaaataatggtactatttggttttgtatttttgtttcatttctagggaggatgaatattttttaaatgtattagccatatttcttttgtaacatgctaattttaaatcttggatctattaatatttgtcttttggcaagc

SEQ ID NO: 456361 - DNA, 1846 bp, Homo sapiens
cccggagttgttgcacagttgtttccgggaagcgggactccaaatgggtcgcagtcgcagccgctctccacggagggaacgtaggcgttcccggtccacatcccgggagagagaacgcaggcgccgagaaaggtccaggtctcgggagagagatcggagaaggagccgctcgcgatccccgcaccgaagacgctcccgatctccaagacgacatagatccacatctccttccccttctcgactgaaagaaagaagagatgaggaaaagaaagaaacaaaagaaacaaagagcaaagaacggcagattactgaggaagacttagagggcaaaacagaggaagaaatagaaatgatgaagttaatgggatttgcctcctttgactccacaaaaggtaagaaggtggatggctctgtaaatgcctatgccataaatgtctctcagaagaggaagtacagcagtacatgaatcgaaaaggtggattcaacagacctttggatttcattggcatggcagtacatgaatcgaaaaggtggattcaacagacctttggatttcattgcatgagaattgaagtgttgaaggatgattttttttcccctcatcttggtcagagagtggatttgtattttgtatttaacttgcattcaaaaaacaggatctcagttctcctttcttgtaaagtaagaaaatcttatttatgatatatgcagttaacttaccttgcctcaacagaagaaaggttaaatattacatttttttcttttaggaaatatcatttgtggcaggaccccattttatttgtccttattcctgtggaagcagtatatgttttcttcctgaatgctcattaggacttcttaaaaaacatgaaagtaatttggaagtaagtttatccaataaagcagtatttctacccttttagatttgataaatatttttattactaaagaatctccccagacattttcttttttttttcacacatagatttaagtatcttgattgttagtagtctaaaaatgggaagaatgaaaaagcataactagatttttctatcttctgtggtcgcccgcccccccccaaaaaaataccatttatggttctctccgcaagtataaaagcattacatgcaaaaaaaagatctcagagaaaacaaaagtaaaagaaaagcagaaaatcacctgttatctactcccagaaataatcaatttcaacattttggtatatgtttttccaggcttctttgggttgatcccacctatgagatcagaatatgtatgcagttctttctttaacccttttttctcctatgtactgtgaacatttaaaaagtacttttaaatattctttggaaacttagcttttagtaactacttggttgtatcataatttattaactaatgttttattggtaaacattggcttgcctcccatgacttgccattataattaaaactgtgactactatctgtctccattacatacatatttttgtatgtttccattatttcctcagggtccgtacttagacgtggcattgctgagtgagattaaaagggccatgtatacatgttttaagacatttggtatctctggctaaaaggtaacagccaactctatccagtaaagtatgagcattcttgtttcagatacatgtacaaatattaagtgtaaaatttgttttaaagtttcctacctgatgggtaaaataatggtactatttggttttgtatttttgtttcatttctagggaggatgaatattttttaaatgtattagccatatttcttttgtaacatgctaattttaaatcttggatctattaatatttgtcttttggcaagc

SEQ ID NO: 456362 - DNA, 1727 bp, Homo sapiens
cccggagttgttgcacagttgtttccgggaagcgggactccaaatgggtcgcagtcgcagccgctctccacggagggaacgtaggcgttcccggtccacatcccgggagagagaacgcaggcgccgagaaaggtccaggtctcgggagagagatcggagaaggagccgctcgcgatccccgcaccgaagacgctcccgatctccaagacgacatagatccacatctccttccccttctcgactgaaagaaagaagagatgaggaaaagaaagaaacaaaagaaacaaagagcaaagaacggcagattactgaggaagacttagagggcaaaacagaggaagaaatagaaatgatgaagttaatgggatttgcctcctttgactccacaaaagcagtacatgaatcgaaaaggtggattcaacagacctttggatttcattgcatgagaattgaagtgttgaaggatgattttttttcccctcatcttggtcagagagtggatttgtattttgtatttaacttgcattcaaaaaacaggatctcagttctcctttcttgtaaagtaagaaaatcttatttatgatatatgcagttaacttaccttgcctcaacagaagaaaggttaaatattacatttttttcttttaggaaatatcatttgtggcaggaccccattttatttgtccttattcctgtggaagcagtatatgttttcttcctgaatgctcattaggacttcttaaaaaacatgaaagtaatttggaagtaagtttatccaataaagcagtatttctacccttttagatttgataaatatttttattactaaagaatctccccagacattttcttttttttttcacacatagatttaagtatcttgattgttagtagtctaaaaatgggaagaatgaaaaagcataactagatttttctatcttctgtggtcgcccgcccccccccaaaaaaataccatttatggttctctccgcaagtataaaagcattacatgcaaaaaaaagatctcagagaaaacaaaagtaaaagaaaagcagaaaatcacctgttatctactcccagaaataatcaatttcaacattttggtatatgtttttccaggcttctttgggttgatcccacctatgagatcagaatatgtatgcagttctttctttaacccttttttctcctatgtactgtgaacatttaaaaagtacttttaaatattctttggaaacttagcttttagtaactacttggttgtatcataatttattaactaatgttttattggtaaacattggcttgcctcccatgacttgccattataattaaaactgtgactactatctgtctccattacatacatatttttgtatgtttccattatttcctcagggtccgtacttagacgtggcattgctgagtgagattaaaagggccatgtatacatgttttaagacatttggtatctctggctaaaaggtaacagccaactctatccagtaaagtatgagcattcttgtttcagatacatgtacaaatattaagtgtaaaatttgttttaaagtttcctacctgatgggtaaaataatggtactatttggttttgtatttttgtttcatttctagggaggatgaatattttttaaatgtattagccatatttcttttgtaacatgctaattttaaatcttggatctattaatatttgtcttttggcaagc

SEQ ID NO: 456363 - DNA, 3519 bp, Homo sapiens
aggcggagttgcgaatcctgtcaccagttggaaagagggggtggagcccgggccttgtcaagtgtgaccaaccagcgagaggagcggactttgcggggtggagccctgaagccctctcccaatcgcacaagtgtaggggcggggcattctttggggggcccaatgaggaacgcggccgaagctggcctgtcaagagaaggggctgggggcggggagatggtgagtcggggataaacactccgcggcggtggcggctgctgctctgctccgggttctgtcactgtgtcggcggtgcccagctcactggccccctccctctcttgtcgagcgtggttgccagagaggctccctcagccctgctccgcggggtccacagcgggctccacagcgggctccatagcgggctccacagcggtccggcggcggcagcgagcccgtgggcagtgggggttggtcccgtggctccggcccccggtgcagaatggcggcggcggttcggatgaacatccagatgctgctggaggcggccgactatctggagcggcgggagagagaagctgaacatggttatgcctccatgttaccatacaataacaaggacagagatgccttaaaacggaggaacaaatccaaaaagaataacagcagtagcagatcaactcacaatgaaatggagaagaatagacgggctcatcttcgcttgtgcctggagaagttgaaggggctggtgccactgggacccgaatcaagtcgacacactacgttgagtttattaacaaaagccaaattgcacataaagaaacttgaagattgtgacagaaaagccgttcaccaaatcgaccagcttcagcgagagcagcgacacctgaagaggcagctggagaagctgggcattgagaggatccggatggacagcatcggctccaccgtctcctcggagcgctccgactccgacagggaagaaatcgacgttgacgtggagagcacggactatctcacaggtgatctggactggagcagcagcagtgtgagcgactctgacgagcggggcagcatgcagagcctcggcagtgatgagggctattccagcaccagcatcaagagaataaagctgcaggacagtcacaaggcgtgtcttggtctctaagagagtgggcactgcggctgtctccttgaaggttctccctgttggttctgattaggtaacgtattggacctgcccacaactcccttgcacgtaaacttcagtgtcccaccttgaccaaaatcagctttgtaactgttttcaaggaggtgcttaggattgtgggtttctgattgcatccactagcttctctttttctcgccataaaaatttgtctctgagagactatacattccaatcaatttgaagcatccaagaattcttagaccgaataagcaatgtccacatctcagcaatccccctctttgctctcctcgtgtcctctcccagacctttcttccagttttctggcttactgtgttacttgcctaggaggaatgtccaagtgtgtcttgtacttaggaaactgaaggaaacaaacttttgaaattgagatcctgatctcagaactccaaagtaagctttgaaagcagcatttaagagcacttaaccatggacctcaccaccagtgaggaagtcaggaatacctctagaaaacacgcccttcacaccgcgcatgctcattcccccgacgcgccgcgtgtggatgggagcagtatttctcactttaaaatggacaccttgatagtgtgtctctggggttgcacagctcatcaaagttccaaattgtttgttctcacaaacaaaacggtacaatctatttttgtgcgatgttcttgggacctcgctgtgttctgctatctcgaggcacattctcccctccaactttgttaatgctacttgtctctggaacatttttttttcctacctcagagataaatgagatctccatttcccacttaacacagtgattatccttttttccccccccaaaatagtgacatttggtccaattataatctattttcctattgaactttcagcaataactgagctgtggcactagcagagctagtagccattatcagtgaaagaaaaagtccacatttctactctctgttgcaggtgaacaggagaggatggtacactgttactagaactcctctccttattgattatttttggacacacccagaaacttctttatggaggcttttgggttgatagtttaaaaggctgatttttctttttggttatgatttctcccttaagtggtctccgactttgtagcatttttatttaagctaaaacagagcacatgtatatgtacataagacacattaaatctataaatactatttattcattttatataaactaatgtaatggaaaacaaattcttatgactttgtggttttatagatgttctagaaactttgtatgtaggtatctacaaaattagttcattcccctgaatatttttgcattcatatttttgaggtcttgatgttttcagcctctggcgaatctttttcattgaatttgaaccatttgtaaaatctgtgatgctgaagcagagtgtgtcacaaagtgatgagaacattactaaaatccacggacgcactgcgacctaagggctcaacggctgactcggcagcgggcagccaccccacgctcccctgcggtcactcgcacaccacagcctgaagctcccccagcgcctgcacctcgcacacagctaaggtcaaagttcaaacgcactccacacggaagctcattctatacccgaagagcagtctcagaaagcaagattacttttgtgttttttaaaaaatgattctttaatgtatttttctaaacattctgattggaagtagtggattcctaaatgattccaaagtcacctgtaattcttctgtttttgttttgttctgtcttttcttcattttggctttgggtggggggaggggcaggtgacacaaaggattttttttttttttttaatttttggaatcttttccaataaccagctaaagatttgcactgaaatacaacttgtatgccttttgcatttttaaagcctgcttcctggatttaagcagagtgatagtgttcaaagagccagttcagcctgtaacatatttgaaaaagatatgtctgcactttgaggtcccttttgaatgccattcactagacctctcaagcattttgtttcattgctacatccaagcgcctcacaagtccacaatgcgggacagcatcaaaagctcaagactttggaaaaagcttgtgggcttgcactgggggagggaagggaacaaaatttgtgtacttctttgtttaatttagaaataaggcatccaagagatgccattattttctgtgtttcaattgttgtgcctttgagttaaactgcatttttgtcttttggttgaaatctgaaatgtactgtcccaatataaaacagtaattatttgaccttcagcactgtttgt

SEQ ID NO: 456364 - DNA, 1647 bp, Homo sapiens
cccggagttgttgcacagttgtttccgggaagcgggactccaaatgggtcgcagtcgcagccgctctccacggagggaacgtaggcgttcccggtccacatcccgggagagagaacgcaggcgccgagaaaggtccaggtctcgggagagagatcggagaaggagccgctcgcgatccccgcaccgaagacgctcccgatctccaagacgacatagatccacatctccttccccttctcgactgaaagaaagaagagatgaggaaaagaaagaaacaaaagaaacaaagagcaaagaacggcagattactgaggaagacttagagggcaaaacagaggaagaaatagaaatgatgaagttaatgggatttgcctcctttgactccacaaaaggtaagaaggtggatggctctgtaaatgcctatgccataaatgtctctcagaagaggaagtacaggcagtacatgaatcgaaaaggtggattcaacagacctttggatttcattgcatgagaattgaagtgttgaaggatgattttttttcccctcatcttggtcagagagtggatttgtattttgtatttaacttgcattcaaaaaacaggatctcagttctcctttcttgtaaagtaagctgaacatggttatgcctccatgttaccatacaataacaaggacagagatgccttaaaacggaggaacaaatccaaaaagaataacagcagtagcagatcaactcacaatgaaatggagaagaatagacgggctcatcttcgcttgtgcctggagaagttgaaggggctggtgccactgggacccgaatcaagtcgacacactacgttgagtttattaacaaaagccaaattgcacataaagaaacttgaagattgtgacagaaaagccgttcaccaaatcgaccagcttcagcgagagcagcgacacctgaagaggcagctggagaagctgggcattgagaggatccggatggacagcatcggctccaccgtctcctcggagcgctccgactccgacagggaagaaatcgacgttgacgtggagagcacggactatctcacaggtgatctggactggagcagcagcagtgtgagcgactctgacgagcggggcagcatgcagagcctcggcagtgatgagggctattccagcaccagcatcaagagaataaagctgcaggacagtcacaaggcgtgtcttggtctctaagagagtgggcactgcggctgtctccttgaaggttctccctgttggttctgattaggtaacgtattggacctgcccacaactcccttgcacgtaaacttcagtgtcccaccttgaccaaaatcagctttgtaactgttttcaaggaggtgcttaggattgtgggtttctgattgcatccactagcttctctttttctcgccataaaaatttgtctctgagagactatacattccaatcaatttgaagcatccaagaattcttagaccgaataagcaatgtccacatctcagcaatccccctctttgctctcctcgtgtcctctcccagtgacgttcctcatcccagtgacgttcctcatcccagtgacgttcctcatcccagtgacgttcctcatcccagtgacgttcctcatcccgggtaccgag

SEQ ID NO: 456365 - DNA, 618 bp, Homo sapiens
cccggagttgttgcacagttgtttccgggaagcgggactccaaatgggtcgcagtcgcagccgctctccacggagggaacgtaggcgttcccggtccacatcccgggagagagaacgcaggcgccgagaaaggtccaggtctcgggagagagatcggagaaggagccgctcgcgatccccgcaccgaagacgctcccgatctccaagacgacatagatccacatctccttccccttctcgactgaaagaaagaagagatgaggaaaagaaagaaacaaaagaaacaaagagcaaagaacggcagattactgaggaagacttagagggcaaaacagaggaagaaatagaaatgatgaagttaatgggatttgcctcctttgactccacaaaaggtaagaaggtggatggctctgtaaatgcctatgccataaatgtctctcagaagaggaagtacaggtatgcatagcccccattattatgtttgaactaataaatcagttttttacttcaaactttattatgagataatcatgtttgtaggaaatgtagcagttttccatactgttccttgtttgaatgaaatattcattgcttatattctggtgtgttaaaattgtt

SEQ ID NO: 456366 - DNA, 228 bp, Homo sapiens
gcggccgcctactactactactgctcgaattcaagcttctaacgatgtacggggacatgtatcctttcacacatttgccttgacaaacttctttcactcacatctttttcactgactttttttgtggggggcggggccggggggactctggtatctaattctttaatgattcctataaatctaatgacattcaataaagttgagcaaacattttacttaaaaaaaaaa

SEQ ID NO: 456367 - DNA, 1223 bp, Homo sapiens
ttcggcacttgggagaagatgtttgaaaaaactgactctgctaatgagcctggactcagagctcaagtctgaactctacctccagacagaatgaagttcatctcgacatctctgcttctcatgctgctggtcagcagcctctctccagtccaaggtgttctggaggtctattacacaagcttgaggtgtagatgtgtccaagagagctcagtctttatccctagacgcttcattgatcgaattcaaatcttgccccgtgggaatggttgtccaagaaaagaaatcatagtctggaagaagaacaagtcaattgtgtgtgtggaccctcaagctgaatggatacaaagaatgatggaagtattgagaaaaagaagttcttcaactctaccagttccagtgtttaagagaaagattccctgatgctgatatttccactaagaacacctgcattcttcccttatccctgctctggattttagttttgtgcttagttaaatcttttccaggaaaaagaacttccccatacaaataagcatgagactatgtaaaaataaccttgcagaagctgatggggcaaactcaagcttcttcactcacagcaccctatatacacttggagtttgcattcttattcatcagggaggaaagtttctttgaaaatagttattcagttataagtaatacaggattattttgattatatacttgttgtttaatgtttaaaatttcttagaaaacaatggaatgagaatttaagcctcaaatttgaacatgtggcttgaattaagaagaaaattatggcatatattaaaagcaggcttctatgaaagactcaaaaagctgcctgggaggcagatggaacttgagcctgtcaagaggcaaaggaatccatgtagtagatatcctctgcttaaaaactcactacggaggagaattaagtcctacttttaaagaatttctttataaaatttactgtctaagattaatagcattcgaagatccccagacttcatagaatactcagggaaagcatttaaagggtgatgtacacatgtatcctttcacacatttgccttgacaaacttctttcactcacatctttttcactgactttttttgtggggggcggggccggggggactctggtatctaattctttaatgattcctataaatctaatgacattcaataaagttgagcaaacattttacttaaaaaaaaaa

SEQ ID NO: 456368 - DNA, 1623 bp, Homo sapiens
cagcttattttgttctcccgattgcagtgcaacagataagcacattttaaagatattgtgatataactttagaagtgagccaatcttggagtaagttatttggttgttctccaatgcacgtaaatgttatcaacaaaacactaacctctgacatgtgaggccctcgcagctttggattcaaccccaccagctcacacatactgttccacaaatggttgttctcttattcctctgaccccatactacaaatcacctattccagatcccaaactgcccagctccaatttcacttcatctaggaataattattttcataccaaactcttttctttattaaaagtataggattgactaaaaagtaagactgaattatttaatttttattttcccccagagtctggaagaagaacaagtcaattgtgtgtgtggaccctcaagctgaatggatacaaagaatgatggaagtattgagaaagtaagttaggcataacaaggggtttcagattccaacttgtactgaagagtttccctttcctgggcagtcaaaatagggactagcttgaatttatgagaagttcctaagacaaatgtgtgtttttcactgttattgcttatcagatggagtaggggtagctcattccagcagctcagtaaaccaaactagatgccagtatacataagagtccttgcccggtatctccagaggaaagccacagtttcttgtgtttctctaaacatgacaattttgtttttgtttctgcttcacagaagaagttcttcaactctaccagttccagtgtttaagagaaagattccctgatgctgatatttccactaagaacacctgcattcttcccttatccctgctctggattttagttttgtgcttagttaaatcttttccaggaaaaagaacttccccatacaaataagcatgagactatgtaaaaataaccttgcagaagctgatggggcaaactcaagcttcttcactcacagcaccctatatacacttggagtttgcattcttattcatcagggaggaaagtttctttgaaaatagttattcagttataagtaatacaggattattttgattatatacttgttgtttaatgtttaaaatttcttagaaaacaatggaatgagaatttaagcctcaaatttgaacatgtggcttgaattaagaagaaaattatggcatatattaaaagcaggcttctatgaaagactcaaaaagctgcctgggaggcagatggaacttgagcctgtcaagaggcaaaggaatccatgtagtagatatcctctgcttaaaaactcactacggaggagaattaagtcctacttttaaagaatttctttataaaatttactgtctaagattaatagcattcgaagatccccagacttcatagaatactcagggaaagcatttaaagggtgatgtacacatgtatcctttcacacatttgccttgacaaacttctttcactcacatctttttcactgactttttttgtggggggcggggccggggggactctggtatctaattctttaatgattcctataaatctaatgacattcaataaagttgagcaaacattttacttaaaaaaaaaa

SEQ ID NO: 456369 - DNA, 1175 bp, Homo sapiens
ttcggcacttgggagaagatgtttgaaaaaactgactctgctaatgagcctggactcagagctcaagtctgaactctacctccagacagaatgaagttcatctcgacatctctgcttctcatgctgctggtcagcagcctctctccagtccaaggtgttctggaggtctattacacaagcttgaggtgtagatgtgtccaagagagctcagtctttatccctagacgcttcattgatcgaattcaaatcttgccccgtgggaatggttgtccaagaaaagaaatcatagtctggaagaagaacaagtcaattgtgtgtgtggaccctcaagctgaatggatacaaagaatgatggaagtattgagaaaaagaagttcttcaactctaccagttccagtgtttaagagaaagattccctgatgctgatatttccactaagaacacctgcattcttcccttatccctgctctggattttagttttgtgcttagttaaatcttttccaggaaaaagaacttccccatacaaataagcatgagactatgtaaaaataaccttgcagaagctgatggggcaaactcaagcttcttcactcacagcaccctatatacacttggagtttgcattcttattcatcagggaggaaagtttctttgaaaatagttattcagttataagtaatacaggattattttgattatatacttgttgtttaatgtttaaaatttcttagaaaacaatggaatgagaatttaagcctcaaatttgaacatgtggcttgaattaagaagaaaattatggcatatattaaaagcaggcttctatgaaagactcaaaaagctgcctgggaggcagatggaacttgagcctgtcaagaggcaaaggaatccatgtagtagatatcctctgcttaaaaactcactacggaggagaattaagtcctacttttaaagaatttctttataaaatttactgtctaagattaatagcattcgaagatccccagacttcatagaatactcagggaaagcatttaaagggtgatgtacacatgtatcctttcacacatttgccttgacaaacttctttcactcacatctttttcactgacttttttagatggaaagctgtgctcgacggtatatatacagtactcaaggtgcttaaataggtat

SEQ ID NO: 456370 - DNA, 724 bp, Homo sapiens
ttcggcacttgggagaagatgtttgaaaaaactgactctgctaatgagcctggactcagagctcaagtctgaactctacctccagacagaatgaagttcatctcgacatctctgcttctcatgctgctggtcagcagcctctctccagtccaaggtgttctggaggtctattacacaagcttgaggtgtagatgtgtccaagagagctcagtctttatccctagacgcttcattgatcgaattcaaatcttgccccgtgggaatggttgtccaagaaaagaaatcatagtctggaagaagaacaagtcaattgtgtgtgtggaccctcaagctgaatggatacaaagaatgatggaagtattgagaaaaagaagttcttcaactctaccagttccagtgtttaagagaaagattccctgatgctgatatttccactaagaacacctgcattcttcccttatccctgctctggattttagttttgtgcttagttaaatcttttccaggaaaaagaacttccccatacaaataagcatgagactatgtaaaaataaccttgcagaagctgatggggcaaactcaagcttcttcactcacatctttttcactgactttttttgtggggggcggggccggggggactctggtatctaattctttaatgattcctataaatctaatgacattcaataaagttgagcaaacattttacttaaaaaaaaaa

SEQ ID NO: 456371 - DNA, 507 bp, Homo sapiens
tgcatgagtaaacatccttctaataatgaacagaccaataatgtcttaagagagaaaaagaacaatcttttcctttttgctgtttctggagagagctgtttgaatttggaaacccatgttggctgtcccaaatatgagatttggcatctttcttttgtggtggggatgggttttggccactgaaagcagaatgcactggcccggaagagaagtccacgagatgtctaagaaaggcagatgaaatagtcagcaaggtgaagtgtaacttatcagatgctcggccattagctgaatgagccttccagcagacctccctcatcacaaacccccatccgtgctccagctcacctccaagaaagttctgacacctcttttgggaaaacatccatgcacagactaagaactagaacaagcagacatcaagaagaagtcttgtaggttggaatttgtcatttgatccaaaataaaagtgggtgttcaacaaatgtacaccctatgttcagttca

SEQ ID NO: 456372 - DNA, 2822 bp, Homo sapiens
tgcatgagtaaacatccttctaataatgaacagaccaataatgtcttaagagagaaaaagaacaatcttttcctttttgctgtttctggagagagctgtttgaatttggaaacccatgttggctgtcccaaatatgagatttggcatctttcttttgtggtggggatgggttttggccactgaaagcagaatgcactggcccggaagagaagtccacgagatgtctaagaaaggcaggccccaaagacaaagacgagaagtacatgaagatgcccacaagcaagtcagcccaattctgagacgaagtcctgacatcaccaaatcgcctctgacaaagtcagaacagcttctgaggatagatgaccatgatttcagcatgaggcctggctttggaggccctgccattcctgttggtgtggatgtgcaggtggagagtttggatagcatctcagaggttgacatggactttacgatgaccctctacctgaggcactactggaaggacgagaggctgtcttttccaagcaccaacaacctcagcatgacgtttgatggccggctggtcaagaagatctgggtccctgacatgtttttcgtgcactccaaacgctccttcatccacgacaccaccacagacaacgtcatgttgcgggtccagcctgatgggaaagtgctctatagtctcagggttacagtaactgcaatgtgcaacatggacttcagccgatttcccttggacacacaaacgtgctctcttgaaattgaaagctatgcctatacagaagatgacctcatgctgtactggaaaaagggcaatgactccttaaagacagatgaacggatctcactctcccagttcctcattcaggaattccacaccaccaccaaactggctttctacagcagcacaggctggtacaaccgtctctacattaatttcacgttgcgtcgccacatcttcttcttcttgctccaaacttatttccccgctaccctgatggtcatgctgtcctgggtgtccttctggatcgaccgcagagccgtgcctgccagagtccccttaggtatcacaacggtgctgaccatgtccaccatcatcacgggcgtgaatgcctccatgccgcgcgtctcctacatcaaggccgtggacatctacctctgggtcagctttgtgttcgtgttcctctcggtgctggagtatgcggccgtcaactacctgaccactgtgcaggagaggaaggaacagaagctgcgggagaagcttccctgcaccagcggattacctccgccccgcactgcaatgctggacggcaactacagtgatggggaggtgaatgacctggacaactacatgccagagaatggagagaagcccgacaggatgatggtgcagctgaccctggcctcagagaggagctccccacagaggaaaagtcagagaagcagctatgtgagcatgagaatcgacacccacgccattgataaatactccaggatcatctttccagcagcatacattttattcaatttaatatactggtctattttctcctagatgcttgtaattctacaaatttcacatttccatggcatgcactacagaaataactgtataatgaaaaagtatttaaggatatggttaaaaaaaaatcccaggacccacccatgttttcactatcccttctgcagctttccaaagctacattgacgagacacttactggtttaatttgcacttattaaccatctattgaatacacagcattatattaggtgctgcaggaaatacgacactgtagcgactgatgttagttgttacccagatcccctggaaaagcacactaccagtgttgtgggcacatttagttccacccgttagacccttgatgctattcacatgaataatttattttcctcaagtgtcattacattgttcaggctacgtgaacttggaagcacctacaggccatttgcatgaaattcacatgcacctaaatcctcactttgacagaaactcatgcttcagtttataacctattacctattttgtatgcgactccacctccgcatgtttattttaataaaaggcaatgataacattcacattatttttctttatatgctgtggttcacaggctttaccccttcacaagaaaagctctttagattggcgcaattgcttctgattttggtgaaattttccctggtagggaaactttgaagataagagtacacacatgcattttgtctgttgtgtcatagaggtaactaggctagaaaatttgtgtttaaatgttccctattttatataatcaccacttcatgtttcttcttcttggagcatgtccttgttcaaagagaagtgctttctcagtgatgtgatatcttcactgaggaacttgggtagagaatgatttcttctgcataaacacttcaaggaaatacataatttgggactacttgtaactcattagaatgagaaatactcacatggtttcttaagagaaaaagaacatcggaaagcaaaataaatgggaagatatcactggacatctgcatttatactcgaaataccagcattttctatggaccagaaaactgccatcacctagaccacacagcccagataccaggcagacggatggcccaatggcaactgatgtcagggcatggggtaaaggagagggttctaatctggtgtatcacttaaaaacagttatttatattatatatctgctatatagatcaacctccaccaaacttacccaaacagcatttgttttatttgaaactcactttaataaagtgaattatatacacaaa

SEQ ID NO: 456373 - DNA, 2921 bp, Homo sapiens
tgcatgagtaaacatccttctaataatgaacagaccaataatgtcttaagagagaaaaagaacaatcttttcctttttgctgtttctggagagagctgtttgaatttggaaacccatgttggctgtcccaaatatgagatttggcatctttcttttgtggtggggatgggttttggccactgaaagcagaatgcactggcccggaagagaagtccacgagatgtctaagaaaggcagaatcgaggcttcatgaaggcaaaggcagtggcatctcagaatttgacaaacctcctttcatcagtgactggttccatttcaggctggcccaaagtcaaagccccaaagacaaagacgagaagtacatgaagatgcccacaagcaagtcagcccaattctgagacgaagtcctgacatcaccaaatcgcctctgacaaagtcagaacagcttctgaggatagatgaccatgatttcagcatgaggcctggctttggaggccctgccattcctgttggtgtggatgtgcaggtggagagtttggatagcatctcagaggttgacatggactttacgatgaccctctacctgaggcactactggaaggacgagaggctgtcttttccaagcaccaacaacctcagcatgacgtttgatggccggctggtcaagaagatctgggtccctgacatgtttttcgtgcactccaaacgctccttcatccacgacaccaccacagacaacgtcatgttgcgggtccagcctgatgggaaagtgctctatagtctcagggttacagtaactgcaatgtgcaacatggacttcagccgatttcccttggacacacaaacgtgctctcttgaaattgaaagctatgcctatacagaagatgacctcatgctgtactggaaaaagggcaatgactccttaaagacagatgaacggatctcactctcccagttcctcattcaggaattccacaccaccaccaaactggctttctacagcagcacaggctggtacaaccgtctctacattaatttcacgttgcgtcgccacatcttcttcttcttgctccaaacttatttccccgctaccctgatggtcatgctgtcctgggtgtccttctggatcgaccgcagagccgtgcctgccagagtccccttaggtatcacaacggtgctgaccatgtccaccatcatcacgggcgtgaatgcctccatgccgcgcgtctcctacatcaaggccgtggacatctacctctgggtcagctttgtgttcgtgttcctctcggtgctggagtatgcggccgtcaactacctgaccactgtgcaggagaggaaggaacagaagctgcgggagaagcttccctgcaccagcggattacctccgccccgcactgcaatgctggacggcaactacagtgatggggaggtgaatgacctggacaactacatgccagagaatggagagaagcccgacaggatgatggtgcagctgaccctggcctcagagaggagctccccacagaggaaaagtcagagaagcagctatgtgagcatgagaatcgacacccacgccattgataaatactccaggatcatctttccagcagcatacattttattcaatttaatatactggtctattttctcctagatgcttgtaattctacaaatttcacatttccatggcatgcactacagaaataactgtataatgaaaaagtatttaaggatatggttaaaaaaaaatcccaggacccacccatgttttcactatcccttctgcagctttccaaagctacattgacgagacacttactggtttaatttgcacttattaaccatctattgaatacacagcattatattaggtgctgcaggaaatacgacactgtagcgactgatgttagttgttacccagatcccctggaaaagcacactaccagtgttgtgggcacatttagttccacccgttagacccttgatgctattcacatgaataatttattttcctcaagtgtcattacattgttcaggctacgtgaacttggaagcacctacaggccatttgcatgaaattcacatgcacctaaatcctcactttgacagaaactcatgcttcagtttataacctattacctattttgtatgcgactccacctccgcatgtttattttaataaaaggcaatgataacattcacattatttttctttatatgctgtggttcacaggctttaccccttcacaagaaaagctctttagattggcgcaattgcttctgattttggtgaaattttccctggtagggaaactttgaagataagagtacacacatgcattttgtctgttgtgtcatagaggtaactaggctagaaaatttgtgtttaaatgttccctattttatataatcaccacttcatgtttcttcttcttggagcatgtccttgttcaaagagaagtgctttctcagtgatgtgatatcttcactgaggaacttgggtagagaatgatttcttctgcataaacacttcaaggaaatacataatttgggactacttgtaactcattagaatgagaaatactcacatggtttcttaagagaaaaagaacatcggaaagcaaaataaatgggaagatatcactggacatctgcatttatactcgaaataccagcattttctatggaccagaaaactgccatcacctagaccacacagcccagataccaggcagacggatggcccaatggcaactgatgtcagggcatggggtaaaggagagggttctaatctggtgtatcacttaaaaacagttatttatattatatatctgctatatagatcaacctccaccaaacttacccaaacagcatttgttttatttgaaactcactttaataaagtgaattatatacacaaa

SEQ ID NO: 456374 - DNA, 2771 bp, Homo sapiens
tgcatgagtaaacatccttctaataatgaacagaccaataatgtcttaagagagaaaaagaacaatcttttcctttttgctgtttctggagagagctgtttgaatttggaaacccatgttggctgtcccaaatatgagatttggcatctttcttttgtggtggggatgggttttggccactgaaagcagaatgcactggcccggaagagaagtccacgagatgtctaagaaaggcagcccaattctgagacgaagtcctgacatcaccaaatcgcctctgacaaagtcagaacagcttctgaggatagatgaccatgatttcagcatgaggcctggctttggaggccctgccattcctgttggtgtggatgtgcaggtggagagtttggatagcatctcagaggttgacatggactttacgatgaccctctacctgaggcactactggaaggacgagaggctgtcttttccaagcaccaacaacctcagcatgacgtttgatggccggctggtcaagaagatctgggtccctgacatgtttttcgtgcactccaaacgctccttcatccacgacaccaccacagacaacgtcatgttgcgggtccagcctgatgggaaagtgctctatagtctcagggttacagtaactgcaatgtgcaacatggacttcagccgatttcccttggacacacaaacgtgctctcttgaaattgaaagctatgcctatacagaagatgacctcatgctgtactggaaaaagggcaatgactccttaaagacagatgaacggatctcactctcccagttcctcattcaggaattccacaccaccaccaaactggctttctacagcagcacaggctggtacaaccgtctctacattaatttcacgttgcgtcgccacatcttcttcttcttgctccaaacttatttccccgctaccctgatggtcatgctgtcctgggtgtccttctggatcgaccgcagagccgtgcctgccagagtccccttaggtatcacaacggtgctgaccatgtccaccatcatcacgggcgtgaatgcctccatgccgcgcgtctcctacatcaaggccgtggacatctacctctgggtcagctttgtgttcgtgttcctctcggtgctggagtatgcggccgtcaactacctgaccactgtgcaggagaggaaggaacagaagctgcgggagaagcttccctgcaccagcggattacctccgccccgcactgcaatgctggacggcaactacagtgatggggaggtgaatgacctggacaactacatgccagagaatggagagaagcccgacaggatgatggtgcagctgaccctggcctcagagaggagctccccacagaggaaaagtcagagaagcagctatgtgagcatgagaatcgacacccacgccattgataaatactccaggatcatctttccagcagcatacattttattcaatttaatatactggtctattttctcctagatgcttgtaattctacaaatttcacatttccatggcatgcactacagaaataactgtataatgaaaaagtatttaaggatatggttaaaaaaaaatcccaggacccacccatgttttcactatcccttctgcagctttccaaagctacattgacgagacacttactggtttaatttgcacttattaaccatctattgaatacacagcattatattaggtgctgcaggaaatacgacactgtagcgactgatgttagttgttacccagatcccctggaaaagcacactaccagtgttgtgggcacatttagttccacccgttagacccttgatgctattcacatgaataatttattttcctcaagtgtcattacattgttcaggctacgtgaacttggaagcacctacaggccatttgcatgaaattcacatgcacctaaatcctcactttgacagaaactcatgcttcagtttataacctattacctattttgtatgcgactccacctccgcatgtttattttaataaaaggcaatgataacattcacattatttttctttatatgctgtggttcacaggctttaccccttcacaagaaaagctctttagattggcgcaattgcttctgattttggtgaaattttccctggtagggaaactttgaagataagagtacacacatgcattttgtctgttgtgtcatagaggtaactaggctagaaaatttgtgtttaaatgttccctattttatataatcaccacttcatgtttcttcttcttggagcatgtccttgttcaaagagaagtgctttctcagtgatgtgatatcttcactgaggaacttgggtagagaatgatttcttctgcataaacacttcaaggaaatacataatttgggactacttgtaactcattagaatgagaaatactcacatggtttcttaagagaaaaagaacatcggaaagcaaaataaatgggaagatatcactggacatctgcatttatactcgaaataccagcattttctatggaccagaaaactgccatcacctagaccacacagcccagataccaggcagacggatggcccaatggcaactgatgtcagggcatggggtaaaggagagggttctaatctggtgtatcacttaaaaacagttatttatattatatatctgctatatagatcaacctccaccaaacttacccaaacagcatttgttttatttgaaactcactttaataaagtgaattatatacacaaa

SEQ ID NO: 456375 - DNA, 1539 bp, Homo sapiens
tgcatgagtaaacatccttctaataatgaacagaccaataatgtcttaagagagaaaaagaacaatcttttcctttttgctgtttctggagagagctgtttgaatttggaaacccatgttggctgtcccaaatatgagatttggcatctttcttttgtggtggggatgggttttggccactgaaagcagaatgcactggcccggaagagaagtccacgagatgtctaagaaaggcaggccccaaagacaaagacgagaagtacatgaagatgcccacaagcaagtcagcccaattctgagacgaagtcctgacatcaccaaatcgcctctgacaaagtcagaacagcttctgaggatagatgaccatgatttcagcatgaggcctggctttggaggccctgccattcctgttggtgtggatgtgcaggtggagagtttggatagcatctcagaggttgacatggactttacgatgaccctctacctgaggcactactggaaggacgagaggctgtcttttccaagcaccaacaacctcagcatgacgtttgatggccggctggtcaagaagatctgggtccctgacatgtttttcgtgcactccaaacgctccttcatccacgacaccaccacagacaacgtcatgttgcgggtccagcctgatgggaaagtgctctatagtctcagggttacagtaactgcaatgtgcaacatggacttcagccgatttcccttggacacacaaacgtgctctcttgaaattgaaagctatgcctatacagaagatgacctcatgctgtactggaaaaagggcaatgactccttaaagacagatgaacggatctcactctcccagttcctcattcaggaattccacaccaccaccaaactggctttctacagcagcacaggctggtacaaccgtctctacattaatttcacgttgcgtcgccacatcttcttcttcttgctccaaacttatttccccgctaccctgatggtcatgctgtcctgggtgtccttctggatcgaccgcagagccgtgcctgccagagtccccttaggtatcacaacggtgctgaccatgtccaccatcatcacgggcgtgaatgcctccatgccgcgcgtctcctacatcaaggccgtggacatctacctctgggtcagctttgtgttcgtgttcctctcggtgctggagtatgcggccgtcaactacctgaccactgtgcaggagaggaaggaacagaagctgcgggagaagcttccctgcaccagcggattacctccgccccgcactgcaatgctggacggcaactacagtgatggggaggtgaatgacctggacaactacatgccagagaatggagagaagcccgacaggatgatggtgcagctgaccctggcctcagagaggagctccccacagaggaaaagtcagagaagcagctatgtgagcatgagaatttaacccccccgccttggtaaaaaaccccgggtattttttcccagcctccattttttaaaataaaaaaccgggtg

SEQ ID NO: 456376 - DNA, 298 bp, Homo sapiens
cggtagggaatatataacgtggtgataaccgctctgtacaggaagcttgcaaattttctgtacaatgtgctgtgaaaaatctgatgactttaattttaaaatcttgtgacattttgcttatactaaaagttatctatctttagttgaatattttcttttggagagattgtatattttaaaatactgtttagagtttatgagcatatattgcatttaaagaaagataaagcttctgaaatactactgcaattgcttcccttcttaaacagtataataaatgcttagttgtgatatgtta

SEQ ID NO: 456377 - DNA, 884 bp, Homo sapiens
ggtttagtatgataatgtatgtctggaacttaataaagactcaaatgctatttaatatatttttaaagtatagcagttttccatttgtctttctgaaacatttctaacagtttatgttaaaattagcatgtggcccgtaagtacttcactgggtggaatttaaaatgtaattaattaatgactgaatagtaaaatgaagaataatagcacttaatctcagttgtctttcttcagctaatgtcttctatctattaagcaaatatttgagtgtctatactgcccagagttctttaaagttttggagggggctgctagtcacatgtctgtatttaccatcattggacacaaataccaggtcttcttgttaactctttttagagggtttgcaattcatggttaacattatgtttaagcttccttaaaaaacaaaacaaaacaaaaaaaaaacattgtgggacaagtttgggcgtattcatactattcttatttttaacattggagacttaaaattgtaagactataaggaaatatatttactttcttcgtctaacaaataattgtttgtcacttagaaaaagcagagagatcttgctaagatgagaaaatgtctcagaccagaagaactgacaaaccagatgaaccaaatagaaataagcatgcaacatgaacagctggaagagagttttcaggaactagtggaagattaccggcgtgttattgaacgacttgctcaagagtaaagattatactgctctgtacaggaagcttgcaaattttctgtacaatgtgctgtgaaaaatctctgatgactctaatttttttctttggagagatagatatttttactgttagagtgatgagatatattgctttaagaagtgctt

SEQ ID NO: 456378 - DNA, 247 bp, Homo sapiens
gcctactactactaaattcgcggccgctcgtgatgactttaattttaaaatcttgtgacattttgcttatactaaaagttatctatctttagttgaatattttcttttggagagattgtatattttaaaatactgtttagagtttatgagcatatattgcatttaaagaaagataaagcttctgaaatactactgcaattgcttcccttcttaaacagtataataaatgcttagttgtgatatgtta

SEQ ID NO: 456379 - DNA, 1512 bp, Homo sapiens
gagcgcgcgggttgatcgtccttcctcagccgcgggtgatcgtagctcggaaatggcgggatttggtgctatggagaaatttttggtagaatataagagtgcagtggagaagaaactggcagagtacaaatgtaacaccaacacagcaattgaactaaaatttgaaactgcttttggttacaagggtctaaagatcctgttatactatattgctggtagcctgtcaacaatgttccgtgttgaatatgcatctaaagttgatgagaactttgactgtgtagaggcagatgatgttgagggcaaaattagacaaatcattccacctggattttgcacaaacacgaatgatttcctttctttactggaaaaggaagttgatttcaagccattcggaaccttacttcatacctactcagttctcagtccaacaggaggagaaaactttacctttcagatatataaggctgacatgacatgtagaggctttcgagaatatcatgaaaggcttcagacctttttgatgtggtttattgaaactgctagctttattgacgtggatgatgaaagatggcactactttctagtatttgagaagtataataaggatggagctacgctctttgcgaccgtaggctacatgacagtctataattactatgtgtacccagacaaaacccggccacgtgtaagtcagatgctgattttgactccatttcaaggtcaaggccatggtgctcaacttcttgaaacagttcatagatactacactgaatttcctacagttcttgatattacagcggaagatccatccaaaagctatgtgaaattacgagactttgtgcttgtgaagctttgtcaagatttgccctgtttttcccgggaaaaattaatgcaaggattcaatgaagatatggcgatagaggcacaacagaagttcaaaataaataagcaacacgctagaagggtttatgaaattcttcgactactggtaactgacatgagtgatgccgaacaatacagaagctacagactggatattaaaagaagactaattagcccatataagaaaaagcagagagatcttgctaagatgagaaaatgtctcagaccagaagaactgacaaaccagatgaaccaaatagaaataagcatgcaacatgaacagctggaagagagttttcaggaactagtggaagattaccggcgtgttattgaacgacttgctcaagagtaaagattatactgctctgtacaggaagcttgcaaattttctgtacaatgtgctgtgaaaaatctgatgactttaattttaaaatcttgtgacattttgcttatactaaaagttatctatctttagttgaatattttcttttggagagattgtatattttaaaatactgtttagagtttatgagcatatattgcatttaaagaaagataaagcttctgaaatactactgcaattgcttcccttcttaaacagtataataaatgcttagttgtgatatgtta

SEQ ID NO: 456380 - DNA, 1417 bp, Homo sapiens
ggacgcgtgggtcgacccacgcgtccgctttctttcctgagtatacccatcaactctttggggatgatgaaactgcttttggttacaagggtctaaagatcctgttatactatattgctggtagcctgtcaacaatgttccgtgttgaatatgcatctaaagttgatgagaactttgactgtgtagaggcagatgatgttgagggcaaaattagacaaatcattccacctggattttgcacaaacacgaatgatttcctttctttactggaaaaggaagttgatttcaagccattcggaaccttacttcatacctactcagttctcagtccaacaggaggagaaaactttacctttcagatatataaggctgacatgacatgtagaggctttcgagaatatcatgaaaggcttcagacctttttgatgtggtttattgaaactgctagctttattgacgtggatgatgaaagatggcactactttctagtatttgagaagtataataaggatggagctacgctctttgcgaccgtaggctacatgacagtctataattactatgtgtacccagacaaaacccggccacgtgtaagtcagatgctgattttgactccatttcaaggtcaaggccatggtgctcaacttcttgaaacagttcatagatactacactgaatttcctacagttcttgatattacagcggaagatccatccaaaagctatgtgaaattacgagactttgtgcttgtgaagctttgtcaagatttgccctgtttttcccgggaaaaattaatgcaaggattcaatgaagatatggcgatagaggcacaacagaagttcaaaataaataagcaacacgctagaagggtttatgaaattcttcgactactggtaactgacatgagtgatgccgaacaatacagaagctacagactggatattaaaagaagactaattagcccatataagaaaaagcagagagatcttgctaagatgagaaaatgtctcagaccagaagaactgacaaaccagatgaaccaaatagaaataagcatgcaacatgaacagctggaagagagttttcaggaactagtggaagattaccggcgtgttattgaacgacttgctcaagagtaaagattatactgctctgtacaggaagcttgcaaattttctgtacaatgtgctgtgaaaaatctgatgactttaattttaaaatcttgtgacattttgcttatactaaaagttatctatctttagttgaatattttcttttggagagattgtatattttaaaatactgtttagagtttatgagcatatattgcatttaaagaaagataaagcttctgaaatactactgcaattgcttcccttcttaaacagtataataaatgcttagttgtgatatgtta

SEQ ID NO: 456381 - DNA, 1099 bp, Homo sapiens
  misc_feature (39)..(39): n is a, c, g, or t
tcagggctcatatcagtaggggagagtacttggactttnagatatataaggctgacatgacatgtagaggctttcgagaatatcatgaaaggcttcagacctttttgatgtggtttattgaaactgctagctttattgacgtggatgatgaaagatggcactactttctagtatttgagaagtataataaggatggagctacgctctttgcgaccgtaggctacatgacagtctataattactatgtgtacccagacaaaacccggccacgtgtaagtcagatgctgattttgactccatttcaaggtcaaggccatggtgctcaacttcttgaaacagttcatagatactacactgaatttcctacagttcttgatattacagcggaagatccatccaaaagctatgtgaaattacgagactttgtgcttgtgaagctttgtcaagatttgccctgtttttcccgggaaaaattaatgcaaggattcaatgaagatatggcgatagaggcacaacagaagttcaaaataaataagcaacacgctagaagggtttatgaaattcttcgactactggtaactgacatgagtgatgccgaacaatacagaagctacagactggatattaaaagaagactaattagcccatataagaaaaagcagagagatcttgctaagatgagaaaatgtctcagaccagaagaactgacaaaccagatgaaccaaatagaaataagcatgcaacatgaacagctggaagagagttttcaggaactagtggaagattaccggcgtgttattgaacgacttgctcaagagtaaagattatactgctctgtacaggaagcttgcaaattttctgtacaatgtgctgtgaaaaatctgatgactttaattttaaaatcttgtgacattttgcttatactaaaagttatctatctttagttgaatattttcttttggagagattgtatattttaaaatactgtttagagtttatgagcatatattgcatttaaagaaagataaagcttctgaaatactactgcaattgcttcccttcttaaacagtataataaatgcttagttgtgatatgtta

SEQ ID NO: 456382 - DNA, 1133 bp, Homo sapiens
caacagcgaggcagaaacactttaccctttcacgatatactaacggcctgacactgcacactgctacgacgcgccttctccgagcaactactcactgcaacaggccttcagcaacccttctctccgactgctggcttctactctgaacacctgcctacgctttattgacgctggactgatgaaacgatggcactacctttctagctatttgagaagtataataaggatggagctacgctctttgcgaccgtaggctacatgacagtctataattactatgtgtacccagacaaaacccggccacgtgtaagtcagatgctgattttgactccatttcaaggtcaaggccatggtgctcaacttcttgaaacagttcatagatactacactgaatttcctacagttcttgatattacagcggaagatccatccaaaagctatgtgaaattacgagactttgtgcttgtgaagctttgtcaagatttgccctgtttttcccgggaaaaattaatgcaaggattcaatgaagatatggcgatagaggcacaacagaagttcaaaataaataagcaacacgctagaagggtttatgaaattcttcgactactggtaactgacatgagtgatgccgaacaatacagaagctacagactggatattaaaagaagactaattagcccatataagaaaaagcagagagatcttgctaagatgagaaaatgtctcagaccagaagaactgacaaaccagatgaaccaaatagaaataagcatgcaacatgaacagctggaagagagttttcaggaactagtggaagattaccggcgtgttattgaacgacttgctcaagagtaaagattatactgctctgtacaggaagcttgcaaattttctgtacaatgtgctgtgaaaaatctgatgactttaattttaaaatcttgtgacattttgcttatactaaaagttatctatctttagttgaatattttcttttggagagattgtatattttaaaatactgtttagagtttatgagcatatattgcatttaaagaaagataaagcttctgaaatactactgcaattgcttcccttcttaaacagtataataaatgcttagttgtgatatgtta

SEQ ID NO: 456383 - DNA, 1539 bp, Homo sapiens
gagcgcgcgggttgatcgtccttcctcagccgcgggtgatcgtagctcggaaatggcgggatttggtgctatggagaaatttttggtagaatataagagtgcagtggagaagaaactggcagagtacaaatgtaacaccaacacagcaattgaactaaaattagttcgttttcctgaagatcttgaaaatgacattagaactttctttcctgagtatacccatcaactctttggggatgatgaaactgcttttggttacaagggtctaaagatcctgttatactatattgctggtagcctgtcaacaatgttccgtgttgaatatgcatctaaagttgatgagaactttgactgtgtagaggcagatgatgttgagggcaaaattagacaaatcattccacctggattttgcacaaacacgaatgatttcctttctttactggaaaaggaagttgatttcaagccattcggaaccttacttcatacctactcagttctcagtccaacaggaggagaaaactttacctttcagatatataaggctgacatgacatgtagaggctttcgagaatatcatgaaaggcttcagacctttttgatgtggtttattgaaactgctagctttattgacgtggatgatgaaagatggcactactttctagtatttgagaagtataataaggatggagctacgctctttgcgaccgtaggctacatgacagtctataattactatgtgtacccagacaaaggccatggtgctcaacttcttgaaacagttcatagatactacactgaatttcctacagttcttgatattacagcggaagatccatccaaaagctatgtgaaattacgagactttgtgcttgtgaagctttgtcaagatttgccctgtttttcccgggaaaaattaatgcaaggattcaatgaagatatggcgatagaggcacaacagaagttcaaaataaataagcaacacgctagaagggtttatgaaattcttcgactactggtaactgacatgagtgatgccgaacaatacagaagctacagactggatattaaaagaagactaattagcccatataagaaaaagcagagagatcttgctaagatgagaaaatgtctcagaccagaagaactgacaaaccagatgaaccaaatagaaataagcatgcaacatgaacagctggaagagagttttcaggaactagtggaagattaccggcgtgttattgaacgacttgctcaagagtaaagattatactgctctgtacaggaagcttgcaaattttctgtacaatgtgctgtgaaaaatctgatgactttaattttaaaatcttgtgacattttgcttatactaaaagttatctatctttagttgaatattttcttttggagagattgtatattttaaaatactgtttagagtttatgagcatatattgcatttaaagaaagataaagcttctgaaatactactgcaattgcttcccttcttaaacagtataataaatgcttagttgtgatatgtta

SEQ ID NO: 456384 - DNA, 1284 bp, Homo sapiens
gagcgcgcgggttgatcgtccttcctcagccgcgggtgatcgtagctcggaaatggcgggatttggtgctatggagaaatttttggtagaatataagagtgcagtggagaagaaactggcagagtacaaatgtaacaccaacacagcaattgaactaaaattgcagatgatgttgagggcaaaattagacaaatcattccacctggattttgcacaaacacgaatgatttcctttctttactggaaaaggaagttgatttcaagccattcggaaccttacttcatacctactcagttctcagtccaacaggaggagaaaactttacctttcagatatataaggctgacatgacatgtagaggctttcgagaatatcatgaaaggcttcagacctttttgatgtggtttattgaaactgctagctttattgacgtggatgatgaaagatggcactactttctagtatttgagaagtataataaggatggagctacgctctttgcgaccgtaggctacatgacagtctataattactatgtgtacccagacaaaacccggccacgtgtaagcggaagatccatccaaaagctatgtgaaattacgagactttgtgcttgtgaagctttgtcaagatttgccctgtttttcccgggaaaaattaatgcaaggattcaatgaagatatggcgatagaggcacaacagaagttcaaaataaataagcaacacgctagaagggtttatgaaattcttcgactactggtaactgacatgagtgatgccgaacaatacagaagctacagactggatattaaaagaagactaattagcccatataagaaaaagcagagagatcttgctaagatgagaaaatgtctcagaccagaagaactgacaaaccagatgaaccaaatagaaataagcatgcaacatgaacagctggaagagagttttcaggaactagtggaagattaccggcgtgttattgaacgacttgctcaagagtaaagattatactgctctgtacaggaagcttgcaaattttctgtacaatgtgctgtgaaaaatctgatgactttaattttaaaatcttgtgacattttgcttatactaaaagttatctatctttagttgaatattttcttttggagagattgtatattttaaaatactgtttagagtttatgagcatatattgcatttaaagaaagataaagcttctgaaatactactgcaattgcttcccttcttaaacagtataataaatgcttagttgtgatatgtta

SEQ ID NO: 456385 - DNA, 1089 bp, Homo sapiens
gagcgcgcgggttgatcgtccttcctcagccgcgggtgatcgtagctcggaaatggcgggatttggtgctatggagaaatttttggtagaatataagagtgcagtggagaagaaactggcagagtacaaatgtaacaccaacacagcaattgaactaaaattagttcgttttcctgaagatcttgaaaatgacattagaactttctttcctgagtatacccatcaactctttggggatgatgaaactgcttttggttacaagggtctaaagatcctgttatactatattgctggtagcctgtcaacaatgttccgtgttgaatatgcatctaaagttgatgagaactttgactgtgtagaggcagatgatgttgagggcaaaattagacaaatcattccacctggattttgcacaaacacgaatgatttcctttctttactggaaaaggaagttgatttcaagccattcggaaccttacttcatacctactcagttctcagtccaacaggaggagaaaactttacctttcagatatataaggctgacatgacatgtagaggctttcgagaatatcatgaaaggcttcagacctttttgatgtggtttattgaaactgctagctttattgacgtggatgatgaaagatggcactactttctagtatttgagaagtataataaggatggagctacgctctttgcgaccgtaggctacatgacagtctataattactatgtgtacccagacaaaacccggccacgtgtaagtcagatgctgattttgactccatttcaaggtcaaggccatggtgctcaacttcttgaaacagttcatagatactacactgaatttcctacagttcttgatattacagcggaagatccatccaaaagctatgtgaaattacgagactttgtgcttgtgaagctttgtcaagatttgccctgtttttcccgggaaaaattaatgcaaggattcaatgaagatatggcgatagaggcacaacagaagttcaaaataaataagcaacacgctagaagggtttatgaaattcttcgactactgttacgtcagtcgggccccggttt

SEQ ID NO: 456386 - DNA, 1018 bp, Homo sapiens
ggtttagtatgataatgtatgtctggaacttaataaagactcaaatgctatttaatatatttttaaagtatagcagttttccatttgtctttctgaaacatttctaacagtttatgttaaaattagcatgtggcccgtaagtacttcactgggtggaatttaaaatgtaattaattaatgactgaatagtaaaatgaagaataatagcacttaatctcagttgtctttcttcagctaatgtcttctatctattaagcaaatatttgagtgtctatactgcccagagttctttaaagttttggagggggctgctagtcacatgtctgtatttaccatcattggacacaaataccaggtcttcttgttaactctttttagagggtttgcaattcatggttaacattatgtttaagcttccttaaaaaacaaaacaaaacaaaaaaaaaacattgtgggacaagtttgggcgtattcatactattcttatttttaacattggagacttaaaattgtaagactataaggaaatatatttactttcttcgtctaacaaataattgtttgtcacttagaaaaagcagagagatcttgctaagatgagaaaatgtctcagaccagaagaactgacaaaccagatgaaccaaatagaaataagcatgcaacatgaacagctggaagagagttttcaggaactagtggaagattaccggcgtgttattgaacgacttgctcaagagtaaagattatactgctctgtacaggaagcttgcaaattttctgtacaatgtgctgtgaaaaatctgatgactttaattttaaaatcttgtgacattttgcttatactaaaagttatctatctttagttgaatattttcttttggagagattgtatattttaaaatactgtttagagtttatgagcatatattgcatttaaagaaagataaagcttctgaaatactactgcaattgcttcccttcttaaacagtataataaatgcttagttgtgatatgtta

SEQ ID NO: 456387 - DNA, 484 bp, Homo sapiens
tgcagtaaacaagttttaatcagcattataaaccaagatctattttgtgtgtatgtctgtatctatgttcacatcttaatctgagacttctaaacattttcccacaggataattttgtgttctgcggactttcacttacctttgtgatgagtttcacctgacttttcctggctttttccctaggctgacatgacatgtagaggctttcgagaatatcatgaaaggcttcagacctttttgatgtggtttattgaaactgctagctttattgacgtggatgatgaaagatggcactactttctagtgtaagtacagttctaaagcaacagtagaccttattacctccacaaagccagcattttaattgtggcagcccaattattgggacagtataatgatatttttcccaggaaagaaaaactattgtttatgaggcttgagttttccttcattatgctttgggagaccttgagaatagagctga

SEQ ID NO: 456388 - DNA, 1590 bp, Homo sapiens
gagcgcgcgggttgatcgtccttcctcagccgcgggtgatcgtagctcggaaatggcgggatttggtgctatggagaaatttttggtagaatataagagtgcagtggagaagaaactggcagagtacaaatgtaacaccaacacagcaattgaactaaaattagttcgttttcctgaagatcttgaaaatgacattagaactttctttcctgagtatacccatcaactctttggggatgatgaaactgcttttggttacaagggtctaaagatcctgttatactatattgctggtagcctgtcaacaatgttccgtgttgaatatgcatctaaagttgatgagaactttgactgtgtagaggcagatgatgttgagggcaaaattagacaaatcattccacctggattttgcacaaacacgaatgatttcctttctttactggaaaaggaagttgatttcaagccattcggaaccttacttcatacctactcagttctcagtccaacaggaggagaaaactttacctttcagatatataaggctgacatgacatgtagaggctttcgagaatatcatgaaaggcttcagacctttttgatgtggtttattgaaactgctagctttattgacgtggatgatgaaagatggcactactttctagtatttgagaagtataataaggatggagctacgctctttgcgaccgtaggctacatgacagtctataattactatgtgtacccagacaaaacccggccacgtgtaagtcagatgctgattttgactccatttcaaggtcaaggccatggtgctcaacttcttgaaacagttcatagatactacactgaatttcctacagttcttgatattacagcggaagatccatccaaaagctatgtgaaattacgagactttgtgcttgtgaagctttgtcaagatttgccctgtttttcccgggaaaaattaatgcaaggattcaatgaagatatggcgatagaggcacaacagaagttcaaaataaataagcaacacgctagaagggtttatgaaattcttcgactactggtaactgacatgagtgatgccgaacaatacagaagctacagactggatattaaaagaagactaattagcccatataagaaaaagcagagagatcttgctaagatgagaaaatgtctcagaccagaagaactgacaaaccagatgaaccaaatagaaataagcatgcaacatgaacagctggaagagagttttcaggaactagtggaagattaccggcgtgttattgaacgacttgctcaagagtaaagattatactgctctgtacaggaagcttgcaaattttctgtacaatgtgctgtgaaaaatctgatgactttaattttaaaatcttgtgacattttgcttatactaaaagttatctatctttagttgaatattttcttttggagagattgtatattttaaaatactgtttagagtttatgagcatatattgcatttaaagaaagataaagcttctgaaatactactgcaattgcttcccttcttaaacagtataataaatgcttagttgtgatatgtta

SEQ ID NO: 456389 - DNA, 1642 bp, Homo sapiens
gagcgcgcgggttgatcgtccttcctcagccgcgggtgatcgtagctcggaaatggcgggatttggtgctatggagaaatttttggtagaatataagagtgcagtggagaagaaactggcagagtacaaatgtaacaccaacacagcaattgaactaaaattagttcgttttcctgaagatcttgaaaatgacattagaactttctttcctgagtatacccatcaactctttggggatgatgaaactgcttttggttacaagggtctaaagatcctgttatactatattgctggtagcctgtcaacaatgttccgtgttgaatatgcatctaaagttgatgagaactttgactgtgtagaggcagatgatgttgagggcaaaattagacaaatcattccacctggattttgcacaaacacgaatgatttcctttctttactggaaaaggaagttgatttcaagccattcggaaccttacttcatacctactcagttctcagtccaacaggaggagaaaactttacctttcagatatataaggctgacatgacatgtagaggctttcgagaatatcatgaaaggcttcagacctttttgatgtggtttattgaaactgctagctttattgacgtggatgatgaaagatggcactactttctagtatttgagaagtataataaggatggagctacgctctttgcgaccgtaggctacatgacagtctataattactatgtgtacccagacaaaacccggccacgtgtaagtcagatgctgattttgactccatttcaaggtcaaggccatggtgctcaacttcttgaaacagttcatagatactacactgaatttcctacagttcttgatattacagcggaagatccatccaaaagctatgtgaaattacgagactttgtgcttgtgaagctttgtcaagatttgccctgtttttcccgggaaaaattaatgcaaggattcaatgaagatatggcgatagaggcacaacagaagttcaaaataaataagcaacacgctagaagggtttatgaaattcttcgactactggtaactgacatgagtgatgccgaacaatacagaagctacagactggatattaaaagaagactaattagcccatataagaaaaagcagagagatcttgctaagatgagaaaatgtctcagaccagaagaactgacaaaccagatgaaccaaatagaaataagcatgcaacatgaacagctggaagagagttttcaggaactagtggaagattaccggcgtgttattgaacgacttgctcaagagtaaagattatactgctctgtacaggaagcttgcaaattttctgtacaatgtgctgtgaaaaatctgatgactttaattttaaaatcttgtgacattttgcttatactaaaagttatctatctttagttgaatattttcttttggagagattgtatattttaaaatactgtttagagtttatgagcatatattgcatttaaagaaagataaagcttctgaaatactactgcaattgcttcccttcttaaacagtataataaatgcttagttgtgatatgttaatgtgtgatgatatgattcttaaatacttacaataaacctcattcttaaata

SEQ ID NO: 456390 - DNA, 1536 bp, Homo sapiens
gagcgcgcgggttgatcgtccttcctcagccgcgggtgatcgtagctcggaaatggcgggatttggtgctatggagaaatttttggtagaatataagagtgcagtggagaagaaactggcagagtacaaatgtaacaccaacacagcaattgaactaaaattagttcgttttcctgaagatcttgaaaatgacattagaactttctttcctgagtatacccatcaactctttggggatgatgaaactgcttttggttacaagggtctaaagatcctgttatactatattgctggtagcctgtcaacaatgttccgtgttgaatatgcatctaaagttgatgagaactttgactgtgtagaggcagatgatgttgagggcaaaattagacaaatcattccacctggattttgcacaaacacgaatgatttcctttctttactggaaaaggaagttgatttcaagccattcggaaccttacttcatacctactcagttctcagtccaacaggaggagaatatcatgaaaggcttcagacctttttgatgtggtttattgaaactgctagctttattgacgtggatgatgaaagatggcactactttctagtatttgagaagtataataaggatggagctacgctctttgcgaccgtaggctacatgacagtctataattactatgtgtacccagacaaaacccggccacgtgtaagtcagatgctgattttgactccatttcaaggtcaaggccatggtgctcaacttcttgaaacagttcatagatactacactgaatttcctacagttcttgatattacagcggaagatccatccaaaagctatgtgaaattacgagactttgtgcttgtgaagctttgtcaagatttgccctgtttttcccgggaaaaattaatgcaaggattcaatgaagatatggcgatagaggcacaacagaagttcaaaataaataagcaacacgctagaagggtttatgaaattcttcgactactggtaactgacatgagtgatgccgaacaatacagaagctacagactggatattaaaagaagactaattagcccatataagaaaaagcagagagatcttgctaagatgagaaaatgtctcagaccagaagaactgacaaaccagatgaaccaaatagaaataagcatgcaacatgaacagctggaagagagttttcaggaactagtggaagattaccggcgtgttattgaacgacttgctcaagagtaaagattatactgctctgtacaggaagcttgcaaattttctgtacaatgtgctgtgaaaaatctgatgactttaattttaaaatcttgtgacattttgcttatactaaaagttatctatctttagttgaatattttcttttggagagattgtatattttaaaatactgtttagagtttatgagcatatattgcatttaaagaaagataaagcttctgaaatactactgcaattgcttcccttcttaaacagtataataaatgcttagttgtgatatgtta

SEQ ID NO: 456391 - DNA, 995 bp, Homo sapiens
gtcggaggaatactatttgcctcacaagacctggacgtggatgatgaaagatggcactactttctagtatttgagaagtataataaggatggagctacgctctttgcgaccgtaggctacatgacagtctataattactatgtgtacccagacaaaacccggccacgtgtaagtcagatgctgattttgactccatttcaaggtcaaggccatggtgctcaacttcttgaaacagttcatagatactacactgaatttcctacagttcttgatattacagcggaagatccatccaaaagctatgtgaaattacgagactttgtgcttgtgaagctttgtcaagatttgccctgtttttcccgggaaaaattaatgcaaggattcaatgaagatatggcgatagaggcacaacagaagttcaaaataaataagcaacacgctagaagggtttatgaaattcttcgactactggtaactgacatgagtgatgccgaacaatacagaagctacagactggatattaaaagaagactaattagcccatataagaaaaagcagagagatcttgctaagatgagaaaatgtctcagaccagaagaactgacaaaccagatgaaccaaatagaaataagcatgcaacatgaacagctggaagagagttttcaggaactagtggaagattaccggcgtgttattgaacgacttgctcaagagtaaagattatactgctctgtacaggaagcttgcaaattttctgtacaatgtgctgtgaaaaatctgatgactttaattttaaaatcttgtgacattttgcttatactaaaagttatctatctttagttgaatattttcttttggagagattgtatattttaaaatactgtttagagtttatgagcatatattgcatttaaagaaagataaagcttctgaaatactactgcaattgcttcccttcttaaacagtataataaatgcttagttgtgatatgtta

SEQ ID NO: 456392 - DNA, 1052 bp, Homo sapiens
  misc_feature (1)..(1): n is a, c, g, or t
nattcggaacgaggtttacctttcagatatataaggctgacatgacatgtagaggctttcgagaatatcatgaaaggcttcagacctttttgatgtggtttattgaaactgctagctttattgacgtggatgatgaaagatggcactactttctagtatttgagaagtataataaggatggagctacgctctttgcgaccgtaggctacatgacagtctataattactatgtgtacccagacaaaacccggccacgtgtaagaaggccatggtgctcaacttcttgaaacagttcatagatactacactgaatttcctacagttcttgatattacagcggaagatccatccaaaagctatgtgaaattacgagactttgtgcttgtgaagctttgtcaagatttgccctgtttttcccgggaaaaattaatgcaaggattcaatgaagatatggcgatagaggcacaacagaagttcaaaataaataagcaacacgctagaagggtttatgaaattcttcgactactggtaactgacatgagtgatgccgaacaatacagaagctacagactggatattaaaagaagactaattagcccatataagaaaaagcagagagatcttgctaagatgagaaaatgtctcagaccagaagaactgacaaaccagatgaaccaaatagaaataagcatgcaacatgaacagctggaagagagttttcaggaactagtggaagattaccggcgtgttattgaacgacttgctcaagagtaaagattatactgctctgtacaggaagcttgcaaattttctgtacaatgtgctgtgaaaaatctgatgactttaattttaaaatcttgtgacattttgcttatactaaaagttatctatctttagttgaatattttcttttggagagattgtatattttaaaatactgtttagagtttatgagcatatattgcatttaaagaaagataaagcttctgaaatactactgcaattgcttcccttcttaaacagtataataaatgcttagttgtgatatgtta

SEQ ID NO: 456393 - DNA, 917 bp, Homo sapiens
ggtgggcgctatggccttggcgggcgctatggccttggtgggcgctatggccttggtgggcgctatggccttggtgggcgctatggccttggcgggcgctatggccttggtgggcgctatggccttggtgggcgctatggccttgaccttgaaagggagtcaaaatcaggatctgaatttcctacagttcttaatattacagcggaagatccatccaaaagctatgtgaaattacgagactttgtgcttgtgaagctttgtcaagatttgccctgtttttcccgggaaaaattaatgcaaggattcaatgaagatatggcgatagaggcacaacagaagttcaaaataaataagcaacacgctagaagggtttatgaaattcttcgactactggtaactgacatgagtgatgccgaacaatacagaagctacagactggatattaaaagaagactaattagcccatataagaaaaagcagagagatcttgctaagatgagaaaatgtctcagaccagaagaactgacaaaccagatgaaccaaatagaaataagcatgcaacatgaacagctggaagagagttttcaggaactagtggaagattaccggcgtgttattgaacgacttgctcaagagtaaagattatactgctctgtacaggaagcttgcaaattttctgtacaatgtgctgtgaaaaatctgatgactttaattttaaaatcttgtgacattttgcttatactaaaagttatctatctttagttgaatattttcttttggagagattgtatattttaaaatactgtttagagtttatgagcatatattgcatttaaagaaagataaagcttctgaaatactactgcaattgcttcccttcttaaacagtataataaatgcttagttgtgatatgtta

SEQ ID NO: 456394 - DNA, 5651 bp, Homo sapiens
  misc_feature (77)..(77): n is a, c, g, or t
gggtgtcccctccgcgccgttaaaatgaaactctagtggctggagtccgggcagagcttgagggcagttggtgcggncgggttggttcttacaccccggcgggagcgcccagacaagccgagctgactggacttctccggccggccccattcccgaggctgcggcagcttcggttccgagaccgaccggagaggagcccgagtcccggcctctgggggattcgctctctgcagaccagtgggaccccgaaacttgaacgcaatctccagcccccttttttgccttcctttgtcacttgcccgggtttctcccaacgtgttcttttttttcctcttcattctccctccttcgaaggacacaaaagtggcttccgcggaaagatttggaggcggtgggagcttttctccccggagagcgactgtgtagaaaggatttttgggaagccgctttttaacacctctgctctccgtcccccaagcctctgtgtaatcctctgaggagaaaagcccatagcttgaaagttcgggggcattttgttgtgttctgtaggagagagggggaggaccctgttcgggtagtttggccggactggtactggccgttggaaaacccgaagtacatttccgtgtggaacttttgcagatatatatttttagatttttaaataccagataaaaaatatatgccttctatatatctcctggcgacctgcccctgacagcgcgatgtacaatacggtgtggagtatggaccgcgatgacgcagactggagggaggtgatgatgccctattcgacagaactgatattttatattgaaatggatcctccagctcttccaccaaagccacctaagccaatgacttcagcagttccaaatggaatgaaggacagttctgtttctcttcaggatgcagaatggtactggggggatatttcaagggaggaggtaaatgacaaattgcgggatatgccagatgggaccttcttggtccgagatgcctcaacaaaaatgcagggagattatactttgactttgcggaagggaggcaataataagttaataaagatctatcaccgggatggtaaatatggcttttctgatcctctgacatttaattccgtggtggagctcattaaccactatcaccatgaatctcttgctcagtacaatcccaaacttgatgtgaagctgatgtacccagtgtccagataccaacaggatcagttggtaaaagaagataatattgatgcagtaggtaaaaaactgcaagaataccactctcagtatcaggagaagagtaaagagtatgataggctgtatgaagaatatactagaacatcccaggaaatacagatgaagaggactgcaatagaagcttttaatgaaacaattaaaatatttgaagagcagtgtcacacacaagaacaacatagcaaagaatatattgagcgatttcgcagagaggggaatgaaaaggagattgaacgaattatgatgaattatgataaattgaaatcacgtctgggtgagattcatgatagcaaaatgcgtctagagcaggatttgaagaaacaagctttggacaaccgagaaatagataaaaaaatgaatagtatcaaacctgacctgatccagctgcgaaagatccgagatcaacaccttgtatggctcaatcacaaaggagtgagacagaaacgcctgaatgtctggctgggaattaagaatgaggatgctgatgagaactattttatcaatgaggaagatgaaaacctgccccattatgatgagaaaacctggtttgttgaggatatcaatcgagtacaagcagaggacttgctttatgggaaacctgatggtgcattcttaattcgtgagagtagcaagaaaggatgctatgcttgctctgtggtggccgatggggaagtgaagcactgtgtgatctacagcactgctcggggctatggctttgcagagccctacaacctgtacagctctctgaaggagctagtgctccattaccagcagacatccttggttcagcacaacgactccctcaacgtcaggcttgcctaccctgttcatgcacagatgccctcgctttgcagataaagaggaagtgggaagagaggtggttctctggcatttttttctacagtttttattagactacgatgagggcattctttctacatagactgcttgttttgcacaagaagtgattttgtgaatgtgaagtggagaggccgagcagcagccggccgggatgggggcattagaggcctgaggttctctaggactcagccatgccgctgcactgacatactaagctggaagcagatgttttttttgaaagtctgtttcattggggtttttgttttgtttagccagacaccctcaacagaatattaggcttgatggttatagcgggtggggttgtatttggaagcctctgaagagaccatgtctttttaaaatctaactcttgagagtgcagcaggggcatggctctgctgggagttgtgttttgctttggcagtctctcttccccccacgaagaaggctgtttaggttttgtgatagaatgggatttgatgaaaaagacaaccaaaggaaaatggggaggcttgggatttcatttaaataatctaagccaagatgataaaaaaaaccttcaactgaaggtactttgtttcttaccaacataatttaggcttcagcatctcaccagcccctccctctgaagaagtattatgttcagaagccaacaaaacagtttgttgccagaccaatgtttgatgggaaaacgtggcactcatagttgaatgtatacttctgtaccaaaacttgaacataaaagactagaatttgtgagttttagcaaacgctaaaattgatcactgtaactaaccccttctgtccttcctgcctgtttctctgagatgaggaatagcattctttttgtggggatggtgagctttgaatcataaaatgaagttggtgcttgtatggtgtttccttagcctaaagaatgatctgttgtttgaaacctttgtaacttgtttgtatgagtaaagaaaaggtgcaatgcagtgcttttagatggcttgatataccaaataacaatatagaacaacattattatatgtgcttccccaagtttaaaggccctgcagaaatagtaaacatggtttaatttcccttcatttccccctcctttgctggatggggttttgggagctataggttgctaaggaggggagtcagattgtggtcaggtgcctcagtaaatcacagacccaggggccctgtggtccagggtgagagtcacaccacattacacatgtgcttccatacagtggtttctgaagcttttgcagggagagaagatggcttagtgtttagactgttagtagaagccatctggaagcttttctctttgcctttttttgtgatcctgccattaaggctatgtgcagtctgccctcctgctccagtggccttgattttaggccaggaatcttctgctccatgtggcttaagccttccagctgagtgaagctaggcaaatggagtgggggcaggcatctattcctgcccccatcatgccccacacccatcagtcaacactcatttgacaaatagagtccagctgcctctgagccaatcctgggaccataataggctcagagtgagtcagctgtttgaacccaaagctgtgcagtcaggcaccctggctgagctagagaagccagtacctgcatcttggtttataaggcttacagctaggaaagctctagttctgggggtgaaagaaaaatattagtttacctgagcacttatttccatgacagggtctaaaatatggaccatgatgtagacacagatttttaattttggaaaaacctccagttactagtgacgaggatagaaagggaagtgcttctctttggctttttcttggttacactgcagtttcaggattgggtgagacagagacaaatgaacccccctctaaagtcatttaactaatagccagcacatcccttccccaaactgtcaattgaaatcttaactgaaagttttactgaataataccaagctaattgctgttgggcacacctggatggctttgcacctggtgttgaacctgctgaagcaggtggatgctcaagattacgtgcaaggaatccctcccatctggtactaaaatttcagtgtgttctgagtgtcttttaaaccaaaatggaaatacagatacagggctgtagtattcagtaatgtgtctgctccttgttgggcagacaccagcggtgtgcagggagagaccaagtaccatctttatctacacttgggctggcttgtggagaagggctgctttttttcagtcctacattccttcattttttttttcattcttgaattcattgttttgtgggatctaagacccaggggtcatttgagaggtttgacagtatcttttctgaccagttgccacatgacttgcttgaccctgagcctgtggaaatggcatagggaccagtctactacccactgggcctggtgtgtagagggggagagggtagcaaggtgcttctctacgcccatgacttgggagcaggtcttggcctccttcatgagagtctagtgccatgtcctgtcccatgatctggaccctgggactgtcttggcatcttaactgcagtttcaatgaggcagagggcaaagagagaccaagatcagaggggttcattatacccctggctagagaacccagctactgacatgcaagcagcttggggctggctggacacaggtactaggcccattgtttccaggtgaagctttcatcacagaacagtgttgtctccacctggccttagatggcacgccatgattcgggcctggatagactgcctgcgtccttaccactgatctggccaagaatgaggccctcccaacactttcactccctctccaagccttgatgggacctccacttatttaggcctcatgtgctttgaagaagctttgagagccaatgtgtcttccacgggtctcttttttgctacaagtaatcagccccatgtgttctcttaaactgagaattgcacctgggcaattcctgttttctaaggtggtctctgctgctatttaacaacccagagtaggcctctgtgaggcttcagtggcctcagaaaccagagggtccagatagggggcctgcttgggccctctgctgccaactgctcaaacctgctttagctccagccacttgtggcaaacaacctcgtttccttacaaattccagcatgtgactttggtgccgttacttgtgaaaaatctattctgttgtctttgatgtgtccaagaaaattcgtgtagtttacgtaaaaatatctgactcacaagaaagccaactgtatgtcttgtgatgggacagttcataatgtagttgctagaccactttacaaattgttcttgtcaccagatgtgttcagacattgctgtgcaattgttggggagggtagggggaaaggcgagaggagatacttattggtctttttgtttaataccttccccaagaggggacagtctggccaacttgctccagtaatgcaataaagacattgcaataaagtaaaaaaaaaa

SEQ ID NO: 456395 - DNA, 5474 bp, Homo sapiens
  misc_feature (77)..(77): n is a, c, g, or t
gggtgtcccctccgcgccgttaaaatgaaactctagtggctggagtccgggcagagcttgagggcagttggtgcggncgggttggttcttacaccccggcgggagcgcccagacaagccgagctgactggacttctccggccggccccattcccgaggctgcggcagcttcggttccgagaccgaccggagaggagcccgagtcccggcctctgggggattcgctctctgcagaccagtgggaccccgaaacttgaacgcaatctccagcccccttttttgccttcctttgtcacttgcccgggtttctcccaacgtgttcttttttttcctcttcattctccctccttcgaaggacacaaaagtggcttccgcggaaagatttggaggcggtgggagcttttctccccggagagcgactgtgtagaaaggatttttgggaagccgctttttaacacctctgctctccgtcccccaagcctctgtgtaatcctctgaggagaaaagcccatagcttgaaagttcgggggcattttgttgtgttctgtaggagagagggggaggaccctgttcgggtagtttggccggactggtactggccgttggaaaacccgaagtacatttccgtgtggaacttttgcagatatatatttttagatttttaaataccagataaaaaatatatgccttctatatatctcctggcgacctgcccctgacagcgcgatgtacaatacggtgtggagtatggaccgcgatgacgcagactggagggaggtgatgatgccctattcgacagaactgatattttatattgaaatggatcctccagctcttccaccaaagccacctaagccaatgacttcagcagttccaaatggaatgaaggacagttctgtttctcttcaggatgcagaatggtactggggggatatttcaagggaggaggtaaatgacaaattgcgggatatgccagatgggaccttcttggtccgagatgcctcaacaaaaatgcagggagattatactttgactttgcggaagggaggcaataataagttaataaagatctatcaccgggatggtaaatatggcttttctgatcctctgacatttaattccgtggtggagctcattaaccactatcaccatgaatctcttgctcagtacaatcccaaacttgatgtgaagctgatgtacccagtgtccagataccaacaggatcagttggtaaaagaagataatattgatgcagtaggtaaaaaactgcaagaataccactctcagtatcaggagaagagtaaagagtatgataggctgtatgaagaatatactagaacatcccaggaaatacagatgaagaggactgcaatagaagcttttaatgaaacaattaaaatatttgaagagcagtgtcacacacaagaacaacatagcaaagaatatattgagcgatttcgcagagaggggaatgaaaaggagattgaacgatggctcaatcacaaaggagtgagacagaaacgcctgaatgtctggctgggaattaagaatgaggatgctgatgagaactattttatcaatgaggaagatgaaaacctgccccattatgatgagaaaacctggtttgttgaggatatcaatcgagtacaagcagaggacttgctttatgggaaacctgatggtgcattcttaattcgtgagagtagcaagaaaggatgctatgcttgctctgtggtggccgatggggaagtgaagcactgtgtgatctacagcactgctcggggctatggctttgcagagccctacaacctgtacagctctctgaaggagctagtgctccattaccagcagacatccttggttcagcacaacgactccctcaacgtcaggcttgcctaccctgttcatgcacagatgccctcgctttgcagataaagaggaagtgggaagagaggtggttctctggcatttttttctacagtttttattagactacgatgagggcattctttctacatagactgcttgttttgcacaagaagtgattttgtgaatgtgaagtggagaggccgagcagcagccggccgggatgggggcattagaggcctgaggttctctaggactcagccatgccgctgcactgacatactaagctggaagcagatgttttttttgaaagtctgtttcattggggtttttgttttgtttagccagacaccctcaacagaatattaggcttgatggttatagcgggtggggttgtatttggaagcctctgaagagaccatgtctttttaaaatctaactcttgagagtgcagcaggggcatggctctgctgggagttgtgttttgctttggcagtctctcttccccccacgaagaaggctgtttaggttttgtgatagaatgggatttgatgaaaaagacaaccaaaggaaaatggggaggcttgggatttcatttaaataatctaagccaagatgataaaaaaaaccttcaactgaaggtactttgtttcttaccaacataatttaggcttcagcatctcaccagcccctccctctgaagaagtattatgttcagaagccaacaaaacagtttgttgccagaccaatgtttgatgggaaaacgtggcactcatagttgaatgtatacttctgtaccaaaacttgaacataaaagactagaatttgtgagttttagcaaacgctaaaattgatcactgtaactaaccccttctgtccttcctgcctgtttctctgagatgaggaatagcattctttttgtggggatggtgagctttgaatcataaaatgaagttggtgcttgtatggtgtttccttagcctaaagaatgatctgttgtttgaaacctttgtaacttgtttgtatgagtaaagaaaaggtgcaatgcagtgcttttagatggcttgatataccaaataacaatatagaacaacattattatatgtgcttccccaagtttaaaggccctgcagaaatagtaaacatggtttaatttcccttcatttccccctcctttgctggatggggttttgggagctataggttgctaaggaggggagtcagattgtggtcaggtgcctcagtaaatcacagacccaggggccctgtggtccagggtgagagtcacaccacattacacatgtgcttccatacagtggtttctgaagcttttgcagggagagaagatggcttagtgtttagactgttagtagaagccatctggaagcttttctctttgcctttttttgtgatcctgccattaaggctatgtgcagtctgccctcctgctccagtggccttgattttaggccaggaatcttctgctccatgtggcttaagccttccagctgagtgaagctaggcaaatggagtgggggcaggcatctattcctgcccccatcatgccccacacccatcagtcaacactcatttgacaaatagagtccagctgcctctgagccaatcctgggaccataataggctcagagtgagtcagctgtttgaacccaaagctgtgcagtcaggcaccctggctgagctagagaagccagtacctgcatcttggtttataaggcttacagctaggaaagctctagttctgggggtgaaagaaaaatattagtttacctgagcacttatttccatgacagggtctaaaatatggaccatgatgtagacacagatttttaattttggaaaaacctccagttactagtgacgaggatagaaagggaagtgcttctctttggctttttcttggttacactgcagtttcaggattgggtgagacagagacaaatgaacccccctctaaagtcatttaactaatagccagcacatcccttccccaaactgtcaattgaaatcttaactgaaagttttactgaataataccaagctaattgctgttgggcacacctggatggctttgcacctggtgttgaacctgctgaagcaggtggatgctcaagattacgtgcaaggaatccctcccatctggtactaaaatttcagtgtgttctgagtgtcttttaaaccaaaatggaaatacagatacagggctgtagtattcagtaatgtgtctgctccttgttgggcagacaccagcggtgtgcagggagagaccaagtaccatctttatctacacttgggctggcttgtggagaagggctgctttttttcagtcctacattccttcattttttttttcattcttgaattcattgttttgtgggatctaagacccaggggtcatttgagaggtttgacagtatcttttctgaccagttgccacatgacttgcttgaccctgagcctgtggaaatggcatagggaccagtctactacccactgggcctggtgtgtagagggggagagggtagcaaggtgcttctctacgcccatgacttgggagcaggtcttggcctccttcatgagagtctagtgccatgtcctgtcccatgatctggaccctgggactgtcttggcatcttaactgcagtttcaatgaggcagagggcaaagagagaccaagatcagaggggttcattatacccctggctagagaacccagctactgacatgcaagcagcttggggctggctggacacaggtactaggcccattgtttccaggtgaagctttcatcacagaacagtgttgtctccacctggccttagatggcacgccatgattcgggcctggatagactgcctgcgtccttaccactgatctggccaagaatgaggccctcccaacactttcactccctctccaagccttgatgggacctccacttatttaggcctcatgtgctttgaagaagctttgagagccaatgtgtcttccacgggtctcttttttgctacaagtaatcagccccatgtgttctcttaaactgagaattgcacctgggcaattcctgttttctaaggtggtctctgctgctatttaacaacccagagtaggcctctgtgaggcttcagtggcctcagaaaccagagggtccagatagggggcctgcttgggccctctgctgccaactgctcaaacctgctttagctccagccacttgtggcaaacaacctcgtttccttacaaattccagcatgtgactttggtgccgttacttgtgaaaaatctattctgttgtctttgatgtgtccaagaaaattcgtgtagtttacgtaaaaatatctgactcacaagaaagccaactgtatgtcttgtgatgggacagttcataatgtagttgctagaccactttacaaattgttcttgtcaccagatgtgttcagacattgctgtgcaattgttggggagggtagggggaaaggcgagaggagatacttattggtctttttgtttaataccttccccaagaggggacagtctggccaacttgctccagtaatgcaataaagacattgcaataaagtaaaaaaaaaa

SEQ ID NO: 456396 - DNA, 5066 bp, Homo sapiens
accattctgattgaggctgggggagagcgcggatggctgattggggagccgaagcctagagagcggtggggagacgtgaaagtcgagatggagagcagctttttgaacatgttctcaggcacttgacagaatcccgcgcgatgtacaatacggtgtggagtatggaccgcgatgacgcagactggagggaggtgatgatgccctattcgacagaactgatattttatattgaaatggatcctccagctcttccaccaaagccacctaagccaatgacttcagcagttccaaatggaatgaaggacagttctgtttctcttcaggatgcagaatggtactggggggatatttcaagggaggaggtaaatgacaaattgcgggatatgccagatgggaccttcttggtccgagatgcctcaacaaaaatgcagggagattatactttgactttgcggaagggaggcaataataagttaataaagatctatcaccgggatggtaaatatggcttttctgatcctctgacatttaattccgtggtggagctcattaaccactatcaccatgaatctcttgctcagtacaatcccaaacttgatgtgaagctgatgtacccagtgtccagataccaacaggatcagttggtaaaagaagataatattgatgcagtaggtaaaaaactgcaagaataccactctcagtatcaggagaagagtaaagagtatgataggctgtatgaagaatatactagaacatcccaggaaatacagatgaagaggactgcaatagaagcttttaatgaaacaattaaaatatttgaagagcagtgtcacacacaagaacaacatagcaaagaatatattgagcgatttcgcagagaggggaatgaaaaggagattgaacgaattatgatgaattatgataaattgaaatcacgtctgggtgagattcatgatagcaaaatgcgtctagagcaggatttgaagaaacaagctttggacaaccgagaaatagataaaaaaatgaatagtatcaaacctgacctgatccagctgcgaaagatccgagatcaacaccttgtatggctcaatcacaaaggagtgagacagaaacgcctgaatgtctggctgggaattaagaatgaggatgctgatgagaactattttatcaatgaggaagatgaaaacctgccccattatgatgagaaaacctggtttgttgaggatatcaatcgagtacaagcagaggacttgctttatgggaaacctgatggtgcattcttaattcgtgagagtagcaagaaaggatgctatgcttgctctgtggtggccgatggggaagtgaagcactgtgtgatctacagcactgctcggggctatggctttgcagagccctacaacctgtacagctctctgaaggagctagtgctccattaccagcagacatccttggttcagcacaacgactccctcaacgtcaggcttgcctaccctgttcatgcacagatgccctcgctttgcagataaagaggaagtgggaagagaggtggttctctggcatttttttctacagtttttattagactacgatgagggcattctttctacatagactgcttgttttgcacaagaagtgattttgtgaatgtgaagtggagaggccgagcagcagccggccgggatgggggcattagaggcctgaggttctctaggactcagccatgccgctgcactgacatactaagctggaagcagatgttttttttgaaagtctgtttcattggggtttttgttttgtttagccagacaccctcaacagaatattaggcttgatggttatagcgggtggggttgtatttggaagcctctgaagagaccatgtctttttaaaatctaactcttgagagtgcagcaggggcatggctctgctgggagttgtgttttgctttggcagtctctcttccccccacgaagaaggctgtttaggttttgtgatagaatgggatttgatgaaaaagacaaccaaaggaaaatggggaggcttgggatttcatttaaataatctaagccaagatgataaaaaaaaccttcaactgaaggtactttgtttcttaccaacataatttaggcttcagcatctcaccagcccctccctctgaagaagtattatgttcagaagccaacaaaacagtttgttgccagaccaatgtttgatgggaaaacgtggcactcatagttgaatgtatacttctgtaccaaaacttgaacataaaagactagaatttgtgagttttagcaaacgctaaaattgatcactgtaactaaccccttctgtccttcctgcctgtttctctgagatgaggaatagcattctttttgtggggatggtgagctttgaatcataaaatgaagttggtgcttgtatggtgtttccttagcctaaagaatgatctgttgtttgaaacctttgtaacttgtttgtatgagtaaagaaaaggtgcaatgcagtgcttttagatggcttgatataccaaataacaatatagaacaacattattatatgtgcttccccaagtttaaaggccctgcagaaatagtaaacatggtttaatttcccttcatttccccctcctttgctggatggggttttgggagctataggttgctaaggaggggagtcagattgtggtcaggtgcctcagtaaatcacagacccaggggccctgtggtccagggtgagagtcacaccacattacacatgtgcttccatacagtggtttctgaagcttttgcagggagagaagatggcttagtgtttagactgttagtagaagccatctggaagcttttctctttgcctttttttgtgatcctgccattaaggctatgtgcagtctgccctcctgctccagtggccttgattttaggccaggaatcttctgctccatgtggcttaagccttccagctgagtgaagctaggcaaatggagtgggggcaggcatctattcctgcccccatcatgccccacacccatcagtcaacactcatttgacaaatagagtccagctgcctctgagccaatcctgggaccataataggctcagagtgagtcagctgtttgaacccaaagctgtgcagtcaggcaccctggctgagctagagaagccagtacctgcatcttggtttataaggcttacagctaggaaagctctagttctgggggtgaaagaaaaatattagtttacctgagcacttatttccatgacagggtctaaaatatggaccatgatgtagacacagatttttaattttggaaaaacctccagttactagtgacgaggatagaaagggaagtgcttctctttggctttttcttggttacactgcagtttcaggattgggtgagacagagacaaatgaacccccctctaaagtcatttaactaatagccagcacatcccttccccaaactgtcaattgaaatcttaactgaaagttttactgaataataccaagctaattgctgttgggcacacctggatggctttgcacctggtgttgaacctgctgaagcaggtggatgctcaagattacgtgcaaggaatccctcccatctggtactaaaatttcagtgtgttctgagtgtcttttaaaccaaaatggaaatacagatacagggctgtagtattcagtaatgtgtctgctccttgttgggcagacaccagcggtgtgcagggagagaccaagtaccatctttatctacacttgggctggcttgtggagaagggctgctttttttcagtcctacattccttcattttttttttcattcttgaattcattgttttgtgggatctaagacccaggggtcatttgagaggtttgacagtatcttttctgaccagttgccacatgacttgcttgaccctgagcctgtggaaatggcatagggaccagtctactacccactgggcctggtgtgtagagggggagagggtagcaaggtgcttctctacgcccatgacttgggagcaggtcttggcctccttcatgagagtctagtgccatgtcctgtcccatgatctggaccctgggactgtcttggcatcttaactgcagtttcaatgaggcagagggcaaagagagaccaagatcagaggggttcattatacccctggctagagaacccagctactgacatgcaagcagcttggggctggctggacacaggtactaggcccattgtttccaggtgaagctttcatcacagaacagtgttgtctccacctggccttagatggcacgccatgattcgggcctggatagactgcctgcgtccttaccactgatctggccaagaatgaggccctcccaacactttcactccctctccaagccttgatgggacctccacttatttaggcctcatgtgctttgaagaagctttgagagccaatgtgtcttccacgggtctcttttttgctacaagtaatcagccccatgtgttctcttaaactgagaattgcacctgggcaattcctgttttctaaggtggtctctgctgctatttaacaacccagagtaggcctctgtgaggcttcagtggcctcagaaaccagagggtccagatagggggcctgcttgggccctctgctgccaactgctcaaacctgctttagctccagccacttgtggcaaacaacctcgtttccttacaaattccagcatgtgactttggtgccgttacttgtgaaaaatctattctgttgtctttgatgtgtccaagaaaattcgtgtagtttacgtaaaaatatctgactcacaagaaagccaactgtatgtcttgtgatgggacagttcataatgtagttgctagaccactttacaaattgttcttgtcaccagatgtgttcagacattgctgtgcaattgttggggagggtagggggaaaggcgagaggagatacttattggtctttttgtttaataccttccccaagaggggacagtctggccaacttgctccagtaatgcaataaagacattgcaataaagtaaaaaaaaaa

SEQ ID NO: 456397 - DNA, 1888 bp, Homo sapiens
gcccatgttgactggacatgggacaactaccatttcagttccgaaacttcctctttgaggagactcaaggtcacctgaggatattgggtactacgcttctggtatgccatgagtcgtaattacccaacgagtgtgagatagaactaaaacacttttttcaccttcagattctgattatcataatcatggtctctaactctgtccttgtgtaaaaaactgagatcccctatgtcctcagagttgttctagagttgggtactacgctttggcatgccaaagcgtagtacccaaactgtcaattgaaatcttaactgaaagttttactgaataataccaagctaattgctgttgggcacacctggatggctttgcacctggtgttgaacctgctgaagcaggtggatgctcaagattacgtgcaaggaatccctcccatctggtactaaaatttcagtgtgttctgagtgtcttttaaaccaaaatggaaatacagatacagggctgtagtattcagtaatgtgtctgctccttgttgggcagacaccagcggtgtgcagggagagaccaagtaccatctttatctacacttgggctggcttgtggagaagggctgctttttttcagtcctacattccttcattttttttttcattcttgaattcattgttttgtgggatctaagacccaggggtcatttgagaggtttgacagtatcttttctgaccagttgccacatgacttgcttgaccctgagcctgtggaaatggcatagggaccagtctactacccactgggcctggtgtgtagagggggagagggtagcaaggtgcttctctacgcccatgacttgggagcaggtcttggcctccttcatgagagtctagtgccatgtcctgtcccatgatctggaccctgggactgtcttggcatcttaactgcagtttcaatgaggcagagggcaaagagagaccaagatcagaggggttcattatacccctggctagagaacccagctactgacatgcaagcagcttggggctggctggacacaggtactaggcccattgtttccaggtgaagctttcatcacagaacagtgttgtctccacctggccttagatggcacgccatgattcgggcctggatagactgcctgcgtccttaccactgatctggccaagaatgaggccctcccaacactttcactccctctccaagccttgatgggacctccacttatttaggcctcatgtgctttgaagaagctttgagagccaatgtgtcttccacgggtctcttttttgctacaagtaatcagccccatgtgttctcttaaactgagaattgcacctgggcaattcctgttttctaaggtggtctctgctgctatttaacaacccagagtaggcctctgtgaggcttcagtggcctcagaaaccagagggtccagatagggggcctgcttgggccctctgctgccaactgctcaaacctgctttagctccagccacttgtggcaaacaacctcgtttccttacaaattccagcatgtgactttggtgccgttacttgtgaaaaatctattctgttgtctttgatgtgtccaagaaaattcgtgtagtttacgtaaaaatatctgactcacaagaaagccaactgtatgtcttgtgatgggacagttcataatgtagttgctagaccactttacaaattgttcttgtcaccagatgtgttcagacattgctgtgcaattgttggggagggtagggggaaaggcgagaggagatacttattggtctttttgtttaataccttccccaagaggggacagtctggccaacttgctccagtaatgcaataaagacattgcaataaagtaaaaaaaaaa

SEQ ID NO: 456398 - DNA, 4956 bp, Homo sapiens
accattctgattgaggctgggggagagcgcggatggctgattggggagccgaagcctagagagcggtggggagacgtgaaagtcgagatggagagcagctttttgaacatgttctcaggcacttgacagaatcccgctcttccaccaaagccacctaagccaatgacttcagcagttccaaatggaatgaaggacagttctgtttctcttcaggatgcagaatggtactggggggatatttcaagggaggaggtaaatgacaaattgcgggatatgccagatgggaccttcttggtccgagatgcctcaacaaaaatgcagggagattatactttgactttgcggaagggaggcaataataagttaataaagatctatcaccgggatggtaaatatggcttttctgatcctctgacatttaattccgtggtggagctcattaaccactatcaccatgaatctcttgctcagtacaatcccaaacttgatgtgaagctgatgtacccagtgtccagataccaacaggatcagttggtaaaagaagataatattgatgcagtaggtaaaaaactgcaagaataccactctcagtatcaggagaagagtaaagagtatgataggctgtatgaagaatatactagaacatcccaggaaatacagatgaagaggactgcaatagaagcttttaatgaaacaattaaaatatttgaagagcagtgtcacacacaagaacaacatagcaaagaatatattgagcgatttcgcagagaggggaatgaaaaggagattgaacgaattatgatgaattatgataaattgaaatcacgtctgggtgagattcatgatagcaaaatgcgtctagagcaggatttgaagaaacaagctttggacaaccgagaaatagataaaaaaatgaatagtatcaaacctgacctgatccagctgcgaaagatccgagatcaacaccttgtatggctcaatcacaaaggagtgagacagaaacgcctgaatgtctggctgggaattaagaatgaggatgctgatgagaactattttatcaatgaggaagatgaaaacctgccccattatgatgagaaaacctggtttgttgaggatatcaatcgagtacaagcagaggacttgctttatgggaaacctgatggtgcattcttaattcgtgagagtagcaagaaaggatgctatgcttgctctgtggtggccgatggggaagtgaagcactgtgtgatctacagcactgctcggggctatggctttgcagagccctacaacctgtacagctctctgaaggagctagtgctccattaccagcagacatccttggttcagcacaacgactccctcaacgtcaggcttgcctaccctgttcatgcacagatgccctcgctttgcagataaagaggaagtgggaagagaggtggttctctggcatttttttctacagtttttattagactacgatgagggcattctttctacatagactgcttgttttgcacaagaagtgattttgtgaatgtgaagtggagaggccgagcagcagccggccgggatgggggcattagaggcctgaggttctctaggactcagccatgccgctgcactgacatactaagctggaagcagatgttttttttgaaagtctgtttcattggggtttttgttttgtttagccagacaccctcaacagaatattaggcttgatggttatagcgggtggggttgtatttggaagcctctgaagagaccatgtctttttaaaatctaactcttgagagtgcagcaggggcatggctctgctgggagttgtgttttgctttggcagtctctcttccccccacgaagaaggctgtttaggttttgtgatagaatgggatttgatgaaaaagacaaccaaaggaaaatggggaggcttgggatttcatttaaataatctaagccaagatgataaaaaaaaccttcaactgaaggtactttgtttcttaccaacataatttaggcttcagcatctcaccagcccctccctctgaagaagtattatgttcagaagccaacaaaacagtttgttgccagaccaatgtttgatgggaaaacgtggcactcatagttgaatgtatacttctgtaccaaaacttgaacataaaagactagaatttgtgagttttagcaaacgctaaaattgatcactgtaactaaccccttctgtccttcctgcctgtttctctgagatgaggaatagcattctttttgtggggatggtgagctttgaatcataaaatgaagttggtgcttgtatggtgtttccttagcctaaagaatgatctgttgtttgaaacctttgtaacttgtttgtatgagtaaagaaaaggtgcaatgcagtgcttttagatggcttgatataccaaataacaatatagaacaacattattatatgtgcttccccaagtttaaaggccctgcagaaatagtaaacatggtttaatttcccttcatttccccctcctttgctggatggggttttgggagctataggttgctaaggaggggagtcagattgtggtcaggtgcctcagtaaatcacagacccaggggccctgtggtccagggtgagagtcacaccacattacacatgtgcttccatacagtggtttctgaagcttttgcagggagagaagatggcttagtgtttagactgttagtagaagccatctggaagcttttctctttgcctttttttgtgatcctgccattaaggctatgtgcagtctgccctcctgctccagtggccttgattttaggccaggaatcttctgctccatgtggcttaagccttccagctgagtgaagctaggcaaatggagtgggggcaggcatctattcctgcccccatcatgccccacacccatcagtcaacactcatttgacaaatagagtccagctgcctctgagccaatcctgggaccataataggctcagagtgagtcagctgtttgaacccaaagctgtgcagtcaggcaccctggctgagctagagaagccagtacctgcatcttggtttataaggcttacagctaggaaagctctagttctgggggtgaaagaaaaatattagtttacctgagcacttatttccatgacagggtctaaaatatggaccatgatgtagacacagatttttaattttggaaaaacctccagttactagtgacgaggatagaaagggaagtgcttctctttggctttttcttggttacactgcagtttcaggattgggtgagacagagacaaatgaacccccctctaaagtcatttaactaatagccagcacatcccttccccaaactgtcaattgaaatcttaactgaaagttttactgaataataccaagctaattgctgttgggcacacctggatggctttgcacctggtgttgaacctgctgaagcaggtggatgctcaagattacgtgcaaggaatccctcccatctggtactaaaatttcagtgtgttctgagtgtcttttaaaccaaaatggaaatacagatacagggctgtagtattcagtaatgtgtctgctccttgttgggcagacaccagcggtgtgcagggagagaccaagtaccatctttatctacacttgggctggcttgtggagaagggctgctttttttcagtcctacattccttcattttttttttcattcttgaattcattgttttgtgggatctaagacccaggggtcatttgagaggtttgacagtatcttttctgaccagttgccacatgacttgcttgaccctgagcctgtggaaatggcatagggaccagtctactacccactgggcctggtgtgtagagggggagagggtagcaaggtgcttctctacgcccatgacttgggagcaggtcttggcctccttcatgagagtctagtgccatgtcctgtcccatgatctggaccctgggactgtcttggcatcttaactgcagtttcaatgaggcagagggcaaagagagaccaagatcagaggggttcattatacccctggctagagaacccagctactgacatgcaagcagcttggggctggctggacacaggtactaggcccattgtttccaggtgaagctttcatcacagaacagtgttgtctccacctggccttagatggcacgccatgattcgggcctggatagactgcctgcgtccttaccactgatctggccaagaatgaggccctcccaacactttcactccctctccaagccttgatgggacctccacttatttaggcctcatgtgctttgaagaagctttgagagccaatgtgtcttccacgggtctcttttttgctacaagtaatcagccccatgtgttctcttaaactgagaattgcacctgggcaattcctgttttctaaggtggtctctgctgctatttaacaacccagagtaggcctctgtgaggcttcagtggcctcagaaaccagagggtccagatagggggcctgcttgggccctctgctgccaactgctcaaacctgctttagctccagccacttgtggcaaacaacctcgtttccttacaaattccagcatgtgactttggtgccgttacttgtgaaaaatctattctgttgtctttgatgtgtccaagaaaattcgtgtagtttacgtaaaaatatctgactcacaagaaagccaactgtatgtcttgtgatgggacagttcataatgtagttgctagaccactttacaaattgttcttgtcaccagatgtgttcagacattgctgtgcaattgttggggagggtagggggaaaggcgagaggagatacttattggtctttttgtttaataccttccccaagaggggacagtctggccaacttgctccagtaatgcaataaagacattgcaataaagtaaaaaaaaaa

SEQ ID NO: 456399 - DNA, 3020 bp, Homo sapiens
actttcctgccccttccccggccaagcccaactccggatctcgctctccaccggatctcacccgccacacccggacaggcggctggaggaggcgggcgtctaaaattctgggaagcagaacctggccggagccactagacagagccgggcctagcccagagacatggagagttgctacaacccaggtctggatggtattattgaatatgatgatttcaaattgaactcctccattgtggaacccaaggagccagccccagaaacagctgatggcccctacctggtgatcgtggaacagcctaagcagagaggcttccgatttcgatatggctgtgaaggcccctcccatggaggactgcccggtgcctccagtgagaagggccgaaagacctatcccactgtcaagatctgtaactacgagggaccagccaagatcgaggtggacctggtaacacacagtgacccacctcgtgctcatgcccacagtctggtgggcaagcaatgctcggagctggggatctgcgccgtttctgtggggcccaaggacatgactgcccaatttaacaacctgggtgtcctgcatgtgactaagaagaacatgatggggactatgatacaaaaacttcagaggcagcggctccgctctaggccccagggccttacggaggccgagcagcgggagctggagcaagaggccaaagaactgaagaaggtgatggatctgagtatagtgcggctgcgcttctctgccttccttagagccagtgatggctccttctccctgcccctgaagccagtcatctcccagcccatccatgacagcaaatctccgggggcatcaaacctgaagatttctcgaatggacaagacagcaggctctgtgcggggtggagatgaagtttatctgctttgtgacaaggtgcagaaagatgacattgaggttcggttctatgaggatgatgagaatggatggcaggcctttggggacttctctcccacagatgtgcataaacagtatgccattgtgttccggacacccccctatcacaagatgaagattgagcggcctgtaacagtgtttctgcaactgaaacgcaagcgaggaggggacgtgtctgattccaaacagttcacctattaccctctggtggaagacaaggaagaggtgcagcggaagcggaggaaggccttgcccaccttctcccagcccttcgggggtggctcccacatgggtggaggctctgggggtgcagccgggggctacggaggagctggaggaggtggcagcctcggtttcttcccctcctccctggcctacagcccctaccagtccggcgcgggccccatgggctgctacccgggaggcgggggcggggcgcagatggccgccacggtgcccagcagggactccggggaggaagccgcggagccgagcgccccctccaggaccccccagtgcgagccgcaggccccggagatgctgcagcgagctcgagagtacaacgcgcgcctgttcggcctggcgcagcgcagcgcccgagccctactcgactacggcgtcaccgcggacgcgcgcgcgctgctggcgggacagcgccacctgctgacggcgcaggacgagaacggagacacaccactgcacctagccatcatccacgggcagaccagtgtcattgagcagatagtctatgtcatccaccacgcccaggacctcggcgttgtcaacctcaccaaccacctgcaccagacgcccctgcacctggcggtgatcacggggcagacgagtgtggtgagctttctgctgcgggtaggtgcagacccagctctgctggatcggcatggagactcagccatgcatctggcgctgcgggcaggcgctggtgctcctgagctgctgcgtgcactgcttcagagtggagctcctgctgtgccccagctgttgcatatgcctgactttgagggactgtatccagtacacctggcggtccgagcccgaagccctgagtgcctggatctgctggtggacagtggggctgaagtggaggccacagagcggcaggggggacgaacagccttgcatctagccacagagatggaggagctggggttggtcacccatctggtcaccaagctccgggccaacgtgaacgctcgcacctttgcgggaaacacacccctgcacctggcagctggactggggtacccgaccctcacccgcctccttctgaaggctggtgctgacatccatgctgaaaacgaggagcccctgtgcccactgccttcaccccctacctctgatagcgactcggactctgaagggcctgagaaggacacccgaagcagcttccggggccacacgcctcttgacctcacttgcagcaccaaggtgaagaccttgctgctaaatgctgctcagaacaccatggagccacccctgaccccgcccagcccagcagggccgggactgtcacttggtgatacagctctgcagaacctggagcagctgctagacgggccagaagcccagggcagctgggcagagctggcagagcgtctggggctgcgcagcctggtagacacgtaccgacagacaacctcacccagtggcagcctcctgcgcagctacgagctggctggcggggacctggcaggtctactggaggccctgtctgacatgggcctagaggagggagtgaggctgctgaggggtccagaaacccgagacaagctgcccagcacagaggtgaaggaagacagtgcgtacgggagccagtcagtggagcaggaggcagagaagctgggcccaccccctgagccaccaggagggctctgccacgggcacccccagcctcaggtgcactgacctgctgcctgcccccagcccccttcccggaccccctgtacagcgtccccacctatttcaaatcttatttaacaccccacacccacccctcagttgggacaaataaaggattctcatgggaaggggaggacccctccttcccaacttaaaaaaaccc

SEQ ID NO: 456400 - DNA, 1637 bp, Homo sapiens
actttcctgccccttccccggccaagcccaactccggatctcgctctccaccggatctcacccgccacacccggacaggcggctggaggaggcgggcgtctaaaattctgggaagcagaacctggccggagccactagacagagccgggcctagcccagagacatggagagttgctacaacccaggtctggatggtattattgaatatgatgatttcaaattgaactcctccattgtggaacccaaggagccagccccagaaacagctgatggcccctacctggtgatcgtggaacagcctaagcagagaggcttccgatttcgatatggctgtgaaggcccctcccatggaggactgcccggtgcctccagtgagaagggccgaaagacctatcccactgtcaagatctgtaactacgagggaccagccaagatcgaggtggacctggtaacacacagtgacccacctcgtgctcatgcccacagtctggtgggcaagcaatgctcggagctggggatctgcgccgtttctgtggggcccaaggacatgactgcccaatttaacaacctgggtgtcctgcatgtgactaagaagaacatgatggggactatgatacaaaaacttcagaggcagcggctccgctctaggccccagggccttacggaggccgagcagcgggagctggagcaagaggccaaagaactgaagaaggtgatggatctgagtatagtgcggctgcgcttctctgccttccttagagccagtgatggctccttctccctgcccctgaagccagtcatctcccagcccatccatgacagcaaatctccgggggcatcaaacctgaagatttctcgaatggacaagacagcaggctctgtgcggggtggagatgaagtttatctgctttgtgacaaggtgcagaaagatgacattgaggttcggttctatgaggatgatgagaatggatggcaggcctttggggacttctctcccacagatgtgcataaacagtatgccattgtgttccggacacccccctatcacaagatgaagattgagcggcctgtaacagtgtttctgcaactgaaacgcaagcgaggaggggacgtgtctgattccaaacagttcacctattaccctctggtggaagacaaggaagaggtgcagcggaagcggaggaaggccttgcccaccttctcccagcccttcgggggtggctcccacatgggtggaggctctgggggtgcagccgggggctacggaggagctggaggaggtgagggggtactgatggagggaggggtaaaggtaagagaagctgtggaggaaaaaaatctgggggaggccgggcgtggtggctcacgcctgtaatccagccctttgggaggccaaggcaggcagattacctgagatcaggagttcaagaccagcttggccaacagcgtgaaacctcgtctctactaaaaatacaaacattagctgggcatggtggcaggcgcctgtaatcccagctactcgggaggctgaggcaggagaatcgcttgaaccctgggagacaagaggttgcagtaagctgagatcacaccactgcactccaggctgggcaataagagcgaaactccgtctcaaaaaa

SEQ ID NO: 456401 - DNA, 3140 bp, Homo sapiens
  misc_feature (4)..(4): n is a, c, g, or t
ggcncggagagaagccgcaaccagagccgccgccacggtgagtggctggattcagacccctgggtggccgggacaagagaaaagagggaggagggcctttagcggacagcgcctggggctggagagcagcagctgcacacagccggaaagggcgcgcaggcgacgacactcggatccacgtcgacaccgttgtacaaagatacgcggacccgcgggcgtctaaaattctgggaagcagaacctggccggagccactagacagagccgggcctagcccagagacatggagagttgctacaacccaggtctggatggtattattgaatatgatgatttcaaattgaactcctccattgtggaacccaaggagccagccccagaaacagctgatggcccctacctggtgatcgtggaacagcctaagcagagaggcttccgatttcgatatggctgtgaaggcccctcccatggaggactgcccggtgcctccagtgagaagggccgaaagacctatcccactgtcaagatctgtaactacgagggaccagccaagatcgaggtggacctggtaacacacagtgacccacctcgtgctcatgcccacagtctggtgggcaagcaatgctcggagctggggatctgcgccgtttctgtggggcccaaggacatgactgcccaatttaacaacctgggtgtcctgcatgtgactaagaagaacatgatggggactatgatacaaaaacttcagaggcagcggctccgctctaggccccagggccttacggaggccgagcagcgggagctggagcaagaggccaaagaactgaagaaggtgatggatctgagtatagtgcggctgcgcttctctgccttccttagagccagtgatggctccttctccctgcccctgaagccagtcatctcccagcccatccatgacagcaaatctccgggggcatcaaacctgaagatttctcgaatggacaagacagcaggctctgtgcggggtggagatgaagtttatctgctttgtgacaaggtgcagaaagatgacattgaggttcggttctatgaggatgatgagaatggatggcaggcctttggggacttctctcccacagatgtgcataaacagtatgccattgtgttccggacacccccctatcacaagatgaagattgagcggcctgtaacagtgtttctgcaactgaaacgcaagcgaggaggggacgtgtctgattccaaacagttcacctattaccctctggtggaagacaaggaagaggtgcagcggaagcggaggaaggccttgcccaccttctcccagcccttcgggggtggctcccacatgggtggaggctctgggggtgcagccgggggctacggaggagctggaggaggtggcagcctcggtttcttcccctcctccctggcctacagcccctaccagtccggcgcgggccccatgggctgctacccgggaggcgggggcggggcgcagatggccgccacggtgcccagcagggactccggggaggaagccgcggagccgagcgccccctccaggaccccccagtgcgagccgcaggccccggagatgctgcagcgagctcgagagtacaacgcgcgcctgttcggcctggcgcagcgcagcgcccgagccctactcgactacggcgtcaccgcggacgcgcgcgcgctgctggcgggacagcgccacctgctgacggcgcaggacgagaacggagacacaccactgcacctagccatcatccacgggcagaccagtgtcattgagcagatagtctatgtcatccaccacgcccaggacctcggcgttgtcaacctcaccaaccacctgcaccagacgcccctgcacctggcggtgatcacggggcagacgagtgtggtgagctttctgctgcgggtaggtgcagacccagctctgctggatcggcatggagactcagccatgcatctggcgctgcgggcaggcgctggtgctcctgagctgctgcgtgcactgcttcagagtggagctcctgctgtgccccagctgttgcatatgcctgactttgagggactgtatccagtacacctggcggtccgagcccgaagccctgagtgcctggatctgctggtggacagtggggctgaagtggaggccacagagcggcaggggggacgaacagccttgcatctagccacagagatggaggagctggggttggtcacccatctggtcaccaagctccgggccaacgtgaacgctcgcacctttgcgggaaacacacccctgcacctggcagctggactggggtacccgaccctcacccgcctccttctgaaggctggtgctgacatccatgctgaaaacgaggagcccctgtgcccactgccttcaccccctacctctgatagcgactcggactctgaagggcctgagaaggacacccgaagcagcttccggggccacacgcctcttgacctcacttgcagcaccaaggtgaagaccttgctgctaaatgctgctcagaacaccatggagccacccctgaccccgcccagcccagcagggccgggactgtcacttggtgatacagctctgcagaacctggagcagctgctagacgggccagaagcccagggcagctgggcagagctggcagagcgtctggggctgcgcagcctggtagacacgtaccgacagacaacctcacccagtggcagcctcctgcgcagctacgagctggctggcggggacctggcaggtctactggaggccctgtctgacatgggcctagaggagggagtgaggctgctgaggggtccagaaacccgagacaagctgcccagcacagaggtgaaggaagacagtgcgtacgggagccagtcagtggagcaggaggcagagaagctgggcccaccccctgagccaccaggagggctctgccacgggcacccccagcctcaggtgcactgacctgctgcctgcccccagcccccttcccggaccccctgtacagcgtccccacctatttcaaatcttatttaacaccccacacccacccctcagttgggacaaataaaggattctcatgggaaggggaggacccctccttcccaacttaaaaaaaccc

SEQ ID NO: 456402 - DNA, 2874 bp, Homo sapiens
  misc_feature (4)..(4): n is a, c, g, or t
ggcncggagagaagccgcaaccagagccgccgccacggcgggcgtctaaaattctgggaagcagaacctggccggagccactagacagagccgggcctagcccagagacatggagagttgctacaacccaggtctggatggtattattgaatatgatgatttcaaattgaactcctccattgtggaacccaaggagccagccccagaaacagctgatggcccctacctggtgatcgtggaacagcctaagcagagaggcttccgatttcgatatggctgtgaaggcccctcccatggaggactgcccggtgcctccagtgagaagggccgaaagacctatcccactgtcaagatctgtaactacgagggaccagccaagatcgaggtggacctggtaacacacagtgacccacctcgtgctcatgcccacagtctggtgggcaagcaatgctcggagctggggatctgcgccgtttctgtggggcccaaggacatgactgcccaatttaacaacctgggtgtcctgcatgtgactaagaagaacatgatggggactatgatacaaaaacttcagaggcagcggctccgctctaggccccagggccttacggaggccgagcagcgggagctggagcaagaggccaaagaactgaagaaggtgatggatctgagtatagtgcggctgcgcttctctgccttccttagagccagtgatggctccttctccctgcccctgaagccagtcatctcccagcccatccatgacagcaaatctccgggggcatcaaacctgaagatttctcgaatggacaagacagcaggctctgtgcggggtggagatgaagtttatctgctttgtgacaaggtgcagaaagatgacattgaggttcggttctatgaggatgatgagaatggatggcaggcctttggggacttctctcccacagatgtgcataaacagtatgccattgtgttccggacacccccctatcacaagatgaagattgagcggcctgtaacagtgtttctgcaactgaaacgcaagcgaggaggggacgtgtctgattccaaacagttcacctattaccctctggtggaagacaaggaagaggtgcagcggaagcggaggaaggccttgcccaccttctcccagcccttcgggggtggctcccacatgggtggaggctctgggggtgcagccgggggctacggaggagctggaggaggtggcagcctcggtttcttcccctcctccctggcctacagcccctaccagtccggcgcgggccccatgggctgctacccgggaggcgggggcggggcgcagatggccgccacggtgcccagcagggactccggggaggaagccgcggagccgagcgccccctccaggaccccccagtgcgagccgcaggccccggagatgctgcagcgagctcgagagtacaacgcgcgcctgttcggcctggcgcagcgcagcgcccgagccctactcgactacggcgtcaccgcggacgcgcgcgcgctgctggcgggacagcgccacctgctgacggcgcaggacgagaacggagacacaccactgcacctagccatcatccacgggcagaccagtgtcattgagcagatagtctatgtcatccaccacgcccaggacctcggcgttgtcaacctcaccaaccacctgcaccagacgcccctgcacctggcggtgatcacggggcagacgagtgtggtgagctttctgctgcgggtaggtgcagacccagctctgctggatcggcatggagactcagccatgcatctggcgctgcgggcaggcgctggtgctcctgagctgctgcgtgcactgcttcagagtggagctcctgctgtgccccagctgttgcatatgcctgactttgagggactgtatccagtacacctggcggtccgagcccgaagccctgagtgcctggatctgctggtggacagtggggctgaagtggaggccacagagcggcaggggggacgaacagccttgcatctagccacagagatggaggagctggggttggtcacccatctggtcaccaagctccgggccaacgtgaacgctcgcaccttttcagcctcctgagtagctgggaccacaggcaagcgccaccacgccagctgattttttaatttcgtgtacagatggggtctcaccgtgtagcccagtctggtctcgaactcctaggctcaagtgatcctcctgcctcggcctcccaaagtgctggattacaagcgtgctgcgccaccgcgcccagcccagtatggcttttgtgtgtggctttcttcactcaatattctatatgtaagattcatccatcatgtaatttatttttcttttattgctgagtattattacattggatattacaactttttctagtcttaatggacatttatattttcaactttgcctgttataaataatgctgctatgaatattcttctgcatgtcttttgaaggaactgtgcactaatttttccagggaatattcttaggagtaggattgctatcatagggcaggtgaatatttaattttggcagatattgccaaacagattcccaaagtagtcctaatttacacacccaccagcagtgtgtgacagtccagtttcctacacattctcacaaacatttttaattttaaggcattgtggtgggtgtttagtgtaacttccttgtgtttgaatttgcatctccttgatgagtaagcaccttttcatatacgtattaagccatttgaaatatcctctttgaagaagttcccgtccatggtttttgcccatttgttatgggtttatctttttttctgttttctggttcattataattccaggtat

SEQ ID NO: 456403 - DNA, 3053 bp, Homo sapiens
  misc_feature (4)..(4): n is a, c, g, or t
ggcncggagagaagccgcaaccagagccgccgccacggcgggcgtctaaaattctgggaagcagaacctggccggagccactagacagagccgggcctagcccagagacatggagagttgctacaacccaggtctggatggtattattgaatatgatgatttcaaattgaactcctccattgtggaacccaaggagccagccccagaaacagctgatggcccctacctggtgatcgtggaacagcctaagcagagaggcttccgatttcgatatggctgtgaaggcccctcccatggaggactgcccggtgcctccagtgagaagggccgaaagacctatcccactgtcaagatctgtaactacgagggaccagccaagatcgaggtggacctggtaacacacagtgacccacctcgtgctcatgcccacagtctggtgggcaagcaatgctcggagctggggatctgcgccgtttctgtggggcccaaggacatgactgcccaatttaacaacctgggtgtcctgcatgtgactaagaagaacatgatggggactatgatacaaaaacttcagaggcagcggctccgctctaggccccagggccttacggaggccgagcagcgggagctggagcaagaggccaaagaactgaagaaggtgatggatctgagtatagtgcggctgcgcttctctgccttccttagagccagtgatggctccttctccctgcccctgaagccagtcatctcccagcccatccatgacagcaaatctccgggggcatcaaacctgaagatttctcgaatggacaagacagcaggctctgtgcggggtggagatgaagtttatctgctttgtgacaaggtgcagaaagatgacattgaggttcggttctatgaggatgatgagaatggatggcaggcctttggggacttctctcccacagatgtgcataaacaggtacccagggctagggcccgggcccgggctgggggctaaattaggctaaggactcactgacaccctgtgtctccctgcaccccccagtatgccattgtgttccggacacccccctatcacaagatgaagattgagcggcctgtaacagtgtttctgcaactgaaacgcaagcgaggaggggacgtgtctgattccaaacagttcacctattaccctctggtggaagacaaggaagaggtgcagcggaagcggaggaaggccttgcccaccttctcccagcccttcgggggtggctcccacatgggtggaggctctgggggtgcagccgggggctacggaggagctggaggaggtggcagcctcggtttcttcccctcctccctggcctacagcccctaccagtccggcgcgggccccatgggctgctacccgggaggcgggggcggggcgcagatggccgccacggtgcccagcagggactccggggaggaagccgcggagccgagcgccccctccaggaccccccagtgcgagccgcaggccccggagatgctgcagcgagctcgagagtacaacgcgcgcctgttcggcctggcgcagcgcagcgcccgagccctactcgactacggcgtcaccgcggacgcgcgcgcgctgctggcgggacagcgccacctgctgacggcgcaggacgagaacggagacacaccactgcacctagccatcatccacgggcagaccagtgtcattgagcagatagtctatgtcatccaccacgcccaggacctcggcgttgtcaacctcaccaaccacctgcaccagacgcccctgcacctggcggtgatcacggggcagacgagtgtggtgagctttctgctgcgggtaggtgcagacccagctctgctggatcggcatggagactcagccatgcatctggcgctgcgggcaggcgctggtgctcctgagctgctgcgtgcactgcttcagagtggagctcctgctgtgccccagctgttgcatatgcctgactttgagggactgtatccagtacacctggcggtccgagcccgaagccctgagtgcctggatctgctggtggacagtggggctgaagtggaggccacagagcggcaggggggacgaacagccttgcatctagccacagagatggaggagctggggttggtcacccatctggtcaccaagctccgggccaacgtgaacgctcgcacctttgcgggaaacacacccctgcacctggcagctggactggggtacccgaccctcacccgcctccttctgaaggctggtgctgacatccatgctgaaaacgaggagcccctgtgcccactgccttcaccccctacctctgatagcgactcggactctgaagggcctgagaaggacacccgaagcagcttccggggccacacgcctcttgacctcacttgcagcaccaaggtgaagaccttgctgctaaatgctgctcagaacaccatggagccacccctgaccccgcccagcccagcagggccgggactgtcacttggtgatacagctctgcagaacctggagcagctgctagacgggccagaagcccagggcagctgggcagagctggcagagcgtctggggctgcgcagcctggtagacacgtaccgacagacaacctcacccagtggcagcctcctgcgcagctacgagctggctggcggggacctggcaggtctactggaggccctgtctgacatgggcctagaggagggagtgaggctgctgaggggtccagaaacccgagacaagctgcccagcacagaggtgaaggaagacagtgcgtacgggagccagtcagtggagcaggaggcagagaagctgggcccaccccctgagccaccaggagggctctgccacgggcacccccagcctcaggtgcactgacctgctgcctgcccccagcccccttcccggaccccctgtacagcgtccccacctatttcaaatcttatttaacaccccacacccacccctcagttgggacaaataaaggattctcatgggaaggggaggacccctccttcccaacttaaaaaaaccc

SEQ ID NO: 456404 - DNA, 1969 bp, Homo sapiens
  misc_feature (4)..(4): n is a, c, g, or t
ggcncggagagaagccgcaaccagagccgccgccacggcgggcgtctaaaattctgggaagcagaacctggccggagccactagacagagccgggcctagcccagagacatggagagttgctacaacccaggtctggatggtattattgaatatgatgatttcaaattgaactcctccattgtggaacccaaggagccagccccagaaacagctgatggcccctacctggtgatcgtggaacagcctaagcagagaggcttccgatttcgatatggctgtgaaggcccctcccatggaggactgcccggtgcctccagtgagaagggccgaaagacctatcccactgtcaagatctgtaactacgagggaccagccaagatcgaggtggacctggtaacacacagtgacccacctcgtgctcatgcccacagtctggtgggcaagcaatgctcggagctggggatctgcgccgtttctgtggggcccaaggacatgactgcccaatttaacaacctgggtgtcctgcatgtgactaagaagaacatgatggggactatgatacaaaaacttcagaggcagcggctccgctctaggccccagggccttacggaggccgagcagcgggagctggagcaagaggccaaagaactgaagaaggtgatggatctgagtatagtgcggctgcgcttctctgccttccttagagccagtgatggctccttctccctgcccctgaagccagtcatctcccagcccatccatgacagcaaatctccgggggcatcaaacctgaagatttctcgaatggacaagacagcaggctctgtgcggggtggagatgaagtttatctgctttgtgacaaggtgcagaaagatgacattgaggttcggttctatgaggatgatgagaatggatggcaggcctttggggacttctctcccacagatgtgcataaacagtatgccattgtgttccggacacccccctatcacaagatgaagattgagcggcctgtaacagtgtttctgcaactgaaacgcaagcgaggaggggacgtgtctgattccaaacagttcacctattaccctctggtggaagacaaggaagaggtgcagcggaagcggaggaaggccttgcccaccttctcccagcccttcgggggtggctcccacatgggtggaggctctgggggtgcagccgggggctacggaggagctggaggaggtggcagcctcggtttcttcccctcctccctggcctacagcccctaccagtccggcgcgggccccatgggctgctacccgggaggcgggggcggggcgcagatggccgccacggtgcccagcagggactccggggaggaagccgcggagccgagcgccccctccaggaccccccagtgcgagccgcaggccccggagatgctgcagcgagctcgagagtacaacgcgcgcctgttcggcctggcgcagcgcagcgcccgagccctactcgactacggcgtcaccgcggacgcgcgcgcgctgctggcgggacagcgccacctgctgacggcgcaggacgagaacggagacacctggctggcggggacctggcaggtctactggaggccctgtctgacatgggcctagaggagggagtgaggctgctgaggggtccagaaacccgagacaagctgcccagcacagaggtgaaggaagacagtgcgtacgggagccagtcagtggagcaggaggcagagaagctgggcccaccccctgagccaccaggagggctctgccacgggcacccccagcctcaggtgcactgacctgctgcctgcccccagcccccttcccggaccccctgtacagcgtccccacctatttcaaatcttatttaacaccccacacccacccctcagttgggacaaataaaggattctcatgggaaggggaggacccctccttcccaacttaaaaaaaccc

SEQ ID NO: 456405 - DNA, 1301 bp, Homo sapiens
  misc_feature (4)..(4): n is a, c, g, or t
ggcncggagagaagccgcaaccagagccgccgccacggcgggcgtctaaaattctgggaagcagaacctggccggagccactagacagagccgggcctagcccagagacatggagagttgctacaacccaggtctggatggtattattgaatatgatgatttcaaattgaactcctccattgtggaacccaaggagccagccccagaaacagctgatggcccctacctggtgatcgtggaacagcctaagcagagaggcttccgatttcgatatggctgtgaaggcccctcccatggaggactgcccggtgcctccagtgagaagggccgaaagacctatcccactgtcaagatctgtaactacgagggaccagccaagatcgaggtggacctggtaacacacagtgacccacctcgtgctcatgcccacagtctggtgggcaagcaatgctcggagctggggatctgcgccgtttctgtggggcccaaggacatgactgcccaatttaacaacctgggtgtcctgcatgtgactaagaagaacatgatggggactatgatacaaaaacttcagaggcagcggctccgctctaggccccagggccttacggaggccgagcagcgggagctggagcaagaggccaaagaactgaagaaggtgatggatctgagtatagtgcggctgcgcttctctgccttccttagagccagtgatggctccttctccctgcccctgaagccagtcatctcccagcccatccatgacagcaaatctccgggggcatcaaacctgaagatttctcgaatggacaagacagcaggctctgtgcggggtggagatgaagtttatctgctttgtgacaaggtgcagaaagatgacattgaggttcggttctatgaggatgatgagaatggatggcaggcctttggggacttctctcccacagatgtgcataaacagtatgccattgtgttccggacacccccctatcacaagatgaagattgagcggcctgtaacagtgtttctgcaactgaaacgcaagcgaggaggggacgtgtctgattccaaacagttcacctattaccctctggtggaagacaaggaagaggtgcagcggaagcggaggaaggccttgcccaccttctcccagcccttcgggggtggctcccggaccccctgtacagcgtccccacctatttcaaatcttatttaacaccccacacccacccctcagttgggacaaataaaggattctcatgggaaggggaggacccctccttcccaacttaaaaaaaccc

SEQ ID NO: 456406 - DNA, 2966 bp, Homo sapiens
  misc_feature (4)..(4): n is a, c, g, or t
ggcncggagagaagccgcaaccagagccgccgccacggcgggcgtctaaaattctgggaagcagaacctggccggagccactagacagagccgggcctagcccagagacatggagagttgctacaacccaggtctggatggtattattgaatatgatgatttcaaattgaactcctccattgtggaacccaaggagccagccccagaaacagctgatggcccctacctggtgatcgtggaacagcctaagcagagaggcttccgatttcgatatggctgtgaaggcccctcccatggaggactgcccggtgcctccagtgagaagggccgaaagacctatcccactgtcaagatctgtaactacgagggaccagccaagatcgaggtggacctggtaacacacagtgacccacctcgtgctcatgcccacagtctggtgggcaagcaatgctcggagctggggatctgcgccgtttctgtggggcccaaggacatgactgcccaatttaacaacctgggtgtcctgcatgtgactaagaagaacatgatggggactatgatacaaaaacttcagaggcagcggctccgctctaggccccagggccttacggaggccgagcagcgggagctggagcaagaggccaaagaactgaagaaggtgatggatctgagtatagtgcggctgcgcttctctgccttccttagagccagtgatggctccttctccctgcccctgaagccagtcatctcccagcccatccatgacagcaaatctccgggggcatcaaacctgaagatttctcgaatggacaagacagcaggctctgtgcggggtggagatgaagtttatctgctttgtgacaaggtgcagaaagatgacattgaggttcggttctatgaggatgatgagaatggatggcaggcctttggggacttctctcccacagatgtgcataaacagtatgccattgtgttccggacacccccctatcacaagatgaagattgagcggcctgtaacagtgtttctgcaactgaaacgcaagcgaggaggggacgtgtctgattccaaacagttcacctattaccctctggtggaagacaaggaagaggtgcagcggaagcggaggaaggccttgcccaccttctcccagcccttcgggggtggctcccacatgggtggaggctctgggggtgcagccgggggctacggaggagctggaggaggtggcagcctcggtttcttcccctcctccctggcctacagcccctaccagtccggcgcgggccccatgggctgctacccgggaggcgggggcggggcgcagatggccgccacggtgcccagcagggactccggggaggaagccgcggagccgagcgccccctccaggaccccccagtgcgagccgcaggccccggagatgctgcagcgagctcgagagtacaacgcgcgcctgttcggcctggcgcagcgcagcgcccgagccctactcgactacggcgtcaccgcggacgcgcgcgcgctgctggcgggacagcgccacctgctgacggcgcaggacgagaacggagacacaccactgcacctagccatcatccacgggcagaccagtgtcattgagcagatagtctatgtcatccaccacgcccaggacctcggcgttgtcaacctcaccaaccacctgcaccagacgcccctgcacctggcggtgatcacggggcagacgagtgtggtgagctttctgctgcgggtaggtgcagacccagctctgctggatcggcatggagactcagccatgcatctggcgctgcgggcaggcgctggtgctcctgagctgctgcgtgcactgcttcagagtggagctcctgctgtgccccagctgttgcatatgcctgactttgagggactgtatccagtacacctggcggtccgagcccgaagccctgagtgcctggatctgctggtggacagtggggctgaagtggaggccacagagcggcaggggggacgaacagccttgcatctagccacagagatggaggagctggggttggtcacccatctggtcaccaagctccgggccaacgtgaacgctcgcacctttgcgggaaacacacccctgcacctggcagctggactggggtacccgaccctcacccgcctccttctgaaggctggtgctgacatccatgctgaaaacgaggagcccctgtgcccactgccttcaccccctacctctgatagcgactcggactctgaagggcctgagaaggacacccgaagcagcttccggggccacacgcctcttgacctcacttgcagcaccaaggtgaagaccttgctgctaaatgctgctcagaacaccatggagccacccctgaccccgcccagcccagcagggccgggactgtcacttggtgatacagctctgcagaacctggagcagctgctagacgggccagaagcccagggcagctgggcagagctggcagagcgtctggggctgcgcagcctggtagacacgtaccgacagacaacctcacccagtggcagcctcctgcgcagctacgagctggctggcggggacctggcaggtctactggaggccctgtctgacatgggcctagaggagggagtgaggctgctgaggggtccagaaacccgagacaagctgcccagcacagaggtgaaggaagacagtgcgtacgggagccagtcagtggagcaggaggcagagaagctgggcccaccccctgagccaccaggagggctctgccacgggcacccccagcctcaggtgcactgacctgctgcctgcccccagcccccttcccggaccccctgtacagcgtccccacctatttcaaatcttatttaacaccccacacccacccctcagttgggacaaataaaggattctcatgggaaggggaggacccctccttcccaacttaaaaaaaccc

SEQ ID NO: 456407 - DNA, 385 bp, Homo sapiens
  misc_feature (44)..(44): n is a, c, g, or t
gtggtggatggaggtggatttaagattggtccccacatcgtccntgctgatattataaagcagatgcagaggggtccagaaacccgagacaagctgcccagcacagaggtgaaggaagacagtgcgtacgggagccagtcagtggagcaggaggcagagaagctgggcccaccccctgagccaccaggagggctctgccacgggcacccccagcctcaggtgcactgacctgctgcctgcccccagcccccttcccggaccccctgtacagcgtccccacctatttcaaatcttatttaacaccccacacccacccctcagttgggacaaataaaggattctcatgggaaggggaggacccctccttcccaacttaaaaaaaccc

SEQ ID NO: 456408 - DNA, 2677 bp, Homo sapiens
tattcatgacgggccgcggttcactcgtaataatggccctagaccttacaacactagatcaagatctgtaactacgagggaccagccaagatcgaggtggacctggtaacacacagtgacccacctcgtgctcatgcccacagtctggtgggcaagcaatgctcggagctggggatctgcgccgtttctgtggggcccaaggacatgactgcccaatttaacaacctgggtgtcctgcatgtgactaagaagaacatgatggggactatgatacaaaaacttcagaggcagcggctccgctctaggccccagggccttacggaggccgagcagcgggagctggagcaagaggccaaagaactgaagaaggtgatggatctgagtatagtgcggctgcgcttctctgccttccttagagccagtgatggctccttctccctgcccctgaagccagtcatctcccagcccatccatgacagcaaatctccgggggcatcaaacctgaagatttctcgaatggacaagacagcaggctctgtgcggggtggagatgaagtttatctgctttgtgacaaggtgcagaaagatgacattgaggttcggttctatgaggatgatgagaatggatggcaggcctttggggacttctctcccacagatgtgcataaacagtatgccattgtgttccggacacccccctatcacaagatgaagattgagcggcctgtaacagtgtttctgcaactgaaacgcaagcgaggaggggacgtgtctgattccaaacagttcacctattaccctctggtggaagacaaggaagaggtgcagcggaagcggaggaaggccttgcccaccttctcccagcccttcgggggtggctcccacatgggtggaggctctgggggtgcagccgggggctacggaggagctggaggaggtggcagcctcggtttcttcccctcctccctggcctacagcccctaccagtccggcgcgggccccatgggctgctacccgggaggcgggggcggggcgcagatggccgccacggtgcccagcagggactccggggaggaagccgcggagccgagcgccccctccaggaccccccagtgcgagccgcaggccccggagatgctgcagcgagctcgagagtacaacgcgcgcctgttcggcctggcgcagcgcagcgcccgagccctactcgactacggcgtcaccgcggacgcgcgcgcgctgctggcgggacagcgccacctgctgacggcgcaggacgagaacggagacacaccactgcacctagccatcatccacgggcagaccagtgtcattgagcagatagtctatgtcatccaccacgcccaggacctcggcgttgtcaacctcaccaaccacctgcaccagacgcccctgcacctggcggtgatcacggggcagacgagtgtggtgagctttctgctgcgggtaggtgcagacccagctctgctggatcggcatggagactcagccatgcatctggcgctgcgggcaggcgctggtgctcctgagctgctgcgtgcactgcttcagagtggagctcctgctgtgccccagctgttgcatatgcctgactttgagggactgtatccagtacacctggcggtccgagcccgaagccctgagtgcctggatctgctggtggacagtggggctgaagtggaggccacagagcggcaggggggacgaacagccttgcatctagccacagagatggaggagctggggttggtcacccatctggtcaccaagctccgggccaacgtgaacgctcgcacctttgcgggaaacacacccctgcacctggcagctggactggggtacccgaccctcacccgcctccttctgaaggctggtgctgacatccatgctgaaaacgaggagcccctgtgcccactgccttcaccccctacctctgatagcgactcggactctgaagggcctgagaaggacacccgaagcagcttccggggccacacgcctcttgacctcacttgcagcaccaaggtgaagaccttgctgctaaatgctgctcagaacaccatggagccacccctgaccccgcccagcccagcagggccgggactgtcacttggtgatacagctctgcagaacctggagcagctgctagacgggccagaagcccagggcagctgggcagagctggcagagcgtctggggctgcgcagcctggtagacacgtaccgacagacaacctcacccagtggcagcctcctgcgcagctacgagctggctggcggggacctggcaggtctactggaggccctgtctgacatgggcctagaggagggagtgaggctgctgaggggtccagaaacccgagacaagctgcccagcacagaggtgaaggaagacagtgcgtacgggagccagtcagtggagcaggaggcagagaagctgggcccaccccctgagccaccaggagggctctgccacgggcacccccagcctcaggtgcactgacctgctgcctgcccccagcccccttcccggaccccctgtacagcgtccccacctatttcaaatcttatttaacaccccacacccacccctcagttgggacaaataaaggattctcatgggaaggggaggacccctccttcccaacttaaaaaaaccc

SEQ ID NO: 456409 - DNA, 2108 bp, Homo sapiens
  misc_feature (4)..(4): n is a, c, g, or t
ggcncggagagaagccgcaaccagagccgccgccacggcgggcgtctaaaattctgggaagcagaacctggccggagccactagacagagccgggcctagcccagagacatggagagttgctacaacccaggtctggatggtattattgaatatgatgatttcaaattgaactcctccattgtggaacccaaggagccagccccagaaacagctgatggcccctacctggtgatcgtggaacagcctaagcagagaggcttccgatttcgatatggctgtgaaggcccctcccatggaggactgcccggtgcctccagtgagaagggccgaaagacctatcccactgtcaagatctgtaactacgagggaccagccaagatcgaggtggacctggtaacacacagtgacccacctcgtgctcatgcccacagtctggtgggcaagcaatgctcggagctggggatctgcgccgtttctgtggggcccaaggacatgactgcccaatttaacaacctgggtgtcctgcatgtgactaagaagaacatgatggggactatgatacaaaaacttcagaggcagcggctccgctctaggccccagggccttacggaggccgagcagcgggagctggagcaagaggccaaagaactgaagaaggtgatggatctgagtatagtgcggctgcgcttctctgccttccttagagccagtgatggctccttctccctgcccctgaagccagtcatctcccagcccatccatgacagcaaatctccgggggcatcaaacctgaagatttctcgaatggacaagacagcaggctctgtgcggggtggagatgaagtttatctgctttgtgacaaggtgcagaaagatgacattgaggttcggttctatgaggatgatgagaatggatggcaggcctttggggacttctctcccacagatgtgcataaacagtatgccattgtgttccggacacccccctatcacaagatgaagattgagcggcctgtaacagtgtttctgcaactgaaacgcaagcgaggaggggacgtgtctgattccaaacagttcacctattaccctctggtggaagacaaggaagaggtgcagcggaagcggaggaaggccttgcccaccttctcccagcccttcgggggtggctcccacatgggtggaggctctgggggtgcagccgggggctacggaggagctggaggaggtggcagcctcggtttcttcccctcctccctggcctacagcccctaccagtccggcgcgggccccatgggctgctacccgggaggcgggggcggggcgcagatggccgccacggtgcccagcagggactccggggaggaagccgcggagccgagcgccccctccaggaccccccagtgcgagccgcaggccccggagatgctgcagcgagctcgagagtacaacgcgcgcctgttcggcctggcgcagcgcagcgcccgagccctactcgactacggcgtcaccgcggacgcgcgcgcgctgctggcgggacagcgccacctgctgacggcgcaggacgagaacggagacacaccactgcacctagccatcatccacgggcagaccagtgtcattgagcagatagtctatgtcatccaccacgcccaggacctcggcgttgtcaacctcaccaaccacctgcaccagacgcccctgcacctggcggtgatcacggggcagacgagtgtggtgagctttctgctgcgggtaggtgcagacccagctctgctggatcggcatggagactcagccatgcatctggcgctgcgggcaggcgctggtgctcctgagctgctgcgtgcactgcttcagagtggagctcctgctgtgccccagctgttgcatatgcctgactttgagggactgtatccagtacacctggcggtccgacctcaggtgcactgacctgctgcctgcccccagcccccttcccggaccccctgtacagcgtccccacctatttcaaatcttatttaacaccccacacccacccctcagttgggacaaataaaggattctcatgggaaggggaggacccctccttcccaacttaaaaaaaccc

SEQ ID NO: 456410 - DNA, 1601 bp, Homo sapiens
tccgtgttgtggggctcagctggttcatttatgttgtttttcctgtacctaagttcccgctgtaggtggtacctttgcagacggtgcgatgggggaagcagagaagtttcactacatctatagttgtgacctggatatcaacgtccagcttaagataggaagcttggaagggaagagagaacaaaagagttataaagctgtcctggaagacccaatgttgaagttctcaggactatatcaagagacatgctctgatctttatgttacttgtcaagtttttgcagaagggaagcctttggccttgccagtgagaacatcctacaaagcatttagtacaagatggaactggaatgaatggctgaaactaccagtaaaataccctgacctgcccaggaatgcccaagtggccctcaccatatgggatgtgtatggtcccggaaaagcagtgcctgtaggaggaacaacggtttcgctctttggaaaatacggcatgtttcgccaagggatgcatgacttgaaagtctggcctaatgtagaagcagatggatcagaacccacaaaaactcctggcagaacaagtagcactctctcagaagatcagatgagccgtcttgccaaggtaaaaaaagtcatttggaacaggtgcaaagctctgactgatgtctattgtagtatatataccttgacattatgaactctgtcagatttttaaaaaatctaaatcttaacttttaaataattgttttattgagatataattcacataccataaagttcacccttggaaagcatacagtctgatggtttagtaaatttacagacttgtataatcatcaccactatataattttagaattttttcatcacccctaaaagaaaccgcaccattaacagtcactcccattttctgctccctgcagttagttccaggcaagtactaatctacttactatctgtatggatttgcctgttctggaaatttcatataaatggaatcattcagtatgtgaccttatgtctggaaatctgtcaggtttgaaaatgtggagcgttggtgatattttcaagatgaccacccactttttctggtgacatagccttaaagttgttagtgtaacattctagagaagcttatgccacttggaagtgaagatgactcagacaattaactagtataaagtttctttgtaagcaaatgaagttattacctttttctttcaaaattgttttaatcaagtgttttcacttagaaatataaaaactaaattctattccgtgcattaattgcaacgctgtcatttattttgtgaacttcctttcacaaagcactgtgttagatactgtttaaggatccctttacagttatctgattaggacactttcttgtagttataatacatactttttttttgcaatcttattagtaggagtgcctctttaatgtctggaggaagttttgttgctaagcttttaacagcttgttgcctttacccacatatagaagaaatcttcaagaataagtacttgggttggctaggcttcatgcttcaacacagaatttttgtcaagttcattttgtcttttgtattgctcttttaagg

SEQ ID NO: 456411 - DNA, 837 bp, Homo sapiens
gaaatcttcgttgattttattcctactggggatatctcagtattgaacaccattaatagtgttggccccaaaacagctcttcactaggcctctcgacttcttcctttgatttgatttccagaccatttctggaatgaagtagttgcactctctgggataagctacaggttttcacagcctctcaaaatgtggcaccaagaaccaagcacactactcaaaatcactttatctaaatcactttagaattcagtggaatttttgccttcctagtgctggatgagatgatttttgcttgtctcgtgttaattacattcatcttgagcttacagtcagcagacaccctctccttgaattattttctcatataaactgatttttaagtgaagcctcaggaatcctatacagtatagttaattgcaatcctcttggtagcatttagcaaactaattaatgcactttttattttattagtagtcttttttaaaactatagactattgtttatctttgtgaataattaagtaaattattttctgtttatttctttttaatttttgtagtactggagaaaatgaaactgggattgacccatcaagatgcttggctcaataagaaaaccacgttaggagcaacctttgtatattggagacttcagagtaaccagcaaggaagagaaatcttaatcttcaagttaccatattttccaaatattacatggtacctgagttctgcttccttggatgtcattgcttaaatatagtcttgaagggcttgttttgaaatattgtatatattttttcaaatgtatacattgttaataaattaagaaatgagaaac

SEQ ID NO: 456412 - DNA, 3100 bp, Homo sapiens
tccgtgttgtggggctcagctggttcatttatgttgtttttcctgtacctaagttcccgctgtaggtggtacctttgcagacggtgcgatgggggaagcagagaagtttcactacatctatagttgtgacctggatatcaacgtccagcttaagataggaagcttggaagggaagagagaacaaaagagttataaagctgtcctggaagacccaatgttgaagttctcaggactatatcaagagacatgctctgatctttatgttacttgtcaagtttttgcagaagggaagcctttggccttgccagtgagaacatcctacaaagcatttagtacaagatggaactggaatgaatggctgaaactaccagtaaaataccctgacctgcccaggaatgcccaagtggccctcaccatatgggatgtgtatggtcccggaaaagcagtgcctgtaggaggaacaacggtttcgctctttggaaaatacggcatgtttcgccaagggatgcatgacttgaaagtctggcctaatgtagaagcagatggatcagaacccacaaaaactcctggcagaacaagtagcactctctcagaagatcagatgagccgtcttgccaagctcaccaaagctcatcgacaaggacacatggtgaaagtagattggctggatagattgacatttagagaaatagaaatgataaatgagagtgaaaaacgaagttctaatttcatgtacctgatggttgaatttcgatgtgtcaagtgtgatgataaggaatatggtattgtttattatgaaaaggacggtgatgaatcatctccaattttaacaagttttgaattagtgaaagttcctgacccccagatgtctatggagaatttagttgagagcaaacaccacaagcttgcccggagtttaagaagtggaccttctgaccacgatctgaaacccaatgctgccacgagagatcagttaaatattattgtgagttatccaccaaccaagcaacttacatatgaagaacaagatcttgtttggaagtttagatattatcttacgaatcaagaaaaagccttgacaaaattcttgaaatgtgttaattgggatctacctcaagaggccaaacaggccttggaacttctgggaaaatggaagccgatggatgtagaggactccttggagctgttatcctctcattacaccaacccaactgtgaggcgttatgctgttgcccggttgcgacaggccgatgatgaggatttgttgatgtacctattacaattggtccaggctctcaaatatgaaaattttgatgatataaagaatggattggaacctaccaagaaggatagtcagagttcagtgtcagaaaatgtgtcaaattctggaataaattctgcagaaatagatagctcccaaattataaccagcccccttccttcagtctcttcacctcctcctgcatcaaaaacaaaagaagttccagatggcgaaaatctggaacaagatctctgtaccttcttgatatcgagagcctgcaaaaactcaacactggctaattatttatactggtatgtgatagtggaatgtgaagatcaagatactcagcagagagatccaaagacccatgagatgtacttgaacgtaatgagaagattcagccaagcattgttgaagggtgataagtctgtcagagttatgcgttctttgctggctgcacaacagacatttgtagatcggttggtgcatctaatgaaggcagtacaacgcgaaagtggaaatcgtaagaaaaagaatgagagactacaggcattgcttggagataatgaaaagatgaatttgtcagatgtggaacttatcccgttgcctttagaaccccaagtgaaaattagaggaataattccggaaacagctacactgtttaaaagtgcccttatgcctgcacagttgttttttaagacggaagatggaggcaaatatccagttatatttaagcatggagatgatttacgtcaagatcaacttattcttcaaatcatttcactcatggacaagctgttacggaaagaaaatctggacttgaaattgacaccttataaggtgttagccaccagtacaaaacatggcttcatgcagtttatccagtcagttcctgtggctgaagttcttgatacagagggaagcattcagaacttttttagaaaatatgcaccaagtgagaatgggccaaatgggattagtgctgaggtcatggacacttacgttaaaagctgtgctggatattgcgtgatcacctatatacttggagttggagacaggcacctggataaccttttgctaacaaaaacaggcaaactcttccacatagactttggatatattttgggtcgggatccaaagcctcttcctccaccaatgaagctgaataaagaaatggtagaaggaatggggggcacacagagtgagcagtaccaagagttccgtaaacagtgttacacggctttcctccacctgcgaaggtattctaatctgattttgaacttgttttccttgatggttgatgcaaacattccagatattgcacttgaaccagataaaactgtgaaaaaggttcaggataaattccgcttagacctgtcggatgaagaggctgtgcattacatgcagagtctgattgatgagagtgtccatgctctttttgctgcagtggtggaacagattcacaagtttgcccagtactggagaaaatgaaactgggattgacccatcaagatgcttggctcaataagaaaaccacgttaggagcaacctttgtatattggagacttcagagtaaccagcaaggaagagaaatcttaatcttcaagttaccatattttccaaatattacatggtacctgagttctgcttccttggatgtcattgcttaaatatagtcttgaagggcttgttttgaaatattgtatatattttttcaaatgtatacattgttaataaattaagaaatgagaaacattcttatttatgtacatgttatgagagttctggaggaagtaatatgttgaaatagtaaaacattttagtttttgagtttaaaat

SEQ ID NO: 456413 - DNA, 1868 bp, Homo sapiens
cttcagagaggttttcagaataagagagtcttatgtaataccaaagtattacacagattatgaaaataatagtttttgttctcgagttactcagtaaatatgtgagcttagatgatttctgaggatgttaatactctacctcataaataggagaaaatgcttgttttggtggcaaaagttttagaaaatttgggatattacacaaattaaggcattaccactcttagtttaccttttattgatggttgtatgtgttcctctttaagttttcacttttaaaagtgatgataaaatgtgttttattactccaattttattatttttgcatatgtaaattaatctgttttagtgaaatgatatgagtatttacaaactgaatctaagtttcatttcacatcacatgaatggctcaaactatttttaaggtatgtgatagtggaatgtgaagatcaagatactcagcagagagatccaaagacccatgagatgtacttgaacgtaatgagaagattcagccaagcattgttgaagggtgataagtctgtcagagttatgcgttctttgctggctgcacaacagacatttgtagatcggttggtgcatctaatgaaggcagtacaacgcgaaagtggaaatcgtaagaaaaagaatgagagactacaggcattgcttggagataatgaaaagatgaatttgtcagatgtggaacttatcccgttgcctttagaaccccaagtgaaaattagaggaataattccggaaacagctacactgtttaaaagtgcccttatgcctgcacagttgttttttaagacggaagatggaggcaaatatccagttatatttaagcatggagatgatttacgtcaagatcaacttattcttcaaatcatttcactcatggacaagctgttacggaaagaaaatctggacttgaaattgacaccttataaggtgttagccaccagtacaaaacatggcttcatgcagtttatccagtcagttcctgtggctgaagttcttgatacagagggaagcattcagaacttttttagaaaatatgcaccaagtgagaatgggccaaatgggattagtgctgaggtcatggacacttacgttaaaagctgtgctggatattgcgtgatcacctatatacttggagttggagacaggcacctggataaccttttgctaacaaaaacaggcaaactcttccacatagactttggatatattttgggtcgggatccaaagcctcttcctccaccaatgaagctgaataaagaaatggtagaaggaatggggggcacacagagtgagcagtaccaagagttccgtaaacagtgttacacggctttcctccacctgcgaaggtattctaatctgattttgaacttgttttccttgatggttgatgcaaacattccagatattgcacttgaaccagataaaactgtgaaaaaggttcaggataaattccgcttagacctgtcggatgaagaggctgtgcattacatgcagagtctgattgatgagagtgtccatgctctttttgctgcagtggtggaacagattcacaagtttgcccagtactggagaaaatgaaactgggattgacccatcaagatgcttggctcaataagaaaaccacgttaggagcaacctttgtatattggagacttcagagtaaccagcaaggaagagaaatcttaatcttcaagttaccatattttccaaatattacatggtacctgagttctgcttccttggatgtcattgcttaaatatagtcttgaagggcttgttttgaaatattgtatatattttttcaaatgtatacattgttaataaattaagaaatgagaaac

SEQ ID NO: 456414 - DNA, 1815 bp, Homo sapiens
cttcagagaggttttcagaataagagagtcttatgtaataccaaagtattacacagattatgaaaataatagtttttgttctcgagttactcagtaaatatgtgagcttagatgatttctgaggatgttaatactctacctcataaataggagaaaatgcttgttttggtggcaaaagttttagaaaatttgggatattacacaaattaaggcattaccactcttagtttaccttttattgatggttgtatgtgttcctctttaagttttcacttttaaaagtgatgatgttttagtgaaatgatatgagtatttacaaactgaatctaagtttcatttcacatcacatgaatggctcaaactatttttaaggtatgtgatagtggaatgtgaagatcaagatactcagcagagagatccaaagacccatgagatgtacttgaacgtaatgagaagattcagccaagcattgttgaagggtgataagtctgtcagagttatgcgttctttgctggctgcacaacagacatttgtagatcggttggtgcatctaatgaaggcagtacaacgcgaaagtggaaatcgtaagaaaaagaatgagagactacaggcattgcttggagataatgaaaagatgaatttgtcagatgtggaacttatcccgttgcctttagaaccccaagtgaaaattagaggaataattccggaaacagctacactgtttaaaagtgcccttatgcctgcacagttgttttttaagacggaagatggaggcaaatatccagttatatttaagcatggagatgatttacgtcaagatcaacttattcttcaaatcatttcactcatggacaagctgttacggaaagaaaatctggacttgaaattgacaccttataaggtgttagccaccagtacaaaacatggcttcatgcagtttatccagtcagttcctgtggctgaagttcttgatacagagggaagcattcagaacttttttagaaaatatgcaccaagtgagaatgggccaaatgggattagtgctgaggtcatggacacttacgttaaaagctgtgctggatattgcgtgatcacctatatacttggagttggagacaggcacctggataaccttttgctaacaaaaacaggcaaactcttccacatagactttggatatattttgggtcgggatccaaagcctcttcctccaccaatgaagctgaataaagaaatggtagaaggaatggggggcacacagagtgagcagtaccaagagttccgtaaacagtgttacacggctttcctccacctgcgaaggtattctaatctgattttgaacttgttttccttgatggttgatgcaaacattccagatattgcacttgaaccagataaaactgtgaaaaaggttcaggataaattccgcttagacctgtcggatgaagaggctgtgcattacatgcagagtctgattgatgagagtgtccatgctctttttgctgcagtggtggaacagattcacaagtttgcccagtactggagaaaatgaaactgggattgacccatcaagatgcttggctcaataagaaaaccacgttaggagcaacctttgtatattggagacttcagagtaaccagcaaggaagagaaatcttaatcttcaagttaccatattttccaaatattacatggtacctgagttctgcttccttggatgtcattgcttaaatatagtcttgaagggcttgttttgaaatattgtatatattttttcaaatgtatacattgttaataaattaagaaatgagaaac

SEQ ID NO: 456415 - DNA, 1941 bp, Homo sapiens
tccgtgttgtggggctcagctggttcatttatgttgtttttcctgtacctaagttcccgctgtaggtggtacctttgcagacggtgcgatgggggaagcagagaagtttcactacatctatagttgtgacctggatatcaacgtccagcttaagataggaagcttggaagggaagagagaacaaaagagttataaagctgtcctggaagacccaatgttgaagttctcaggactatatcaagagacatgctctgatctttatgttacttgtcaagtttttgcagaagggaagcctttggccttgccagtgagaacatcctacaaagcatttagtacaagatggaactggaatgaatggctgaaactaccagtaaaataccctgacctgcccaggaatgcccaagtggccctcaccatatgggatgtgtatggtcccggaaaagcagtgcctgtaggaggaacaacggtttcgctctttggaaaatacggcatgtttcgccaagggatgcatgacttgaaagtctggcctaatgtagaagcagatggatcagaacccacaaaaactcctggcagaacaagtagcactctctcagaagatcagatgagccgtcttgccaagctcaccaaagctcatcgacaaggacacatggtgaaagtagattggctggatagattgacatttagagaaatagaaatgataaatgagagtgaaaaacgaagttctaatttcatgtacctgatggttgaatttcgatgtgtcaagtgtgatgataaggaatatggtattgtttattatgaaaaggacggtgatgaatcatctccaattttaacaagttttgaattagtgaaagttcctgacccccagatgtctatggagaatttagttgagagcaaacaccacaagcttgcccggagtttaagaagtggaccttctgaccacgatctgaaacccaatgctgccacgagagatcagttaaatattattgtgagttatccaccaaccaagcaacttacatatgaagaacaagatcttgtttggaagtttagatattatcttacgaatcaagaaaaagccttgacaaaattcttgaaatgtgttaattgggatctacctcaagaggccaaacaggccttggaacttctgggaaaatggaagccgatggatgtagaggactccttggagctgttatcctctcattacaccaacccaactgtgaggcgttatgctgttgcccggttgcgacaggccgatgatgaggatttgttgatgtacctattacaattggtccaggctctcaaatatgaaaattttgatgatataaagaatggattggaacctaccaagaaggatagtcagagttcagtgtcagaaaatgtgtcaaattctggaataaattctgcagaaatagatagctcccaaattataaccagcccccttccttcagtctcttcacctcctcctgcatcaaaaacaaaagaagttccagatggcgaaaatctggaacaagatctctgtaccttcttgatatcgagagcctgcaaaaactcaacactggctaattatttatactggtatgtaaaaataattttctgtttattttcttattacccttaagaattattttttctcatgctataaacacaaagatgatttaaaataagatatgagcaatcatcaaaagtctagatatagtatttatatctaactgtattccctgacagctgggttcatggaaatgcttgttggcatcaacatttctctccctttcactaaggatataactttccaggagctaggatataactggggagggtaatgggtactttcagtttaatatctgtttggcatgtaaagtagttgagtatgatatttcacagttcttcaggagtatatattttcacattatttactaaaacattggaatcatttaaaaagaaaaa

SEQ ID NO: 456416 - DNA, 3015 bp, Homo sapiens
tccgtgttgtggggctcagctggttcatttatgttgtttttcctgtacctaagttcccgctgtaggtggtacctttgcagacggtgcgatgggggaagcagagaagtttcactacatctatagttgtgacctggatatcaacgtccagcttaagataggaagcttggaagggaagagagaacaaaagagttataaagctgtcctggaagacccaatgttgaagttctcaggactatatcaagagacatgctctgatctttatgttacttgtcaagtttttgcagaagggaagcctttggccttgccagtgagaacatcctacaaagcatttagtacaagatggaactggaatgaatggctgaaactaccagtaaaataccctgacctgcccaggaatgcccaagtggccctcaccatatgggatgtgtatggtcccggaaaagcagtgcctgtaggaggaacaacggtttcgctctttggaaaatacggcatgtttcgccaagggatgcatgacttgaaagtctggcctaatgtagaagcagatggatcagaacccacaaaaactcctggcagaacaagtagcactctctcagaagatcagatgagccgtcttgccaagctcaccaaagctcatcgacaaggacacatggtgaaagtagattggctggatagattgacatttagagaaatagaaatgataaatgagagtgaaaaacgaagttctaatttcatgtacctgatggttgaatttcgatgtgtcaagtgtgatgataaggaatatggtattgtttattatgaaaaggacggtgatgaatcatctccaattttaacaagttttgaattagtgaaagttcctgacccccagatgtctatggagaatttagttgagagcaaacaccacaagcttgcccggagtttaagaagtggaccttctgaccacgatctgaaacccaatgctgccacgagagatcagttaaatattattgtgagttatccaccaaccaagcaacttacatatgaagaacaagatcttgtttggaagtttagatattatcttacgaatcaagaaaaagccttgacaaaattcttgaaatgtgttaattgggatctacctcaagaggccaaacaggccttggaacttctgggaaaatggaagccgatggatgtagaggactccttggagctgttatcctctcattacaccaacccaactgtgaggcgttatgctgttgcccggttgcgacaggccgatgatgaggatttgttgatgtacctattacaattggtccaggctctcaaatatgaaaattttgatgatataaagaatggattggaacctaccaagaaggatagtcagagttcagtgtcagaaaatgtgtcaaattctggaataaattctgcagaaatagatagctcccaaattataaccagcccccttccttcagtctcttcacctcctcctgcatcaaaaacaaaagaagttccagatggcgaaaatctggaacaagatctctgtaccttcttgatatcgagagcctgcaaaaactcaacactggctaattatttatactggtatgtgatagtggaatgtgaagatcaagatactcagcagagagatccaaagacccatgagatgtacttgaacgtaatgagaagattcagccaagcattgttgaagggtgataagtctgtcagagttatgcgttctttgctggctgcacaacagacatttgtagatcggttggtgcatctaatgaaggcagtacaacgcgaaagtggaaatcgtaagaaaaagaatgagagactacaggcattgcttggagataatgaaaagatgaatttgtcagatgtggaacttatcccgttgcctttagaaccccaagtgaaaattagaggaataattccggaaacagctacactgtttaaaagtgcccttatgcctgcacagttgttttttaagacggaagatggaggcaaatatccagttatatttaagcatggagatgatttacgtcaagatcaacttattcttcaaatcatttcactcatggacaagctgttacggaaagaaaatctggacttgaaattgacaccttataaggtgttagccaccagtacaaaacatggcttcatgcagtttatccagtcagttcctgtggctgaagttcttgatacagagggaagcattcagaacttttttagaaaatatgcaccaagtgagaatgggccaaatgggattagtgctgaggtcatggacacttacgttaaaagctgtgctggatattgcgtgatcacctatatacttggagttggagacaggcacctggataaccttttgctaacaaaaacaggcaaactcttccacatagactttggatatattttgggtcgggatccaaagcctcttcctccaccaatgaagctgaataaagaaatggtagaaggaatggggggcacacagagtgagcagtaccaagagttccgtaaacagtgttacacggctttcctccacctgcgaaggtattctaatctgattttgaacttgttttccttgatggttgatgcaaacattccagatattgcacttgaaccagataaaactgtgaaaaaggttcaggataaattccgcttagacctgtcggatgaagaggctgtgcattacatgcagagtctgattgatgagagtgtccatgctctttttgctgcagtggtggaacagattcacaagtttgcccagtactggagaaaatgaaactgggattgacccatcaagatgcttggctcaataagaaaaccacgttaggagcaacctttgtatattggagacttcagagtaaccagcaaggaagagaaatcttaatcttcaagttaccatattttccaaatattacatggtacctgagttctgcttccttggatgtcattgcttaaatatagtcttgaagggcttgttttgaaatattgtatatattttttcaaatgtatacattgttaataaattaagaaatgagaaac

SEQ ID NO: 456417 - DNA, 605 bp, Homo sapiens
aggggcctgttgggagtgagaggcagaaaaggaagcttggaagggaagagagaacaaaagagttataaagctgtcctggaagacccaatgttgaagttctcaggactatatcaagagacatgctctgatctttatgttacttgtcaagtttttgcagaagggaagcctttggccttgccagtgagaacatcctacaaagcatttagtacaagatggaactggaatgaatggctgaaactaccagtaaaataccctgacctgcccaggaatgcccaagtggccctcaccatatgggatgtgtatggtcccggaaaagcagtgcctgtaggaggaacaacggtttcgctctttggaaaatacggcatgtttcgccaagggatgcatgacttgaaagtctggcctaatgtagaagcagatggatcagaacccacaaaaactcctggcagaacaagtagcactctctcagaagatcagatgagccgtcttgccaaggaacattaagccatcatgtaagaagtccagctatttttttggattgaccaagttggatttccacttggagagggagcagcactgagaatacgtggggaaagagaggccctacc

SEQ ID NO: 456418 - DNA, 4058 bp, Homo sapiens
  misc_feature (2392)..(2392): n is a, c, g, or t
  misc_feature (2489)..(2489): n is a, c, g, or t
tccgtgttgtggggctcagctggttcatttatgttgtttttcctgtacctaagttcccgctgtaggtggtacctttgcagacggtgcgatgggggaagcagagaagtttcactacatctatagttgtgacctggatatcaacgtccagcttaagataggaagcttggaagggaagagagaacaaaagagttataaagctgtcctggaagacccaatgttgaagttctcaggactatatcaagagacatgctctgatctttatgttacttgtcaagtttttgcagaagggaagcctttggccttgccagtgagaacatcctacaaagcatttagtacaagatggaactggaatgaatggctgaaactaccagtaaaataccctgacctgcccaggaatgcccaagtggccctcaccatatgggatgtgtatggtcccggaaaagcagtgcctgtaggaggaacaacggtttcgctctttggaaaatacggcatgtttcgccaagggatgcatgacttgaaagtctggcctaatgtagaagcagatggatcagaacccacaaaaactcctggcagaacaagtagcactctctcagaagatcagatgagccgtcttgccaagctcaccaaagctcatcgacaaggacacatggtgaaagtagattggctggatagattgacatttagagaaatagaaatgataaatgagagtgaaaaacgaagttctaatttcatgtacctgatggttgaatttcgatgtgtcaagtgtgatgataaggaatatggtattgtttattatgaaaaggacggtgatgaatcatctccaattttaacaagttttgaattagtgaaagttcctgacccccagatgtctatggagaatttagttgagagcaaacaccacaagcttgcccggagtttaagaagtggaccttctgaccacgatctgaaacccaatgctgccacgagagatcagttaaatattattgtgagttatccaccaaccaagcaacttacatatgaagaacaagatcttgtttggaagtttagatattatcttacgaatcaagaaaaagccttgacaaaattcttgaaatgtgttaattgggatctacctcaagaggccaaacaggccttggaacttctgggaaaatggaagccgatggatgtagaggactccttggagctgttatcctctcattacaccaacccaactgtgaggcgttatgctgttgcccggttgcgacaggccgatgatgaggatttgttgatgtacctattacaattggtccaggctctcaaatatgaaaattttgatgatataaagaatggattggaacctaccaagaaggatagtcagagttcagtgtcagaaaatgtgtcaaattctggaataaattctgcagaaatagatagctcccaaattataaccagcccccttccttcagtctcttcacctcctcctgcatcaaaaacaaaagaagttccagatggcgaaaatctggaacaagatctctgtaccttcttgatatcgagagcctgcaaaaactcaacactggctaattatttatactggtatgtgatagtggaatgtgaagatcaagatactcagcagagagatccaaagacccatgagatgtacttgaacgtaatgagaagattcagccaagcattgttgaagggtgataagtctgtcagagttatgcgttctttgctggctgcacaacagacatttgtagatcggttggtgcatctaatgaaggcagtacaacgcgaaagtggaaatcgtaagaaaaagaatgagagactacaggcattgcttggagataatgaaaagatgaatttgtcagatgtggaacttatcccgttgcctttagaaccccaagtgaaaattagaggaataattccggaaacagctacactgtttaaaagtgcccttatgcctgcacagttgttttttaagacggaagatggaggcaaatatccagttatatttaagcatggagatgatttacgtcaagatcaacttattcttcaaatcatttcactcatggacaagctgttacggaaagaaaatctggacttgaaattgacaccttataaggtgttagccaccagtacaaaacatggcttcatgcagtttatccagtcagttcctgtggctgaagttcttgatacagagggaagcattcagaacttttttagaaaatatgcaccaagtgagaatgggccaaatgggattagtgctgaggtcatggacacttacgttaaaagctgtgctggatattgcgtgatcacctatatacttggagttggagacaggcacctggataaccttttgctaacaaaaacaggtaacaattaatgactaccagtagacatacattgtatatgnccatggtttttacccctgaatctatgtactaacaagataagttgcggcctggcgcggtggctcacgcccgtaatcccagcactttgggaggccaagncgggtggatcacctgaggttgggagttcgagaccagcctgaccaacatggagaaaccccgtctctactaaacacacaaaatttgccgggcgtggtggtacatgcctgtaatcccaactactcaggaggctgaggcaggagaatcgcttgaacccgggaggcggaggttgcagtgagccgagattgcaccattgcactgcagactaggcaacaagatcaaaacgccatcttagaaaaaaaaaaaaaaaaagatgagttgcgtaattgaagataaatcagagagtcttaaaaattcctttaaatgttaccttggaagaacatttagggaaagtcctttcccttttaagaattgctttagtagtaatcctacagatggtcattttgcccacacttctgtactggaaaatgcctctttttatggaaagccaataatggatacaagtagcttagtctcttactgtatagctctagttagattgttaaaatgtcctttctcttacaaagtgtgcttaattcactttaatatctacctttaattatttgcttttccccttggagttctatgggataatcattctcagtcccctttgtcctgacaactctttagccctatgtatttatctttatgcagacagcttccagacttacagctttttacctcagtccatttcattaacttcaaattgaaatatcgaactgcttacttgaaattgtcattatatatggccagttgtaaaaggttgtcctttcctctactacctgcctaaaacctgtttctcacctcatttttccatttcaatagatagcaacatcacctacccagttgttcaagctctagacctcaaagtcattcttaacatgtctcttggcctcatctcatatactgaacctattagcaaatcttgtctactcctcaactccaaaatagatcatgaagttacccactgtcttcatttttactactttgaccccacttgaagcaaacaatatatgttgcctaaacaatttgaatgaaacctgaaccctttattggggccttgtggcttgtccaggcaggccatttgtctgaatgtcaaaccactcctgcctcagacaagagcctttgttgttttctctttctggaaagttatttattcagatctttgcagggctgactttagttattaagttgaagttctaatggcatctctttagagaagccctttctaactccttgatctgtaataacatatctgccctcttcctccaatgctctctacttattactgtattgtttatagcacttatcactagctgaagttaccttttttgtttaattcaacaactatttattgaacagctagtagatgctgggaataccaaagttaacagaagagacagaaatccttgctctcctagagcttgttgagttcttatcatcatcttctccccttcaggatgcaagttccatgagagcaggaacctttgtccattggggttacccccatgcctctggaccttgaacaccacctagctaaagtgttcaataaatcagtgttgaattaatgatgaataaatacttctgctcttc

SEQ ID NO: 456419 - DNA, 3796 bp, Homo sapiens
tccgtgttgtggggctcagctggttcatttatgttgtttttcctgtacctaagttcccgctgtaggtggtacctttgcagacggtgcgatgggggaagcagagaagtttcactacatctatagttgtgacctggatatcaacgtccagcttaagataggaagcttggaagggaagagagaacaaaagagttataaagctgtcctggaagacccaatgttgaagttctcaggactatatcaagagacatgctctgatctttatgttacttgtcaagtttttgcagaagggaagcctttggccttgccagtgagaacatcctacaaagcatttagtacaagatggaactggaatgaatggctgaaactaccagtaaaataccctgacctgcccaggaatgcccaagtggccctcaccatatgggatgtgtatggtcccggaaaagcagtgcctgtaggaggaacaacggtttcgctctttggaaaatacggcatgtttcgccaagggatgcatgacttgaaagtctggcctaatgtagaagcagatggatcagaacccacaaaaactcctggcagaacaagtagcactctctcagaagatcagatgagccgtcttgccaagctcaccaaagctcatcgacaaggacacatggtgaaagtagattggctggatagattgacatttagagaaatagaaatgataaatgagagtgaaaaacgaagttctaatttcatgtacctgatggttgaatttcgatgtgtcaagtgtgatgataaggaatatggtattgtttattatgaaaaggacggtgatgaatcatctccaattttaacaagttttgaattagtgaaagttcctgacccccagatgtctatggagaatttagttgagagcaaacaccacaagcttgcccggagtttaagaagtggaccttctgaccacgatctgaaacccaatgctgccacgagagatcagttaaatattattgtgagttatccaccaaccaagcaacttacatatgaagaacaagatcttgtttggaagtttagatattatcttacgaatcaagaaaaagccttgacaaaattcttgaaatgtgttaattgggatctacctcaagaggccaaacaggccttggaacttctgggaaaatggaagccgatggatgtagaggactccttggagctgttatcctctcattacaccaacccaactgtgaggcgttatgctgttgcccggttgcgacaggccgatgatgaggatttgttgatgtacctattacaattggtccaggctctcaaatatgaaaattttgatgatataaagaatggattggaacctaccaagaaggatagtcagagttcagtgtcagaaaatgtgtcaaattctggaataaattctgcagaaatagatagctcccaaattataaccagcccccttccttcagtctcttcacctcctcctgcatcaaaaacaaaagaagttccagatggcgaaaatctggaacaagatctctgtaccttcttgatatcgagagcctgcaaaaactcaacactggctaattatttatactggtatgtgatagtggaatgtgaagatcaagatactcagcagagagatccaaagacccatgagatgtacttgaacgtaatgagaagattcagccaagcattgttgaagggtgataagtctgtcagagttatgcgttctttgctggctgcacaacagacatttgtagatcggttggtgcatctaatgaaggcagtacaacgcgaaagtggaaatcgtaagaaaaagaatgagagactacaggcattgcttggagataatgaaaagatgaatttgtcagatgtggaacttatcccgttgcctttagaaccccaagtgaaaattagaggaataattccggaaacagctacactgtttaaaagtgcccttatgcctgcacagttgttttttaagacggaagatggaggcaaatatccagttatatttaagcatggagatgatttacgtcaagatcaacttattcttcaaatcatttcactcatggacaagctgttacggaaagaaaatctggacttgaaattgacaccttataaggtgttagccaccagtacaaaacatggcttcatgcagtttatccagtcagttcctgtggctgaagttcttgatacagagggaagcattcagaacttttttagaaaatatgcaccaagtgagaatgggccaaatgggattagtgctgaggtcatggacacttacgttaaaagctgtgctggatattgcgtgatcacctatatacttggagttggagacaggcacctggataaccttttgctaacaaaaacaggaggctgaggcaggagaatcgcttgaacccgggaggcggaggttgcagtgagccgagattgcaccattgcactgcagactaggcaacaagatcaaaacgccatcttagaaaaaaaaaaaaaaaaagatgagttgcgtaattgaagataaatcagagagtcttaaaaattcctttaaatgttaccttggaagaacatttagggaaagtcctttcccttttaagaattgctttagtagtaatcctacagatggtcattttgcccacacttctgtactggaaaatgcctctttttatggaaagccaataatggatacaagtagcttagtctcttactgtatagctctagttagattgttaaaatgtcctttctcttacaaagtgtgcttaattcactttaatatctacctttaattatttgcttttccccttggagttctatgggataatcattctcagtcccctttgtcctgacaactctttagccctatgtatttatctttatgcagacagcttccagacttacagctttttacctcagtccatttcattaacttcaaattgaaatatcgaactgcttacttgaaattgtcattatatatggccagttgtaaaaggttgtcctttcctctactacctgcctaaaacctgtttctcacctcatttttccatttcaatagatagcaacatcacctacccagttgttcaagctctagacctcaaagtcattcttaacatgtctcttggcctcatctcatatactgaacctattagcaaatcttgtctactcctcaactccaaaatagatcatgaagttacccactgtcttcatttttactactttgaccccacttgaagcaaacaatatatgttgcctaaacaatttgaatgaaacctgaaccctttattggggccttgtggcttgtccaggcaggccatttgtctgaatgtcaaaccactcctgcctcagacaagagcctttgttgttttctctttctggaaagttatttattcagatctttgcagggctgactttagttattaagttgaagttctaatggcatctctttagagaagccctttctaactccttgatctgtaataacatatctgccctcttcctccaatgctctctacttattactgtattgtttatagcacttatcactagctgaagttaccttttttgtttaattcaacaactatttattgaacagctagtagatgctgggaataccaaagttaacagaagagacagaaatccttgctctcctagagcttgttgagttcttatcatcatcttctccccttcaggatgcaagttccatgagagcaggaacctttgtccattggggttacccccatgcctctggaccttgaacaccacctagctaaagtgttcaataaatcagtgttgaattaatgatgaataaatacttctgctcttc

SEQ ID NO: 456420 - DNA, 4263 bp, Homo sapiens
gactgggagcaggcagcccgggcggagcgggccggtgccgaggacggccccaggcattgctctgccccgggcattgcgcggcgcgcgtgagggggatgcggcaggaggcggcgcggcgggaggagtaggcggcggcgccctcgggagggagctgcgcgcgggccagacggcgcccggaggctccgcagtgccgccgccgtcgcccgggaggctccgcgcgggagccatgtaaccctgcggcgggctccgggctgctccgtccttccccagctcccgggctagcgcggcagcggggccacgatgaagaagcagttcaatcgcatgcgccagctggccaaccagacggtgggcagggctgaaaagacagaagttttgagtgaagaccttcttcaggtggagaagcgtctggagctggtgaaacaggtgtcccacagcacgcacaagaagctcaccgcatgtctgcagggccagcaaggggcagaggctgacaagcgctccaaaaagttgcctttgacaacactggctcagtgtctgatggaggggtcagctatcctgggagatgacacacttcttgggaagatgctgaaactctgtggagagacggaggacaagctggctcaggagctgatacattttgagttgcaagtagagagagacgtgattgagcccctgtttttgctggcggaggtggaaatcccaaatattcaaaagcagaggaaacacttagccaagttggtgctggacatggattcctcacgaaccaggtggcagcagacttccaagtcttcaggtttgtccagcagcttacagcctgcgggtgccaaggctgatgccctcagggaagaaatggaagaggctgccaacagagtggagatttgcagggaccagctctcagctgatatgtacagttttgtggccaaagaaattgactatgcaaactactttcaaacgctaatagaagtgcaagctgaataccacaggaagtccctgacactattgcaggctgtattgcctcagatcaaagcacaacaggaggcctgggtagagaagccttccttcgggaagccgctggaggagcacctcaccatcagcggccgggagatcgccttccccatcgaggcgtgtgtgaccatgctgcttgagtgtgggatgcaggaggagggactcttccgagtagccccctctgcctccaaactgaagaagctgaaagcggccctggactgctgcgtggtggatgtgcaggagtactcggcagacccccacgcaattgcaggagctttgaaatcttacctccgagagttgccagaacctcttatgacctttgaactctatgatgagtggatccaggcttccaatgtccaggagcaagacaagaagcttcaggctctatggaatgcttgtgaaaagttgcccaaggccaatcacaacaacatccgatacttgataaaatttttatccaagctgtcagaatatcaagatgtaaacaagatgactcccagtaatatggcaattgttttaggacccaacctcctatggccacaagcagaagggaacattacagagatgatgaccacagtgtcgctgcaaattgttgggatcattgaacctatcatccagcatgcagactggttcttccctggggagatagagttcaacattactggcaattatgggagtccagtacacgtgaaccataatgccaactacagctcaatgccctccccagacatggaccctgctgaccggcgccagcccgagcaggcccgccggcccctcagcgtcgccacggataatatgatgctggagttttacaaaaaggatggcatgggtgtgagggtcatggacacaaactgggtggctcgaagaggctcctcggccggtcggaaagtgtcctgcgccccgccctccatgcagcctcccgccccgcccgccgagctggctgcgcccctgccttcgccgctgccggagcagcccctggacagccccgcggcccccgcgctctctccatccggcctgggcctccagcctgggcccgagcgcaccagcacaacaaaaagcaaggaactttctccaggctctgcacagaaaggaagtccaggctccagccagggcacagcctgtgcagggactcaaccaggggctcaacctggagctcagccgggcgccagccccagccccagccagccgcctgcagaccagagtcctcacaccctccggaaagtttcaaagaagctggcaccgattccacccaaggtcccctttggccagccgggggctatggcagaccagtccgctggccagccgtccccagtcagcctgtcccccaccccgcccagcaccccgtcaccctatggactgagctaccctcaggggtactccttggcctcgggccagctctccccagctgcagctcctcccctggcctctccttctgtctttacaagcactttgagcaaatcgcggcccactcctaagccgcgacagagacctactctgccgcctcctcagcctcccacagtaaacctctcggcctctagtccacagtccacggaggcccccatgctagatggcatgtcccctggggaaagcatgtctacagctgtgtgacatgagtggcgcagttttggatacgtgtgagggggattttcaggatcttgtccactttgatattccctcgatccacatagagctcgggtcgacgctccgcctgagtcccctggagcacatgcggcgacactcagtaactgacaagagggactcggaggaggagtctgagagcaccgccctctgacatgacaccgcccatcctgcctcgcgtgtacatacatcacgggccctaggaacgccgccaggagcagcgtccatgagcttgccaagtgttctctgctggctctttcctgccactgccaacacgaggttggaatttggcagaaaattgtgatctccagtccgtgtggtgatgctggtggtgcaggttttgtttgttcctttcgggtggtgacttcggccttttgtttgacctttgccttttgactttgtgcctcttttgatccactttcagcctccatgccagaaaacacccacctctccatccaaggctggtcaggaacgtcctttgcagggtcggggtggtgcgggagaggctcactttgcctggttagacccaagggctgctaccttttccttggacggctcatgtcaggtcttgcaggatcagtttaatggccacagaaaggaagcaggacagcagggcccctctcacccacaactggaccaggtccaggattctagcagtcctggggcactgacctttgccagctacctgggggagggcttgccactggaaaacctttcaggccgcccccatcagtgggctccaaagtaaatggctgaaaacaaaaatgtttcacttcctaacagttttcctttttccactgtgtgactgaaagctcctatatcattttatatttctgaatctataaaacaaaacaaacaagcctgacagtgtctggaggagccaaaggtggcctccctgtccccaaatatattggctatatgagagtaattttacccctctacgtacctaaaggcacccagttcactagtctgtggggtcctggagcctgtctcttctttctggaggttcaaactgaatagcaataattacgttacccaaagcatgtggaggaaaagtgaaaccagccacggagacgctggcccacgggctcggcctgcggtgtggcctgctttgctcaccagcgtcagccgctcatttccttctcatgaagtcccatctggtcatggggacgagggccgggagggcaccgggtagccttttcacacttggggattaggggagtgagaaaagatttgggccatgcatgcaaagtcaaagtttaaaattttatccttttcaaatagatgatataatatacctatacatgatataatatttgtatatatgaaatctctctatatttgtttaatttgagccattcaatctaaaccaatgtacaggtgtacaatgaaaaatttaaatgcttagttatttttcccaacacagtgtaaagtcaccctcctctgagagtgggatgtgcagagttttgatgttgcagctttgctcacttcctggcaagggcaggtcatgcctcaatttgtaatgggagtctggggtaagggtgggggttgaaagttgttatctttaaatacatgtacaaatcgttgtcaaaagtaacgttattaaaatagatttattatccctga

SEQ ID NO: 456421 - DNA, 2455 bp, Homo sapiens
atcctgagctggctttggcagagggttgaagcacagcttgtggccgccagcgctgccgactgtgccctgctccttgcctcagtgagggggccgctcttgccaggactgggctgcccagggctgtgtcttggccgccgggagcagccagggtgctgggagcacagcccccaatgcatcgcttcccgggcccccggggtgctaaagctgcgctgctcttctcccaacgcggacctgcttgaatgtgggggagggagcctgtctcctgtcatctgttacgcgtggcctcccgccccgcccgccgagctggctgcgcccctgccttcgccgctgccggagcagcccctggacagccccgcggcccccgcgctctctccatccggcctgggcctccagcctgggcccgagcgcaccagtttcaaagaagctggcaccgattccacccaaggtcccctttggccagccgggggctatggcagaccagtccgctggccagccgtccccagtcagcctgtcccccaccccgcccagcaccccgtcaccctatggactgagctaccctcaggggtactccttggcctcgggccagctctccccagctgcagctcctcccctggcctctccttctgtctttacaagcactttgagcaaatcgcggcccactcctaagccgcgacagagacctactctgccgcctcctcagcctcccacagtaaacctctcggcctctagtccacagtccacggaggcccccatgctagatggcatgtcccctggggaaagcatgtctacagctgtgtgacatgagtggcgcagttttggatacgtgtgagggggattttcaggatcttgtccactttgatattccctcgatccacatagagctcgggtcgacgctccgcctgagtcccctggagcacatgcggcgacactcagtaactgacaagagggactcggaggaggagtctgagagcaccgccctctgacatgacaccgcccatcctgcctcgcgtgtacatacatcacgggccctaggaacgccgccaggagcagcgtccatgagcttgccaagtgttctctgctggctctttcctgccactgccaacacgaggttggaatttggcagaaaattgtgatctccagtccgtgtggtgatgctggtggtgcaggttttgtttgttcctttcgggtggtgacttcggccttttgtttgacctttgccttttgactttgtgcctcttttgatccactttcagcctccatgccagaaaacacccacctctccatccaaggctggtcaggaacgtcctttgcagggtcggggtggtgcgggagaggctcactttgcctggttagacccaagggctgctaccttttccttggacggctcatgtcaggtcttgcaggatcagtttaatggccacagaaaggaagcaggacagcagggcccctctcacccacaactggaccaggtccaggattctagcagtcctggggcactgacctttgccagctacctgggggagggcttgccactggaaaacctttcaggccgcccccatcagtgggctccaaagtaaatggctgaaaacaaaaatgtttcacttcctaacagttttcctttttccactgtgtgactgaaagctcctatatcattttatatttctgaatctataaaacaaaacaaacaagcctgacagtgtctggaggagccaaaggtggcctccctgtccccaaatatattggctatatgagagtaattttacccctctacgtacctaaaggcacccagttcactagtctgtggggtcctggagcctgtctcttctttctggaggttcaaactgaatagcaataattacgttacccaaagcatgtggaggaaaagtgaaaccagccacggagacgctggcccacgggctcggcctgcggtgtggcctgctttgctcaccagcgtcagccgctcatttccttctcatgaagtcccatctggtcatggggacgagggccgggagggcaccgggtagccttttcacacttggggattaggggagtgagaaaagatttgggccatgcatgcaaagtcaaagtttaaaattttatccttttcaaatagatgatataatatacctatacatgatataatatttgtatatatgaaatctctctatatttgtttaatttgagccattcaatctaaaccaatgtacaggtgtacaatgaaaaatttaaatgcttagttatttttcccaacacagtgtaaagtcaccctcctctgagagtgggatgtgcagagttttgatgttgcagctttgctcacttcctggcaagggcaggtcatgcctcaatttgtaatgggagtctggggtaagggtgggggttgaaagttgttatctttaaatacatgtacaaatcgttgtcaaaagtaacgttattaaaatagatttattatccctga

SEQ ID NO: 456422 - DNA, 4745 bp, Homo sapiens
gactgggagcaggcagcccgggcggagcgggccggtgccgaggacggccccaggcattgctctgccccgggcattgcgcggcgcgcgtgagggggatgcggcaggaggcggcgcggcgggaggagtaggcggcggcgccctcgggagggagctgcgcgcgggccagacggcgcccggaggctccgcagtgccgccgccgtcgcccgggaggctccgcgcgggagccatgtaaccctgcggcgggctccgggctgctccgtccttccccagctcccgggctagcgcggcagcggggccacgatgaagaagcagttcaatcgcatgcgccagctggccaaccagacggtgggcagggctgaaaagacagaagttttgagtgaagaccttcttcaggtggagaagcgtctggagctggtgaaacaggtgtcccacagcacgcacaagaagctcaccgcatgtctgcagggccagcaaggggcagaggctgacaagcgctccaaaaagttgcctttgacaacactggctcagtgtctgatggaggggtcagctatcctgggagatgacacacttcttgggaagatgctgaaactctgtggagagacggaggacaagctggctcaggagctgatacattttgagttgcaagtagagagagacgtgattgagcccctgtttttgctggcggaggtggaaatcccaaatattcaaaagcagaggaaacacttagccaagttggtgctggacatggattcctcacgaaccaggtggcagcagacttccaagtcttcaggtttgtccagcagcttacagcctgcgggtgccaaggctgatgccctcagggaagaaatggaagaggctgccaacagagtggagatttgcagggaccagctctcagctgatatgtacagttttgtggccaaagaaattgactatgcaaactactttcaaacgctaatagaagtgcaagctgaataccacaggaagtccctgacactattgcaggctgtattgcctcagatcaaagcacaacaggaggcctgggtagagaagccttccttcgggaagccgctggaggagcacctcaccatcagcggccgggagatcgccttccccatcgaggcgtgtgtgaccatgctgcttgagtgtgggatgcaggaggagggactcttccgagtagccccctctgcctccaaactgaagaagctgaaagcggccctggactgctgcgtggtggatgtgcaggagtactcggcagacccccacgcaattgcaggagctttgaaatcttacctccgagagttgccagaacctcttatgacctttgaactctatgatgagtggatccaggcttccaatgtccaggagcaagacaagaagcttcaggctctatggaatgcttgtgaaaagttgcccaaggccaatcacaacaacatccgatacttgataaaatttttatccaagctgtcagaatatcaagatgtaaacaagatgactcccagtaatatggcaattgttttaggacccaacctcctatggccacaagcagaagggaacattacagagatgatgaccacagtgtcgctgcaaattgttgggatcattgaacctatcatccagcatgcagactggttcttccctggggagatagagttcaacattactggcaattatgggagtccagtacacgtgaaccataatgccaactacagctcaatgccctccccagacatggaccctgctgaccggcgccagcccgagcaggcccgccggcccctcagcgtcgccacggataatatgatgctggagttttacaaaaaggatggcatgggtgtgagggtcatggacacaaactgggtggctcgaagaggctcctcggccggtcggaaagtgtcctgcgccccgccctccatgcagcctcccgccccgcccgccgagctggctgcgcccctgccttcgccgctgccggagcagcccctggacagccccgcggcccccgcgctctctccatccggcctgggcctccagcctgggcccgagcgcaccagcacaacaaaaagcaaggaactttctccaggctctgcacagaaaggaagtccaggctccagccagggcacagcctgtgcagggactcaaccaggggctcaacctggagctcagccgggcgccagccccagccccagccagccgcctgcagaccagagtcctcacaccctccggaaagtttcaaagaagctggcaccgattccacccaaggtcccctttggccagccgggggctatggcagaccagtccgctggccagccgtccccagtcagcctgtcccccaccccgcccagcaccccgtcaccctatggactgagctaccctcaggggtactccttggcctcgggccagctctccccagctgcagctcctcccctggcctctccttctgtctttacaagcactttgagcaaatcgcggcccactcctaagccgcgacagagacctactctgccgcctcctcagcctcccacagtaaacctctcggcctctagtccacagtccacggaggcccccatgctagatggcatgtcccctggggaaagcatgtctacagctgtgtgacatgagtggcgcagttttggatacgtgtgagggggattttcaggatcttgtccactttgatattccctcgatccacatagagctcgggtcgacgctccgcctgagtcccctggagcacatgcggcgacactcagtaactgacaagagggactcggaggaggagtctgagagcaccgccctctgacatgacaccgcccatcctgcctcgcgtgtacatacatcacgggccctaggaacgccgccaggagcagcgtccatgagcttgccaagtgttctctgctggctctttcctgccactgccaacacgaggttggaatttggcagaaaattgtgatctccagtccgtgtggtgatgctggtggtgcaggttttgtttgttcctttcgggtggtgacttcggccttttgtttgacctttgccttttgactttgtgcctcttttgatccactttcagcctccatgccagaaaacacccacctctccatccaaggctggtcaggaacgtcctttgcagggtcggggtggtgcgggagaggctcactttgcctggttagacccaagggctgctaccttttccttggacggctcatgtcaggtcttgcaggatcagtttaatggccacagaaaggaagcaggacagcagggcccctctcacccacaactggaccaggtccaggattctagcagtcctggggcactgacctttgccagctacctgggggagggcttgccactggaaaacctttcaggccgcccccatcagtgggctccaaagtaaatggctgaaaacaaaaatgtttcacttcctaacagttttcctttttccactgtgtgactgaaagctcctatatcattttatatttctgaatctataaaacaaaacaaacaagcctgacagtgtctggaggagccaaaggtggcctccctgtccccaaatatattggctatatgagagtaattttacccctctacgtacctaaaggcacccagttcactagtctgtggggtcctggagcctgtctcttctttctggaggttcaaactgaatagcaataattacgttacccaaagcatgtggaggaaaagtgaaaccagccacggagacgctggcccacgggctcggcctgcggtgtggcctgctttgctcaccagcgtcagccgctcatttccttctcatgaagtcccatctggtcatggggacgagggccgggagggcaccgggtagccttttcacacttggggattaggggagtgagaaaagatttgggccatgcatgcaaagtcaaagtttaaaattttatccttttcaaatagatgatataatatacctatacatgatataatatttgtatatatgaaatctctctatatttgtttaatttgagccattcaatctaaaccaatgtacaggtgtacaatgaaaaatttaaatgcttagttatttttcccaacacagtgtaaagtcaccctcctctgagagtgggatgtgcagagttttgatgttgcagctttgctcacttcctggcaagggcaggtcatgcctcaatttgtaatgggagtctggggtaagggtgggggttgaaagttgttatctttaaatacatgtacaaatcgttgtcaaaagtaacgttattaaaatagatttattatccctgagcttggcatctgttcttgctttaataaacctgcggggacatggccgtcaatctcaaatgcacaccgggatggagcctgaaggtcaccacctgtgtaaagccaggtccctggctgatctctcgcttgcttgtcttttgagtttttaaagctcttctttttacattctcctgggtagggaatatacacaataaatactagattcaacttacttacttacttacttactttacttacttacttccttggaaaatgctctccatttgtcgagcactaatccacgtctgtaaatcccgcaaggaggacaatggaaaccagccccgtgtgccatttctcaaaaccttcgagggcaaagtgatcctcactcctctcagtatggaagcaacaacacagcaaatctattgtctccacttttacccagaaccaccagaagacttgcatttccctgaccaatgacaccagcccagccaggctctcactgattg

SEQ ID NO: 456423 - DNA, 4431 bp, Homo sapiens
gactgggagcaggcagcccgggcggagcgggccggtgccgaggacggccccaggcattgctctgccccgggcattgcgcggcgcgcgtgagggggatgcggcaggaggcggcgcggcgggaggagtaggcggcggcgccctcgggagggagctgcgcgcgggccagacggcgcccggaggctccgcagtgccgccgccgtcgcccgggaggctccgcgcgggagccatgtaaccctgcggcgggctccgggctgctccgtccttccccagctcccgggctagcgcggcagcggggccacgatgaagaagcagttcaatcgcatgcgccagctggccaaccagacggtgggcagggctgaaaagacagaagttttgagtgaagaccttcttcaggtggagaagcgtctggagctggtgaaacaggtgtcccacagcacgcacaagaagctcaccgcatgtctgcagggccagcaaggggcagaggctgacaagcgctccaaaaagttgcctttgacaacactggctcagtgtctgatggaggggtcagctatcctgggagatgacacacttcttgggaagatgctgaaactctgtggagagacggaggacaagctggctcaggagctgatacattttgagttgcaagtagagagagacgtgattgagcccctgtttttgctggcggaggtggaaatcccaaatattcaaaagcagaggaaacacttagccaagttggtgctggacatggattcctcacgaaccaggtggcagcagacttccaagtcttcaggtttgtccagcagcttacagcctgcgggtgccaaggctgatgccctcagggaagaaatggaagaggctgccaacagagtggagatttgcagggaccagctctcagctgatatgtacagttttgtggccaaagaaattgactatgcaaactactttcaaacgctaatagaagtgcaagctgaataccacaggaagtccctgacactattgcaggctgtattgcctcagatcaaagcacaacaggaggcctgggtagagaagccttccttcgggaagccgctggaggagcacctcaccatcagcggccgggagatcgccttccccatcgaggcgtgtgtgaccatgctgcttgagtgtgggatgcaggaggagggactcttccgagtagccccctctgcctccaaactgaagaagctgaaagcggccctggactgctgcgtggtggatgtgcaggagtactcggcagacccccacgcaattgcaggagctttgaaatcttacctccgagagttgccagaacctcttatgacctttgaactctatgatgagtggatccaggcttccaatgtccaggagcaagacaagaagcttcaggctctatggaatgcttgtgaaaagttgcccaaggccaatcacaacaacatccgatacttgataaaatttttatccaagctgtcagaatatcaagatgtaaacaagatgactcccagtaatatggcaattgttttaggacccaacctcctatggccacaagcagaagggaacattacagagatgatgaccacagtgtcgctgcaaattgttgggatcattgaacctatcatccagcatgcagactggttcttccctggggagatagagttcaacattactggcaattatgggagtccagtacacgtgaaccataatgccaactacagctcaatgccctccccagacatggaccctgctgaccggcgccagcccgagcaggcccgccggcccctcagcgtcgccacggataatatgatgctggagttttacaaaaaggatggcatgggtgtgagggtcatggacacaaactgggtggctcgaagaggctcctcggccggtcggaaagtgtcctgcgccccgccctccatgcagcctcccgccccgcccgccgagctggctgcgcccctgccttcgccgctgccggagcagcccctggacagccccgcggcccccgcgctctctccatccggcctgggcctccagcctgggcccgagcgcaccagcacaacaaaaagcaaggaactttctccaggctctgcacagaaaggaagtccaggctccagccagggcacagcctgtgcagggactcaaccaggggctcaacctggagctcagccgggcgccagccccagccccagccagccgcctgcagaccagagtcctcacaccctccggaaagtttcaaagaagctggcaccgattccacccaaggtcccctttggccagccgggggctatggcagaccagtccgctggccagccgtccccagtcagcctgtcccccaccccgcccagcaccccgtcaccctatggactgagctaccctcaggggtactccttggcctcgggccagctctccccagctgcagctcctcccctggcctctccttctgtctttacaagcactttgagcaaatcgcggcccactcctaagccgcgacagagacctactctgccgcctcctcagcctcccacagtaaacctctcggcctctagtccacagtccacggaggcccccatgctagatggcatgtcccctggggaaagcatgtctacagctgtgtgacatgagtggcgcagttttggatacgtgtgagggggattttcaggatcttgtccactttgatattccctcgatccacatagagctcgggtcgacgctccgcctgagtcccctggagcacatgcggcgacactcagtaactgacaagagggactcggaggaggagtctgagagcaccgccctctgacatgacaccgcccatcctgcctcgcgtgtacatacatcacgggccctaggaacgccgccaggagcagcgtccatgagcttgccaagtgttctctgctggctctttcctgccactgccaacacgaggttggaatttggcagaaaattgtgatctccagtccgtgtggtgatgctggtggtgcaggttttgtttgttcctttcgggtggtgacttcggccttttgtttgacctttgccttttgactttgtgcctcttttgatccactttcagcctccatgccagaaaacacccacctctccatccaaggctggtcaggaacgtcctttgcagggtcggggtggtgcgggagaggctcactttgcctggttagacccaagggctgctaccttttccttggacggctcatgtcaggtcttgcaggatcagtttaatggccacagaaaggaagcaggacagcagggcccctctcacccacaactggaccaggtccaggattctagcagtcctggggcactgacctttgccagctacctgggggagggcttgccactggaaaacctttcaggccgcccccatcagtgggctccaaagtaaatggctgaaaacaaaaatgtttcacttcctaacagttttcctttttccactgtgtgactgaaagctcctatatcattttatatttctgaatctataaaacaaaacaaacaagcctgacagtgtctggaggagccaaaggtggcctccctgtccccaaatatattggctatatgagagtaattttacccctctacgtacctaaaggcacccagttcactagtctgtggggtcctggagcctgtctcttctttctggaggttcaaactgaatagcaataattacgttacccaaagcatgtggaggaaaagtgaaaccagccacggagacgctggcccacgggctcggcctgcggtgtggcctgctttgctcaccagcgtcagccgctcatttccttctcatgaagtcccatctggtcatggggacgagggccgggagggcaccgggtagccttttcacacttggggattaggggagtgagaaaagatttgggccatgcatgcaaagtcaaagtttaaaattttatccttttcaaatagatgatataatatacctatacatgatataatatttgtatatatgaaatctctctatatttgtttaatttgagccattcaatctaaaccaatgtacaggtgtacaatgaaaaatttaaatgcttagttatttttcccaacacagtgtaaagtcaccctcctctgagagtgggatgtgcagagttttgatgttgcagctttgctcacttcctggcaagggcaggtcatgcctcaatttgtaatgggagtctggggtaagggtgggggttgaaagttgttatctttaaatacatgtacaaatcgttgtcaaaagtaacgttattaaaatagatttattatccctgaaaaaaaaaaaaaaaaaaaaaagaaacaaaaaaaaggggaaaaaaaaaaaaaaaaaaaaaaaaagttgtgtgggggagcaggggggcagaaaaaaggttttaaaaaaattgtgttgggggggggggcccaggggtgagaaaaaggggggaaagggggggcgaaaaaacg

SEQ ID NO: 456424 - DNA, 6265 bp, Homo sapiens
  misc_feature (3450)..(3450): n is a, c, g, or t
  misc_feature (4421)..(4421): n is a, c, g, or t
  misc_feature (4529)..(4529): n is a, c, g, or t
gactgggagcaggcagcccgggcggagcgggccggtgccgaggacggccccaggcattgctctgccccgggcattgcgcggcgcgcgtgagggggatgcggcaggaggcggcgcggcgggaggagtaggcggcggcgccctcgggagggagctgcgcgcgggccagacggcgcccggaggctccgcagtgccgccgccgtcgcccgggaggctccgcgcgggagccatgtaaccctgcggcgggctccgggctgctccgtccttccccagctcccgggctagcgcggcagcggggccacgatgaagaagcagttcaatcgcatgcgccagctggccaaccagacggtgggcagggctgaaaagacagaagttttgagtgaagaccttcttcaggtggagaagcgtctggagctggtgaaacaggtgtcccacagcacgcacaagaagctcaccgcatgtctgcagggccagcaaggggcagaggctgacaagcgctccaaaaagttgcctttgacaacactggctcagtgtctgatggaggggtcagctatcctgggagatgacacacttcttgggaagatgctgaaactctgtggagagacggaggacaagctggctcaggagctgatacattttgagttgcaagtagagagagacgtgattgagcccctgtttttgctggcggaggtggaaatcccaaatattcaaaagcagaggaaacacttagccaagttggtgctggacatggattcctcacgaaccaggtggcagcagacttccaagtcttcaggtttgtccagcagcttacagcctgcgggtgccaaggctgatgccctcagggaagaaatggaagaggctgccaacagagtggagatttgcagggaccagctctcagctgatatgtacagttttgtggccaaagaaattgactatgcaaactactttcaaacgctaatagaagtgcaagctgaataccacaggaagtccctgacactattgcaggctgtattgcctcagatcaaagcacaacaggaggcctgggtagagaagccttccttcgggaagccgctggaggagcacctcaccatcagcggccgggagatcgccttccccatcgaggcgtgtgtgaccatgctgcttgagtgtgggatgcaggaggagggactcttccgagtagccccctctgcctccaaactgaagaagctgaaagcggccctggactgctgcgtggtggatgtgcaggagtactcggcagacccccacgcaattgcaggagctttgaaatcttacctccgagagttgccagaacctcttatgacctttgaactctatgatgagtggatccaggcttccaatgtccaggagcaagacaagaagcttcaggctctatggaatgcttgtgaaaagttgcccaaggccaatcacaacaacatccgatacttgataaaatttttatccaagctgtcagaatatcaagatgtaaacaagatgactcccagtaatatggcaattgttttaggacccaacctcctatggccacaagcagaagggaacattacagagatgatgaccacagtgtcgctgcaaattgttgggatcattgaacctatcatccagcatgcagactggttcttccctggggagatagagttcaacattactggcaattatgggagtccagtacacgtgaaccataatgccaactacagctcaatgccctccccagacatggaccctgctgaccggcgccagcccgagcaggcccgccggcccctcagcgtcgccacggataatatgatgctggagttttacaaaaaggatggcatgggtgtgagggtcatggacacaaactgggtggctcgaagaggctcctcggccggtcggaaagtgtcctgcgccccgccctccatgcagcctcccgccccgcccgccgagctggctgcgcccctgccttcgccgctgccggagcagcccctggacagccccgcggcccccgcgctctctccatccggcctgggcctccagcctgggcccgagcgcaccagcacaacaaaaagcaaggaactttctccaggctctgcacagaaaggaagtccaggctccagccagggcacagcctgtgcagggactcaaccaggggctcaacctggagctcagccgggcgccagccccagccccagccagccgcctgcagaccagagtcctcacaccctccggaaagtttcaaagaagctggcaccgattccacccaaggtcccctttggccagccgggggctatggcagaccagtccgctggccagccgtccccagtcagcctgtcccccaccccgcccagcaccccgtcaccctatggactgagctaccctcaggggtactccttggcctcgggccagctctccccagctgcagctcctcccctggcctctccttctgtctttacaagcactttgagcaaatcgcggcccactcctaagccgcgacagagacctactctgccgcctcctcagcctcccacagtaaacctctcggcctctagtccacagtccacggaggcccccatgctagatggcatgtcccctggggaaagcatgtctacaggtaaccaagccacaggctccctcacttttttttatgaactttagtgaaatgtgcctaggggatggattgctagagttactgccagtgaacacattcctgcgtgctttgggatgactgggctggcaccaggggtagctcataagatctccttagaagcccaccaatggaaagcaaccctggaatccatgtgtcccacacaggggcttcttatgggatctctctcggtctaagcccaccagcctggggttctgtttttgctcttattatcgggggttgaagacactgagtcatttggagtggggcctcaggagaggctggaagctggttatgatcacaaaacagcatcaaaactcaggtatttcctggatagagcccaagcaactgacaggtataaatgcttatctggagaacaggggctaagaacccaagatgttttttactattactaaaataagccttgctagaaaaatatacttccagatagatatttagagaggggtgaatttcagaaaacatgcatgtctccattctcctccaccagactcccctccctggccaattccctgaggagctaattggacaaacccacaacgacttaatttagtttgggcttaaatttagaaacaaagacggagctctcttcccccagaaaaatctgtaagcacaaaatcgcaaacacacaccacgtttagccaaaaccattcattggctggaaggaacgggatgtttttggaacatctccccagacacttcaaccacataagattataaagtcaggggcctatttgtggtggctgctaaagtcatttgagcattttccttgttcagggagacaggcacagggttgagcngtgtcttgggctagagccaacccacttagtaaagtgcagtagcatggcggtgagctggagcatatgtgtacctagtgttgtcccaagtagcagaaggtgaggcagcttgggttggaacacacacaccacatacacacacacccactcacccatttcaaagaacagtgctgtcctaggatgcactgggacttttgtgataatgcacttttccctccacgtccttctccaaaagagtgatttatttcttccgtgattagacggaagcagtgaccctgtggggttcagctccgtgctgcctttgaaaaggctagtccaatttgcaagtgtttgtactgggtcagatttaaatattacggggaagagccatctggtgattcggcttctttatttttggatgtgattaatgttgaaggtacagctgctgtcatctaccccgaggcttattaaaaattaggcaaatttctccctggaaaatgcagtagcaccacgcccatcttggtgggtcttggtgctgaggtgtctcctgaaggagcccatgataggagggcacaggcttgctgccctcggggaaggtcacagctgcggaggagctgaaggtcacccgagccaggtctccagggctgctcctcccagtgtgtcacatctggtgactcttccagccaccccagggaagggacacaaggtagtgtcaatacataagcaatagaatgagcagaagatggccaggcacggtggctcacgcctgtaatcccagcactttgggaggccgaggagaattagttgggcatggtggcacgtgccactagtcccagctacttgggaggctgaggtaggagaattgcttgaacctgggaggtggagccgagattgtgccactgcattccagcctggcaacagagcgagactccatctcaaaaaaaaaaaaaaaaaaaaaaaaagaatgagcagaagatatcaatggagaagcaganaagagcagaaggagaggagaaattggggaacaaaagtgggcaacagaaggcctgggaggacagcacccccagggctctaagaagcggagtggctcatgttccatcttncaggtttaagaactcctgaccttcaggattcataatgtccctcgccctgtgcggaccctattttaatgtccttttggcagcagactgttgttttgtcccatacgttcaggtctctgagccagtgtagaatccatcatggtttgatgtggcccgtctgggactgtgatattggcatagcttttttttttttttgtgacgttcatgttttgtcgtgttgattcctttctccgaatcctatcattgtgttcttgcagctgtgtgacatgagtggcgcagttttggatacgtgtgagggggattttcagggtaagctggccccggcctcgcccctccaccccgctagctagccaggccagctgcccgctcctcccctccgctcctcgtctctgcatgtggctcagaccatttgcatggcagcttcactctccagccttccccggcctcagcaaggatgagttgatccatgagcttatttggctttggggcatccctggcctccttttctttcttttcattaggaggagctgggggagaacccagccagcccctttcccccaccttctctttcactggaatcacatctgcagctcctccccctccgccctccctcaggcttagaccgtggagctgtaacagatctgttcttcgtgtgagacttttgtgctggagacgcttgtgcccagcaccctgggggacatgcacctgctcacctttgtttaggaaggcgtcctgaggggaggtcataccaggtgcagcccagcacagggtccacaccacagcttggaccccattttctgtggccccgagtttgcaccagcagatctccccttccagacttagatcctaacgtctggcttcctccaggctgagactgctggcaaatcctaaagaatccatatcggagctcatcccgctccccttctccctcatcccaagtggatatggccagacagatcctttctatccaactcaataaaatttgggggagcatttatatcagtatctatttggtctcctcctcctataaagagtaaatcctcaaagcataactgagggaaaggcacgaaggaagccagaaggactttggtgtatttgcctcagtaagtaggggtggccaaagcaaaccaggtcttctccccgatttggcccatggtcctgcagagactaccgaggcgcaccaggatatctggtgctcacagacaggtctcctggcgggtgcttcccgagtgtcctggagacaagcagccactgtgtcccttttcccaggaatgctgatgagggcttctgcccctgaatcccattcccttgcatagtgactcctcccttgggggtgtctttaagggagcagcaaggataaaggtatgacagctcacacaagtgcttgttctgggcctgtctaaattcatcaccgccctgtattattcccatttgactgctgaggcacagggaaggtaggaaacttgtccaaggtcatgctcttcctgcctgacatatttgggatttttgaatctaagcaggggagcttggtgctcttacctgatagcgaaccctgcacagtgaggtgggccccgggccactcagcctcacacctgtgtagagacatgacccaagtagctggggaagggcagaggtgggtctgaggccacctgcttcagaggttgcagtgagccgagattgtgccattgcactccagtctgtgtgacaagagcgaaactccaccccccccaaaaaaaaaa

SEQ ID NO: 456425 - DNA, 677 bp, Homo sapiens
gaccagtggaatgatcaaagagaagaaatggcattatcaaaagagcaatagcacaatgtgtgcttggagcttgcttcagaataggggcacaagctgtagagatggatggaactaatttgcacatcactcctctacaccaactttgactttaactgtggtccaaatgtcaaaatctctggggaaatgactgacataggtgttcttttcaaacttacgcatttttcagagttgtggttgacaaatatgcaaatgcccatggaaagtttgtatcatatcaagtattaaaaaggagattaagcagtgtttaaggctctttctcacgtgatgtgttgacttatgcattagccactctccattggtttatgttttaccttggttgtatattttaccttgcacaggaccagctctcagctgatatgtacagttttgtggccaaagaaattgactatgcaaactactttcaaacggtaagtgcccagaaaggtgagattgcttaaaggctgttcgtaggagaagggaatgtgggcatggaattaagagtcccttaattgatcacatcatagaaaaaggtgggagctttgaccattttactagtgaaataaatcctgccatgctcctgatatggatttctccaaaaaccttagaataaaactcaatcccatccctcgggattattg

SEQ ID NO: 456426 - DNA, 4229 bp, Homo sapiens
gactgggagcaggcagcccgggcggagcgggccggtgccgaggacggccccaggcattgctctgccccgggcattgcgcggcgcgcgtgagggggatgcggcaggaggcggcgcggcgggaggagtaggcggcggcgccctcgggagggagctgcgcgcgggccagacggcgcccggaggctccgcagtgccgccgccgtcgcccgggaggctccgcgcgggagccatgtaaccctgcggcgggctccgggctgctccgtccttccccagctcccgggctagcgcggcagcggggccacgatgaagaagcagttcaatcgcatgcgccagctggccaaccagacggtgggcagggctgaaaagacagaagttttgagtgaagaccttcttcaggtggagaagcgtctggagctggtgaaacaggtgtcccacagcacgcacaagaagctcaccgcatgtctgcagggccagcaaggggcagaggctgacaagcgctccaaaaagttgcctttgacaacactggctcagtgtctgatggaggggtcagctatcctgggagatgacacacttcttgggaagatgctgaaactctgtggagagacggaggacaagctggctcaggagctgatacattttgagttgcaagtagagagagacgtgattgagcccctgtttttgctggcggaggtggaaatcccaaatattcaaaagcagaggaaacacttagccaagttggtgctggacatggattcctcacgaaccaggtggcagcagacttccaagtcttcaggtttgtccagcagcttacagcctgcgggtgccaaggctgatgccctcagggaagaaatggaagaggctgccaacagagtggagatttgcagggaccagctctcagctgatatgtacagttttgtggccaaagaaattgactatgcaaactactttcaaacgctaatagaagtgcaagctgaataccacaggaagtccctgacactattgcaggctgtattgcctcagatcaaagcacaacaggaggcctgggtagagaagccttccttcgggaagccgctggaggagcacctcaccatcagcggccgggagatcgccttccccatcgaggcgtgtgtgaccatgctgcttgagtgtgggatgcaggaggagggactcttccgagtagccccctctgcctccaaactgaagaagctgaaagcggccctggactgctgcgtggtggatgtgcaggagtactcggcagacccccacgcaattgcaggagctttgaaatcttacctccgagagttgccagaacctcttatgacctttgaactctatgatgagtggatccaggcttccaatgtccaggagcaagacaagaagcttcaggctctatggaatgcttgtgaaaagttgcccaaggccaatcacaacaacatccgatacttgataaaatttttatccaagctgtcagaatatcaagatgtaaacaagatgactcccagtaatatggcaattgttttaggacccaacctcctatggccacaagcagaagggaacattacagagatgatgaccacagtgtcgctgcaaattgttgggatcattgaacctatcatccagcatgcagactggttcttccctggggagatagagttcaacattactggcaattatgggagtccagtacacgtgaaccataatgccaactacagctcaatgccctccccagacatggaccctgctgaccggcgccagcccgagcaggcccgccggcccctcagcgtcgccacggataatatgatgctggagttttacaaaaaggatggccttaggaaaatccaaagcatgggtgtgagggtcatggacacaaactgggtggctcgaagaggctcctcggccggtcggaaagtgtcctgcgccccgccctccatgcagcctcccgccccgcccgccgagctggctgcgcccctgccttcgccgctgccggagcagcccctggacagccccgcggcccccgcgctctctccatccggcctgggcctccagcctgggcccgagcgcaccagcacaacaaaaagcaaggaactttctccaggctctgcacagaaaggaagtccaggctccagccagggcacagcctgtgcagggactcaaccaggggctcaacctggagctcagccgggcgccagccccagccccagccagccgcctgcagaccagagtcctcacaccctccggaaagtttcaaagaagctggcaccgattccacccaaggtcccctttggccagccgggggctatggcagaccagtccgctggccagccgtccccagtcagcctgtcccccaccccgcccagcaccccgtcaccctatggactgagctaccctcaggggtactccttggcctcgggccagctctccccagctgcagctcctcccctggcctctccttctgtctttacaagcactttgagcaaatcgcggcccactcctaagccgcgacagagacctactctgccgcctcctcagcctcccacagtaaacctctcggcctctagtccacagtccacggaggcccccatgctagatggcatgtcccctggggaaagcatgtctacagatcttgtccactttgatattccctcgatccacatagagctcgggtcgacgctccgcctgagtcccctggagcacatgcggcgacactcagtaactgacaagagggactcggaggaggagtctgagagcaccgccctctgacatgacaccgcccatcctgcctcgcgtgtacatacatcacgggccctaggaacgccgccaggagcagcgtccatgagcttgccaagtgttctctgctggctctttcctgccactgccaacacgaggttggaatttggcagaaaattgtgatctccagtccgtgtggtgatgctggtggtgcaggttttgtttgttcctttcgggtggtgacttcggccttttgtttgacctttgccttttgactttgtgcctcttttgatccactttcagcctccatgccagaaaacacccacctctccatccaaggctggtcaggaacgtcctttgcagggtcggggtggtgcgggagaggctcactttgcctggttagacccaagggctgctaccttttccttggacggctcatgtcaggtcttgcaggatcagtttaatggccacagaaaggaagcaggacagcagggcccctctcacccacaactggaccaggtccaggattctagcagtcctggggcactgacctttgccagctacctgggggagggcttgccactggaaaacctttcaggccgcccccatcagtgggctccaaagtaaatggctgaaaacaaaaatgtttcacttcctaacagttttcctttttccactgtgtgactgaaagctcctatatcattttatatttctgaatctataaaacaaaacaaacaagcctgacagtgtctggaggagccaaaggtggcctccctgtccccaaatatattggctatatgagagtaattttacccctctacgtacctaaaggcacccagttcactagtctgtggggtcctggagcctgtctcttctttctggaggttcaaactgaatagcaataattacgttacccaaagcatgtggaggaaaagtgaaaccagccacggagacgctggcccacgggctcggcctgcggtgtggcctgctttgctcaccagcgtcagccgctcatttccttctcatgaagtcccatctggtcatggggacgagggccgggagggcaccgggtagccttttcacacttggggattaggggagtgagaaaagatttgggccatgcatgcaaagtcaaagtttaaaattttatccttttcaaatagatgatataatatacctatacatgatataatatttgtatatatgaaatctctctatatttgtttaatttgagccattcaatctaaaccaatgtacaggtgtacaatgaaaaatttaaatgcttagttatttttcccaacacagtgtaaagtcaccctcctctgagagtgggatgtgcagagttttgatgttgcagctttgctcacttcctggcaagggcaggtcatgcctcaatttgtaatgggagtctggggtaagggtgggggttgaaagttgttatctttaaatacatgtacaaatcgttgtcaaaagtaacgttattaaaatagatttattatccctga

SEQ ID NO: 456427 - DNA, 4615 bp, Homo sapiens
  misc_feature (1271)..(1271): n is a, c, g, or t
  misc_feature (2242)..(2242): n is a, c, g, or t
  misc_feature (2350)..(2350): n is a, c, g, or t
  misc_feature (4427)..(4427): n is a, c, g, or t
acaactttgtgttttgttgttgtgttgtgttttctctttcagtttcaaagaagctggcaccgattccacccaaggtcccctttggccagccgggggctatggcagaccagtccgctggccagccgtccccagtcagcctgtcccccaccccgcccagcaccccgtcaccctatggactgagctaccctcaggggtactccttggcctcgggccagctctccccagctgcagctcctcccctggcctctccttctgtctttacaagcactttgagcaaatcgcggcccactcctaagccgcgacagagacctactctgccgcctcctcagcctcccacagtaaacctctcggcctctagtccacagtccacggaggcccccatgctagatggcatgtcccctggggaaagcatgtctacaggtaaccaagccacaggctccctcacttttttttatgaactttagtgaaatgtgcctaggggatggattgctagagttactgccagtgaacacattcctgcgtgctttgggatgactgggctggcaccaggggtagctcataagatctccttagaagcccaccaatggaaagcaaccctggaatccatgtgtcccacacaggggcttcttatgggatctctctcggtctaagcccaccagcctggggttctgtttttgctcttattatcgggggttgaagacactgagtcatttggagtggggcctcaggagaggctggaagctggttatgatcacaaaacagcatcaaaactcaggtatttcctggatagagcccaagcaactgacaggtataaatgcttatctggagaacaggggctaagaacccaagatgttttttactattactaaaataagccttgctagaaaaatatacttccagatagatatttagagaggggtgaatttcagaaaacatgcatgtctccattctcctccaccagactcccctccctggccaattccctgaggagctaattggacaaacccacaacgacttaatttagtttgggcttaaatttagaaacaaagacggagctctcttcccccagaaaaatctgtaagcacaaaatcgcaaacacacaccacgtttagccaaaaccattcattggctggaaggaacgggatgtttttggaacatctccccagacacttcaaccacataagattataaagtcaggggcctatttgtggtggctgctaaagtcatttgagcattttccttgttcagggagacaggcacagggttgagcngtgtcttgggctagagccaacccacttagtaaagtgcagtagcatggcggtgagctggagcatatgtgtacctagtgttgtcccaagtagcagaaggtgaggcagcttgggttggaacacacacaccacatacacacacacccactcacccatttcaaagaacagtgctgtcctaggatgcactgggacttttgtgataatgcacttttccctccacgtccttctccaaaagagtgatttatttcttccgtgattagacggaagcagtgaccctgtggggttcagctccgtgctgcctttgaaaaggctagtccaatttgcaagtgtttgtactgggtcagatttaaatattacggggaagagccatctggtgattcggcttctttatttttggatgtgattaatgttgaaggtacagctgctgtcatctaccccgaggcttattaaaaattaggcaaatttctccctggaaaatgcagtagcaccacgcccatcttggtgggtcttggtgctgaggtgtctcctgaaggagcccatgataggagggcacaggcttgctgccctcggggaaggtcacagctgcggaggagctgaaggtcacccgagccaggtctccagggctgctcctcccagtgtgtcacatctggtgactcttccagccaccccagggaagggacacaaggtagtgtcaatacataagcaatagaatgagcagaagatggccaggcacggtggctcacgcctgtaatcccagcactttgggaggccgaggagaattagttgggcatggtggcacgtgccactagtcccagctacttgggaggctgaggtaggagaattgcttgaacctgggaggtggagccgagattgtgccactgcattccagcctggcaacagagcgagactccatctcaaaaaaaaaaaaaaaaaaaaaaaaagaatgagcagaagatatcaatggagaagcaganaagagcagaaggagaggagaaattggggaacaaaagtgggcaacagaaggcctgggaggacagcacccccagggctctaagaagcggagtggctcatgttccatcttncaggtttaagaactcctgaccttcaggattcataatgtccctcgccctgtgcggaccctattttaatgtccttttggcagcagactgttgttttgtcccatacgttcaggtctctgagccagtgtagaatccatcatggtttgatgtggcccgtctgggactgtgatattggcatagcttttttttttttttgtgacgttcatgttttgtcgtgttgattcctttctccgaatcctatcattgtgttcttgcagctgtgtgacatgagtggcgcagttttggatacgtgtgagggggattttcagggtaagctggccccggcctcgcccctccaccccgctagctagccaggccagctgcccgctcctcccctccgctcctcgtctctgcatgtggctcagaccatttgcatggcagcttcactctccagccttccccggcctcagcaaggatgagttgatccatgagcttatttggctttggggcatccctggcctccttttctttcttttcattaggaggagctgggggagaacccagccagcccctttcccccaccttctctttcactggaatcacatctgcagctcctccccctccgccctccctcaggcttagaccgtggagctgtaacagatctgttcttcgtgtgagacttttgtgctggagacgcttgtgcccagcaccctgggggacatgcacctgctcacctttgtttaggaaggcgtcctgaggggaggtcataccaggtgcagcccagcacagggtccacaccacagcttggaccccattttctgtggccccgagtttgcaccagcagatctccccttccagacttagatcctaacgtctggcttcctccaggctgagactgctggcaaatcctaaagaatccatatcggagctcatcccgctccccttctccctcatcccaagtggatatggccagacagatcctttctatccaactcaataaaatttgggggagcatttatatcagtatctatttggtctcctcctcctataaagagtaaatcctcaaagcataactgagggaaaggcacgaaggaagccagaaggactttggtgtatttgcctcagtaagtaggggtggccaaagcaaaccaggtcttctccccgatttggcccatggtcctgcagagactaccgaggcgcaccaggatatctggtgctcacagacaggtctcctggcgggtgcttcccgagtgtcctggagacaagcagccactgtgtcccttttcccaggaatgctgatgagggcttctgcccctgaatcccattcccttgcatagtgactcctcccttgggggtgtctttaagggagcagcaaggataaaggtatgacagctcacacaagtgcttgttctgggcctgtctaaattcatcaccgccctgtattattcccatttgactgctgaggcacagggaaggtaggaaacttgtccaaggtcatgctcttcctgcctgacatatttgggatttttgaatctaagcaggggagcttggtgctcttacctgatagcgaaccctgcacagtgaggtgggccccgggccactcagcctcacacctgtgtagagacatgacccaagtagctggggaagggcagaggtgggtctgaggccacctgcttcagaggaacaagtggcactggctgttcctccagccccacgccccaaatctctgcttctccatcaggcagcaaaacaaagactggaaggacgtgagggctgcctgggggttggggcaagggaggacctttgttcaagagcttccatgtttgtatgatgtctttcaggacagtgtccaaatgtatgtctgtacacttagtatggtattccccagtctgaacatgtgttcccttcctctgcctcctggagtgctgctcccagccttgcaaagctaagtgacggccagaaactaagcaggcaggccgggcgtggttgctcacgcctgtaatcccaaaactttgggaggctgaagtgggtgaatcacctgaggtcatgagttcgagaccagcctggccaacatggtgaaacccaatctctactaaaaacnccaaaaaaaaaaaaaaaaaaaaaattagccgggcatggtggtgggtgcctgtaatcccagctactcgggaggctgaggcaggagaatcgcttgaacccaggaggcagaggttgcagtgagccgagattgtgccattgcactccagtctgtgtgacaagagcgaaactccaccccccccaaaaaaaaaa

SEQ ID NO: 456428 - DNA, 4136 bp, Homo sapiens
gactgggagcaggcagcccgggcggagcgggccggtgccgaggacggccccaggcattgctctgccccgggcattgcgcggcgcgcgtgagggggatgcggcaggaggcggcgcggcgggaggagtaggcggcggcgccctcgggagggagctgcgcgcgggccagacggcgcccggaggctccgcagtgccgccgccgtcgcccgggaggctccgcgcgggagccatgtaaccctgcggcgggctccgggctgctccgtccttccccagctcccgggctagcgcggcagcggggccacgatgaagaagcagttcaatcgcatgcgccagctggccaaccagacggtgggcagggctgaaaagacagaagttttgagtgaagaccttcttcaggtggagaagcgtctggagctggtgaaacaggtgtcccacagcacgcacaagaagctcaccgcatgtctgcagggccagcaaggggcagaggctgacaagcgctccaaaaagttgcctttgacaacactggctcagtgtctgatggaggggtcagctatcctgggagatgacacacttcttgggaagatgctgaaactctgtggagagacggaggacaagctggctcaggagctgatacattttgagttgcaagtagagagagacgtgattgagcccctgtttttgctggcggaggtggaaatcccaaatattcaaaagcagaggaaacacttagccaagttggtgctggacatggattcctcacgaaccaggtggcagcagacttccaagtcttcaggtttgtccagcagcttacagcctgcgggtgccaaggctgatgccctcagggaagaaatggaagaggctgccaacagagtggagatttgcagggaccagctctcagctgatatgtacagttttgtggccaaagaaattgactatgcaaactactttcaaacgctaatagaagtgcaagctgaataccacaggaagtccctgacactattgcaggctgtattgcctcagatcaaagcacaacaggaggcctgggtagagaagccttccttcgggaagccgctggaggagcacctcaccatcagcggccgggagatcgccttccccatcgaggcgtgtgtgaccatgctgcttgagtgtgggatgcaggaggagggactcttccgagtagccccctctgcctccaaactgaagaagctgaaagcggccctggactgctgcgtggtggatgtgcaggagtactcggcagacccccacgcaattgcaggagctttgaaatcttacctccgagagttgccagaacctcttatgacctttgaactctatgatgagtggatccaggcttccaatgtccaggagcaagacaagaagcttcaggctctatggaatgcttgtgaaaagttgcccaaggccaatcacaacaacatccgatacttgataaaatttttatccaagctgtcagaatatcaagatgtaaacaagatgactcccagtaatatggcaattgttttaggacccaacctcctatggccacaagcagaagggaacattacagagatgatgaccacagtgtcgctgcaaattgttgggatcattgaacctatcatccagcatgcagactggttcttccctggggagatagagttcaacattactggcaattatgggagtccagtacacgtgaaccataatgccaactacagctcaatgccctccccagacatggaccctgctgaccggcgccagcccgagcaggcccgccggcccctcagcgtcgccacggataatatgatgctggagttttacaaaaaggatggcatgggtgtgagggtcatggacacaaactgggtggctcgaagaggctcctcggccggtcggaaagtgtcctgcgccccgccctccatgcagcctcccgccccgcccgccgagctggctgcgcccctgccttcgccgctgccggagcagcccctggacagccccgcggcccccgcgctctctccatccggcctgggcctccagcctgggcccgagcgcaccagcacaacaaaaagcaaggaactttctccaggctctgcacagaaaggaagtccaggctccagccagggcacagcctgtgcagggactcaaccaggggctcaacctggagctcagccgggcgccagccccagccccagccagccgcctgcagaccagagtcctcacaccctccggaaagtttcaaagaagctggcaccgattccacccaaggtcccctttggccagccgggggctatggcagaccagtccgctggccagccgtccccagtcagcctgtcccccaccccgcccagcaccccgtcaccctatggactgagctaccctcaggggtactccttggcctcgggccagctctccccagctgcagctcctcccctggcctctccttctgtctttacaagcactttgagcaaatcgcggcccactcctaagccgcgacagagacctactctgccgcctcctcagcctcccacagtaaacctctcggcctctagtccacagtccacggaggcccccatgctagatggcatgtcccctggggaaagcatgtctacagctgtgtgacatgagtggcgcagttttggatacgtgtgagggggattttcaggatcttgtccactttgatattccctcgatccacatagagctcgggtcgacgctccgcctgagtcccctggagcacatgcggcgacactcagtaactgacaagagggactcggaggaggagtctgagagcaccgccctctgacatgacaccgcccatcctgcctcgcgtgtacatacatcacgggccctaggaacgccgccaggagcagcgtccatgagcttgccaagtgttctctgctggctctttcctgccactgccaacacgaggttggaatttggcagaaaattgtgatctccagtccgtgtggtgatgctggtggtgcaggttttgtttgttcctttcgggtggtgacttcggccttttgtttgacctttgcctggttagacccaagggctgctaccttttccttggacggctcatgtcaggtcttgcaggatcagtttaatggccacagaaaggaagcaggacagcagggcccctctcacccacaactggaccaggtccaggattctagcagtcctggggcactgacctttgccagctacctgggggagggcttgccactggaaaacctttcaggccgcccccatcagtgggctccaaagtaaatggctgaaaacaaaaatgtttcacttcctaacagttttcctttttccactgtgtgactgaaagctcctatatcattttatatttctgaatctataaaacaaaacaaacaagcctgacagtgtctggaggagccaaaggtggcctccctgtccccaaatatattggctatatgagagtaattttacccctctacgtacctaaaggcacccagttcactagtctgtggggtcctggagcctgtctcttctttctggaggttcaaactgaatagcaataattacgttacccaaagcatgtggaggaaaagtgaaaccagccacggagacgctggcccacgggctcggcctgcggtgtggcctgctttgctcaccagcgtcagccgctcatttccttctcatgaagtcccatctggtcatggggacgagggccgggagggcaccgggtagccttttcacacttggggattaggggagtgagaaaagatttgggccatgcatgcaaagtcaaagtttaaaattttatccttttcaaatagatgatataatatacctatacatgatataatatttgtatatatgaaatctctctatatttgtttaatttgagccattcaatctaaaccaatgtacaggtgtacaatgaaaaatttaaatgcttagttatttttcccaacacagtgtaaagtcaccctcctctgagagtgggatgtgcagagttttgatgttgcagctttgctcacttcctggcaagggcaggtcatgcctcaatttgtaatgggagtctggggtaagggtgggggttgaaagttgttatctttaaatacatgtacaaatcgttgtcaaaagtaacgttattaaaatagatttattatccctga

SEQ ID NO: 456429 - DNA, 3961 bp, Homo sapiens
gactgggagcaggcagcccgggcggagcgggccggtgccgaggacggccccaggcattgctctgccccgggcattgcgcggcgcgcgtgagggggatgcggcaggaggcggcgcggcgggaggagtaggcggcggcgccctcgggagggagctgcgcgcgggccagacggcgcccggaggctccgcagtgccgccgccgtcgcccgggaggctccgcgcgggagccatgtaaccctgcggcgggctccgggctgctccgtccttccccagctcccgggctagcgcggcagcggggccacgatgaagaagcagttcaatcgcatgcgccagctggccaaccagacggtgggcagggctgaaaagacagaagttttgagtgaagaccttcttcaggtggagaagcgtctggagctggtgaaacaggtgtcccacagcacgcacaagaagctcaccgcatgtctgcagggccagcaaggggcagaggctgacaagcgctccaaaaagttgcctttgacaacactggctcagtgtctgatggaggggtcagctatcctgggagatgacacacttcttgggaagatgctgaaactctgtggagagacggaggacaagctggctcaggagctgatacattttgagttgcaagtagagagagacgtgattgagcccctgtttttgctggcggaggtggaaatcccaaatattcaaaagcagaggaaacacttagccaagttggtgctggacatggattcctcacgaaccaggtggcagcagacttccaagtcttcaggtttgtccagcagcttacagcctgcgggtgccaaggctgatgccctcagggaagaaatggaagaggctgccaacagagtggagatttgcagggaccagctctcagctgatatgtacagttttgtggccaaagaaattgactatgcaaactactttcaaacgctaatagaagtgcaagctgaataccacaggaagtccctgacactattgcaggctgtattgcctcagatcaaagcacaacaggaggcctgggtagagaagccttccttcgggaagccgctggaggagcacctcaccatcagcggccgggagatcgccttccccatcgaggcgtgtgtgaccatgctgcttgagtgtgggatgcaggaggagggactcttccgagtagccccctctgcctccaaactgaagaagctgaaagcggccctggactgctgcgtggtggatgtgcaggagtactcggcagacccccacgcaattgcaggagctttgaaatcttacctccgagagttgccagaacctcttatgacctttgaactctatgatgagtggatccaggcttccaatgtccaggagcaagacaagaagcttcaggctctatggaatgcttgtgaaaagttgcccaaggccaatcacaacaacatccgatacttgataaaatttttatccaagctgtcagaatatcaagatgtaaacaagatgactcccagtaatatggcaattgttttaggacccaacctcctatggccacaagcagaagggaacattacagagatgatgaccacagtgtcgctgcaaattgttgggatcattgaacctatcatccagcatgcagactggttcttccctggggagatagagttcaacattactggcaattatgggagtccagtacacgtgaaccataatgccaactacagctcaatgccctccccagacatggaccctgctgaccggcgccagcccgagcaggcccgccggcccctcagcgtcgccacggataatatgatgctggagttttacaaaaaggatggcatgggtgtgagggtcatggacacaaactgggtggctcgaagaggctcctcggccggtcggaaagtgtcctgcgccccgccctccatgcagcctcccgccccgcccgccgagctggctgcgcccctgccttcgccgctgccggagcagcccctggacagccccgcggcccccgcgctctctccatccggcctgggcctccagcctgggcccgagcgcaccagcacaacaaaaagcaaggaactttctccaggctctgcacagaaaggaagtccaggctccagccagggcacagcctgtgcagggactcaaccaggggctcaacctggagctcagccgggcgccagccccagccccagccagccgcctgcagaccagagtcctcacaccctccggaaagtttcaaagaagctggcaccgattccacccaaggtcccctttggccagccgggggctatggcagaccagtccgctggccagccgtccccagtcagcctgtcccccaccccgcccagcaccccgtcaccctatggactgagctaccctcaggggtactccttggcctcgggccagctctccccagctgcagctcctcccctggcctctccttctgtctttacaagcactttgagcaaatcgcggcccactcctaagccgcgacagagacctactctgccgcctcctcagcctcccacagtaaacctctcggcctctagtccacagtccacggaggcccccatgctagatggcatgtcccctggggaaagcatgtctacagctgtgtgacatgagtggcgcagttttggatacgtgtgagggggattttcaggatcttgtccactttgatattccctcgatccacatagagctcgggtcgacgctccgcctgagtcccctggagcacatgcggcgacactcagtaactgacaagagggactcggaggaggagtctgagagcaccgccctctgacatgacaccgcccatcctgcctcgcgtgtacatacatcacgggccctaggaacgccgccaggagcagcgtccatgagcttgccaagtgttctctgctggctctttcctgccactgccaacacgaggttggaatttggcagaaaattgtgatctccagtccgtgtggtgatgctggtggtgcaggttttgtttgttcctttcgggtggtgacttcggccttttgtttgacctttgccttttgactttgtgcctcttttgatccactttcagcctccatgccagaaaacacccacctctccatccaaggctggtcaggaacgtcctttgcagggtcggggtggtgcgggagaggctcactttgcctggttagacccaagggctgctaccttttccttggacggctcatgtcaggtcttgcaggatcagtttaatggcctccctgtccccaaatatattggctatatgagagtaattttacccctctacgtacctaaaggcacccagttcactagtctgtggggtcctggagcctgtctcttctttctggaggttcaaactgaatagcaataattacgttacccaaagcatgtggaggaaaagtgaaaccagccacggagacgctggcccacgggctcggcctgcggtgtggcctgctttgctcaccagcgtcagccgctcatttccttctcatgaagtcccatctggtcatggggacgagggccgggagggcaccgggtagccttttcacacttggggattaggggagtgagaaaagatttgggccatgcatgcaaagtcaaagtttaaaattttatccttttcaaatagatgatataatatacctatacatgatataatatttgtatatatgaaatctctctatatttgtttaatttgagccattcaatctaaaccaatgtacaggtgtacaatgaaaaatttaaatgcttagttatttttcccaacacagtgtaaagtcaccctcctctgagagtgggatgtgcagagttttgatgttgcagctttgctcacttcctggcaagggcaggtcatgcctcaatttgtaatgggagtctggggtaagggtgggggttgaaagttgttatctttaaatacatgtacaaatcgttgtcaaaagtaacgttattaaaatagatttattatccctga

SEQ ID NO: 456430 - DNA, 1114 bp, Homo sapiens
gactgggagcaggcagcccgggcggagcgggccggtgccgaggacggccccaggcattgctctgccccgggcattgcgcggcgcgcgtgagggggatgcggcaggaggcggcgcggcgggaggagtaggcggcggcgccctcgggagggagctgcgcgcgggccagacggcgcccggaggctccgcagtgccgccgccgtcgcccgggaggctccgcgcgggagccatgtaaccctgcggcgggctccgggctgctccgtccttccccagctcccgggctagcgcggcagcggggccacgatgaagaagcagttcaatcgcatgcgccagctggccaaccagacggtgggcagggctgaaaagacagaagttttgagtgaagaccttcttcaggtggagaagcgtctggagctggtgaaacaggtgtcccacagcacgcacaagaagctcaccgcatgtctgcagggccagcaaggggcagaggctgacaagcgctccaaaaagttgcctttgacaacactggctcagtgtctgatggaggggtcagctatcctgggagatgacacacttcttgggaagatgctgaaactctgtggagagacggaggacaagctggctcaggagctgatacattttgagttgcaagtagagagagacgtgattgagcccctgtttttgctggcggaggtggaaatcccaaatattcaaaagcagaggaaacacttagccaagttggtgctggacatggattcctcacgaaccaggtggcagcagacttccaagtcttcaggtttgtccagcagcttacagcctgcgggtgccaaggctgatgccctcagggaagaaatggaagaggctgccaacagagtggagatttgcagggtacctgccctctttgctcctctctactgggacaggctggggagccctcagggattccctttttgttcactggagttctcttaaaactctgtcagtgaggctctagttgaactgaatgtccccaagcccgccggctagcatctccaaggagtccaggatgaacccaaggagttggggctttgatggtgacctagacagggaggcagcattcatttatcattggtggtcctgc

SEQ ID NO: 456431 - DNA, 3291 bp, Homo sapiens
cgggtggctggggcgcctccacctcctcttcctaaagcggcgaggcgcagaggagcggcatcactcgagcccaggtcccagccaccaccactcacagcgctcggcgttcaggaagaggagcagcagcggaggcggctgcttcagcggcgggcgggcgccagaaagaataacatagctgatccagaagaactgttcacaaaattagagcgcattgggaaaggctcatttggggaagttttcaaaggaattgataaccgtacccagcaagtcgttgctattaaaatcatagaccttgaggaagccgaagatgaaatagaagacattcagcaagaaataactgtcttgagtcaatgtgacagctcatatgtaacaaaatactatgggtcatatttaaaggggtctaaattatggataataatggaatacctgggcggtggttcagcactggatcttcttcgagctggtccatttgatgagttccagattgctaccatgctaaaggaaattttaaaaggtctggactatctgcattcagaaaagaaaattcaccgagacataaaagctgccaatgtcttgctctcagaacaaggagatgttaaacttgctgattttggagttgctggtcagctgacagatacacagattaaaagaaatacctttgtgggaactccattttggatggctcctgaagttattcaacagtcagcttatgactcaaaagctgacatttggtcattgggaattactgctattgaactagccaagggagagccacctaactccgatatgcatccaatgagagttctgtttcttattcccaaaaacaatcctccaactcttgttggagactttactaagtcttttaaggagtttattgatgcttgcctgaacaaagatccatcatttcgtcctacagcaaaagaacttctgaaacacaaattcattgtaaaaaattcaaagaagacttcttatctgactgaactgatagatcgttttaagagatggaaggcagaaggacacagtgatgatgaatctgattccgagggctctgattcggaatctaccagcagggaaaacaatactcatcctgaatggagctttaccaccgtacgaaagaagcctgatccaaagaaagtacagaatggggcagagcaagatcttgtgcaaaccctgagttgtttgtctatgataatcacacctgcatttgctgaacttaaacagcaggacgagaataacgctagcaggaatcaggcgattgaagaactcgagaaaagtattgctgtggctgaagccgcctgtcccggcatcacagataaaatggtgaagaaactaattgaaaaatttcaaaagtgttcagcagacgaatccccctaagaaacttattattggcttctgtttcatatggacccagagagccccaccaaacctacgtcaagattaacaatgcttaacccatgagctccatgtgccttttggatctttgcaacactgaagatttggaagaagctattaaactattttgtgatggcgtttatcattttatattttgaaaggattattttgtaaggaataacttttaatactatagtttcacctgtattctagtaaatgttgagacaccgttttgcttttaagtatccctatttcttaagttacgaggatgaatacctttcacattttgatctttagttgactctacagtcatgaaacatacaggtctttcaaagtcattctcaatattcagcttttgtaaattatcaagcttcaaaaagctttttttttaaaaaaaaaacatgcatattctaaaaatgactattggtggggaggtgtaaataagtcataccttcttaaaacagaaaatttaagtaaagtcttttaaatgaaacctgtaaaagtattgactcttctaccaagttggtatgatattccaggcagctcaatgattatcacatttgagaccctgtgtttgaagcatttacaggcaatgtacagcaacagaggtacctcttggtgtatagtatttacattctcttttaggtagaagaggcaattttacccttatttcacatggttagaaatttaaagcaagatcatttacccaaggataggtgtttggtaatgttgaaggagttagtctggcttcatgttttacatcttcaactaaaatcccatactatctgcttggatttggagagccaaaaaataaagctgattgtcatgtgattaaatatctgatcaacaggtatgaatataacttaaatcagcatatttttgccatggtaataaattgtcctataaactatttatatatttttgttcttcataattatcactaataagcatcagtttgttgtttttaaaaggatatttaagtgagcattttctagttcatatgaaaataaccatagtacaggatgatttctgtccacacaaaggttaaattagattgcacagttaattttcacttatatttatggtactattatgtgggtgatgcctttttcttttaagcccagtacatatattatgcctgcctaagttctgaactggggctgtatttcagtagttgtagaattattgatatttagttttgatagctaatgtttaattgtttggatctgcacagtttggtttttgcacaaaagtcatttaaaaaaatctgagtaattgtcaaatattaaaagaaagatattcttcctgtaaggaatacagtttttagtcaaagtggccattacatcctctttttaatttacataatacagatacttgagaaagttgttgtggtgttgtatgccaagaaaattctttttattggtgcctatattgtaacaattatttttaatgcattgtattttgaagtaacggttcagttaaatttttcacctgctgtgtaactgaaacacaattacagtttataatcatctgtagaagtctggagataattttgcaactcatgttatgggttaaatgaatatttttgtaaaagtaaaagcaacaaatttataaattgattatttgaaactttacaacacaattgcatcccaaatacaaattgtattgcttattcattatagctattcgtcctgtaatctgtttctaggtgaagcatactccagtgttttaggggttttgaaaataaatatttaaatttcacagtcaaaaaaaaacacaaaaacgatataaaacaacatctttgtggcctctgggccccaaagagactttcaacaccatctcttgggacgcgggcccaaagtggagggacacaaatggcgcaaagggcgccaaaagacg

SEQ ID NO: 456432 - DNA, 3257 bp, Homo sapiens
cgggtggctggggcgcctccacctcctcttcctaaagcggcgaggcgcagaggagcggcatcactcgagcccaggtcccagccaccaccactcacagcgctcggcgttcaggaagaggagcagcagcggaggcggctgcttcagcggcgggcgggcgccagaaaggccccgatcgaaaagcctgggagggccgccgaactacccccggagggaggagccagtccgaacccaaggcgccaccgccgcagaagcggagcgaggcagcattcgcctccatggcccactcgccggtggctgtccaagtgcctgggatgcagaataacatagctgatccagaagaactgttcacaaaattagagcgcattgggaaaggctcatttggggaagttttcaaaggaattgataaccgtacccagcaagtcgttgctattaaaatcatagaccttgaggaagccgaagatgaaatagaagacattcagcaagaaataactgtcttgagtcaatgtgacagctcatatgtaacaaaatactatgggtcatatttaaaggggtctaaattatggataataatggaatacctgggcggtggttcagcactggatcttcttcgagctggtccatttgatgagttccagattgctaccatgctaaaggaaattttaaaaggtctggactatctgcattcagaaaagaaaattcaccgagacataaaagctgccaatgtcttgctctcagaacaaggagatgttaaacttgctgattttggagttgctggtcagctgacagatacacagattaaaagaaatacctttgtgggaactccattttggatggctcctgaagttattcaacagtcagcttatgactcaaaacgtcctacagcaaaagaacttctgaaacacaaattcattgtaaaaaattcaaagaagacttcttatctgactgaactgatagatcgttttaagagatggaaggcagaaggacacagtgatgatgaatctgattccgagggctctgattcggaatctaccagcagggaaaacaatactcatcctgaatggagctttaccaccgtacgaaagaagcctgatccaaagaaagtacagaatggggcagagcaagatcttgtgcaaaccctgagttgtttgtctatgataatcacacctgcatttgctgaacttaaacagcaggacgagaataacgctagcaggaatcaggcgattgaagaactcgagaaaagtattgctgtggctgaagccgcctgtcccggcatcacagataaaatggtgaagaaactaattgaaaaatttcaaaagtgttcagcagacgaatccccctaagaaacttattattggcttctgtttcatatggacccagagagccccaccaaacctacgtcaagattaacaatgcttaacccatgagctccatgtgccttttggatctttgcaacactgaagatttggaagaagctattaaactattttgtgatggcgtttatcattttatattttgaaaggattattttgtaaggaataacttttaatactatagtttcacctgtattctagtaaatgttgagacaccgttttgcttttaagtatccctatttcttaagttacgaggatgaatacctttcacattttgatctttagttgactctacagtcatgaaacatacaggtctttcaaagtcattctcaatattcagcttttgtaaattatcaagcttcaaaaagctttttttttaaaaaaaaaacatgcatattctaaaaatgactattggtggggaggtgtaaataagtcataccttcttaaaacagaaaatttaagtaaagtcttttaaatgaaacctgtaaaagtattgactcttctaccaagttggtatgatattccaggcagctcaatgattatcacatttgagaccctgtgtttgaagcatttacaggcaatgtacagcaacagaggtacctcttggtgtatagtatttacattctcttttaggtagaagaggcaattttacccttatttcacatggttagaaatttaaagcaagatcatttacccaaggataggtgtttggtaatgttgaaggagttagtctggcttcatgttttacatcttcaactaaaatcccatactatctgcttggatttggagagccaaaaaataaagctgattgtcatgtgattaaatatctgatcaacaggtatgaatataacttaaatcagcatatttttgccatggtaataaattgtcctataaactatttatatatttttgttcttcataattatcactaataagcatcagtttgttgtttttaaaaggatatttaagtgagcattttctagttcatatgaaaataaccatagtacaggatgatttctgtccacacaaaggttaaattagattgcacagttaattttcacttatatttatggtactattatgtgggtgatgcctttttcttttaagcccagtacatatattatgcctgcctaagttctgaactggggctgtatttcagtagttgtagaattattgatatttagttttgatagctaatgtttaattgtttggatctgcacagtttggtttttgcacaaaagtcatttaaaaaaatctgagtaattgtcaaatattaaaagaaagatattcttcctgtaaggaatacagtttttagtcaaagtggccattacatcctctttttaatttacataatacagatacttgagaaagttgttgtggtgttgtatgccaagaaaattctttttattggtgcctatattgtaacaattatttttaatgcattgtattttgaagtaacggttcagttaaatttttcacctgctgtgtaactgaaacacaattacagtttataatcatctgtagaagtctggagataattttgcaactcatgttatgggttaaatgaatatttttgtaaaagtaaaagcaacaaatttataaattgattatttgaaactttacaacacaattgcatcccaaatacaaattgtattgcttattcattatagctattcgtcctgtaatctgtttctaggtgaagcatactccagtgttttaggggttttgaaaataaatatttaaatttcacagtcaaaaaaaaacacaaaaacgatataaaacaacatctttgtggcctctgggccccaaagagactttcaacaccatctcttgggacgcgggcccaaagtggagggacacaaatggcgcaaagggcgccaaaagacg

SEQ ID NO: 456433 - DNA, 3349 bp, Homo sapiens
cgggtggctggggcgcctccacctcctcttcctaaagcggcgaggcgcagaggagcggcatcactcgagcccaggtcccagccaccaccactcacagcgctcggcgttcaggaagaggagcagcagcggaggcggctgcttcagcggcgggcgggcgccagaaaggccccgatcgaaaagcctgggagggccgccgaactacccccggagggaggagccagtccgaacccaaggcgccaccgccgcagaagcggagcgaggcagcattcgcctccatggcccactcgccggtggctgtccaagtgcctgggatgcagaataacatagctgatccagaagaactgttcacaaaattagagcgcattgggaaaggctcatttggggaagttttcaaaggaattgataaccgtacccagcaagtcgttgctattaaaatcatagaccttgaggaagccgaagatgaaatagaagacattcagcaagaaataactgtcttgagtcaatgtgacagctcatatgtaacaaaatactatgggtcatatttaaaggggtctaaattatggataataatggaatacctgggcggtggttcagcactggatcttcttcgagctggtccatttgatgagttccagattgctaccatgctaaaggaaattttaaaaggtctggactatctgcattcagaaaagaaaattcaccgagacataaaagctgccaatgtcttgctctcagaacaaggagatgttaaacttgctgattttggagttgctggtcagctgacagatacacagattaaaagaaatacctttgtgggaactccattttggatggctcctgaagttattcaacagtcagcttatgactcaaaagctgacatttggtcattgggaattactgctattgaactagccaagggagagccacctaactccgatatgcatccaatgagagttctgtttcttattcccaaaaacaatcctccaactcttgttggagactttactaagtcttttaaggagtttattgatgcttgcctgaacaaagatccatcatttcgtcctacagcaaaagaacttctgaaacacaaattcattgtaaaaaattcaaagaagacttcttatctgactgaactgatagatcgttttaagagatggaaggcagaaggacacagtgatgatgaatctgattccgagggctctgattcgagcaagatcttgtgcaaaccctgagttgtttgtctatgataatcacacctgcatttgctgaacttaaacagcaggacgagaataacgctagcaggaatcaggcgattgaagaactcgagaaaagtattgctgtggctgaagccgcctgtcccggcatcacagataaaatggtgaagaaactaattgaaaaatttcaaaagtgttcagcagacgaatccccctaagaaacttattattggcttctgtttcatatggacccagagagccccaccaaacctacgtcaagattaacaatgcttaacccatgagctccatgtgccttttggatctttgcaacactgaagatttggaagaagctattaaactattttgtgatggcgtttatcattttatattttgaaaggattattttgtaaggaataacttttaatactatagtttcacctgtattctagtaaatgttgagacaccgttttgcttttaagtatccctatttcttaagttacgaggatgaatacctttcacattttgatctttagttgactctacagtcatgaaacatacaggtctttcaaagtcattctcaatattcagcttttgtaaattatcaagcttcaaaaagctttttttttaaaaaaaaaacatgcatattctaaaaatgactattggtggggaggtgtaaataagtcataccttcttaaaacagaaaatttaagtaaagtcttttaaatgaaacctgtaaaagtattgactcttctaccaagttggtatgatattccaggcagctcaatgattatcacatttgagaccctgtgtttgaagcatttacaggcaatgtacagcaacagaggtacctcttggtgtatagtatttacattctcttttaggtagaagaggcaattttacccttatttcacatggttagaaatttaaagcaagatcatttacccaaggataggtgtttggtaatgttgaaggagttagtctggcttcatgttttacatcttcaactaaaatcccatactatctgcttggatttggagagccaaaaaataaagctgattgtcatgtgattaaatatctgatcaacaggtatgaatataacttaaatcagcatatttttgccatggtaataaattgtcctataaactatttatatatttttgttcttcataattatcactaataagcatcagtttgttgtttttaaaaggatatttaagtgagcattttctagttcatatgaaaataaccatagtacaggatgatttctgtccacacaaaggttaaattagattgcacagttaattttcacttatatttatggtactattatgtgggtgatgcctttttcttttaagcccagtacatatattatgcctgcctaagttctgaactggggctgtatttcagtagttgtagaattattgatatttagttttgatagctaatgtttaattgtttggatctgcacagtttggtttttgcacaaaagtcatttaaaaaaatctgagtaattgtcaaatattaaaagaaagatattcttcctgtaaggaatacagtttttagtcaaagtggccattacatcctctttttaatttacataatacagatacttgagaaagttgttgtggtgttgtatgccaagaaaattctttttattggtgcctatattgtaacaattatttttaatgcattgtattttgaagtaacggttcagttaaatttttcacctgctgtgtaactgaaacacaattacagtttataatcatctgtagaagtctggagataattttgcaactcatgttatgggttaaatgaatatttttgtaaaagtaaaagcaacaaatttataaattgattatttgaaactttacaacacaattgcatcccaaatacaaattgtattgcttattcattatagctattcgtcctgtaatctgtttctaggtgaagcatactccagtgttttaggggttttgaaaataaatatttaaatttcacagtcaaaaaaaaacacaaaaacgatataaaacaacatctttgtggcctctgggccccaaagagactttcaacaccatctcttgggacgcgggcccaaagtggagggacacaaatggcgcaaagggcgccaaaagacg

SEQ ID NO: 456434 - DNA, 3162 bp, Homo sapiens
cgggtggctggggcgcctccacctcctcttcctaaagcggcgaggcgcagaggagcggcatcactcgagcccaggtcccagccaccaccactcacagcgctcggcgttcaggaagaggagcagcagcggaggcggctgcttcagcggcgggcgggcgccagaaaggccccgatcgaaaagcctgggagggccgccgaactacccccggagggaggagccagtccgaacccaaggcgccaccgccgcagaagcggagcgaggcagcattcgcctccatggcccactcgccggtggctgtccaagtgcctgggatgcagaataacatagctgatccagaagaactgttcacaaaattagagcgcattgggaaaggctcatttggggaagttttcaaaggaattgataaccgtacccagcaagtcgttgctattaaaatcatagaccttgaggaagccgaagatgaaatagaagacattcagcaagaaataactgtcttgagtcaatgtgacagctcatatgtaacaaaatactatgggtcatatttaaaggggtctaaattatggataataatggaatacctgggcggtggttcagcactggatcttcttcgagctggtccatttgatgagttccagattgctaccatgctaaaggaaattttaaaaggtctggactatctgcattcagaaaagaaaattcaccgagacataaaagctgccaatgtcttgctctcagaacaaggagatgttaaacttgctgattttggagttgctggtcagctgacagatacacagattaaaagaaatacctttgtgggaactccattttggatggctcctgaagttattcaacagtcagcttatgactcaaaagctgacatttggtcattgggaattactgctattgaactagccaagggagagccacctaactccgatatgcatccaatgagagttctgtttcttattcccaaaaacaatcctccaactcttgttggagactttactaagtcttttaaggagtttattgatgcttgcctgaacaaagatccatcatttcgtcctacagcaaaagaacttctgaaacacaaattcattgtaaaaaattcaaagaagacttcttatctgactgaactgatagatcgttttaagagatggaaggcagaaggacacagtgatgatgaatctgattccgagggctctgattcggaatctaccagcagggaaaacaatactcatcctgaatggagctttaccaccgtacgaaagaagcctgatccaaagaaagtacagaatggggcagagcaagatcttgtgcaaaccctgagttgtttgtctatgataatcacacctgcatttgctgaacttaaacagcaggacgagaataacgctagcaggaatcaggcgattgaagaactcgagaaaagtattgctgtggctgaagccgcctgtcccggcatcacagataaaatggtgaagaaactaattgaaaaatttcaaaagtgttcagcagacgaatccccctaagaaacttattattggcttctgtttcatatggacccagagagccccaccaaacctacgtcaagattaacaatgcttaacccatgagctccatgtgccttttggatctttgcaacactgaagatttggaagaagctattaaactattttgtgatggcgtttatcattttatattttgaaaggattattttgtaaggaataacttttaatactatagtttcacctgtattctagtaaatgttgagacaccgttttgcttttaagtatccctatttcttaagttacgaggatgaatacctttcacattttgatctttagttgactctacagtcatgaaacatacaggtctttcaaagtcattctcaatattcagcttttgtaaattatcaagcttcaaaaagctttttttttaaaaaaaaaacatgcatattctaaaaatgactattggtggggaggtgtaaataagtcataccttcttaaaacagaaaatttaagtaaagtcttttaaatgaaacctgtaaaagtattgactcttctaccaagttggtatgatattccaggcagctcaatgattatcacatttgagaccctgtgtttgaagcatttacaggcaatgtacagcaacagaggtacctcttggtgtatagtatttacattctcttttaggtagaagaggcaattttacccttatttcacatggttagaaatttaaagcaagatcatttacccaaggataggtgtttggtaatgttgaaggagttagtctggcttcatgttttacatcttcaactaaaatcccatactatctgcttggatttggagagccaaaaaataaagctgattgtcatgtgattaaatatctgatcaacaggtatgaatataacttaaatcagcatatttttgccatggtaataaattgtcctataaactatttatatatttttgttcttcataattatcactaataagcatcagtttgttgtttttaaaaggatatttaagtgagcattttctagttcatatgaaaataaccatagtacaggatgatttctgtccacacaaaggttaaattagattgcacagttaattttcacttatatttatggtactattatgtgggtgatgcctttttcttttaagcccagtacatatattatgcctgcctaagttctgaactggggctgtatttcagtagttgtagaattattgatatttagttttgatagctaatgtttaattgtttggatctgcacagtttggttttatcctcggcgtgtgcatgcacacgccgaggccccacacacgaggctcttggcgatgttgaattcacaggtctctccccagtaccagtgtgtgttcgtatttgggcacaggcggcgggggccactgcgttgcagctgacatgtgcccaggttacagttcatttgcgacttcgttcctttggtgcacttgttcacacaggccagcttcccatccaagacatccacatagtagaactgggtatatccttcggcagccttctgggtgcattgctcctggaagtcaaagcccggagtcaccgatgaatccacgaaagtgtcctcttcactatagcacagtatggtcgttcggcgtgtgcagtttgtcgctcggcgtgtgc

SEQ ID NO: 456435 - DNA, 2104 bp, Homo sapiens
gattttttaacttgtttatattttaacatctacatgataagattcaatagaaacaatgtatcccttttgtggaatcagtttcttcattgcagagttcatacaaaggagaaatataaacatgcatagttgtacattggtttaaattttttaaaaattttataggtgttcagcagacgaatccccctaagaaacttattattggcttctgtttcatatggacccagagagccccaccaaacctacgtcaagattaacaatgcttaacccatgagctccatgtgccttttggatctttgcaacactgaagatttggaagaagctattaaactattttgtgatggcgtttatcattttatattttgaaaggattattttgtaaggaataacttttaatactatagtttcacctgtattctagtaaatgttgagacaccgttttgcttttaagtatccctatttcttaagttacgaggatgaatacctttcacattttgatctttagttgactctacagtcatgaaacatacaggtctttcaaagtcattctcaatattcagcttttgtaaattatcaagcttcaaaaagctttttttttaaaaaaaaaacatgcatattctaaaaatgactattggtggggaggtgtaaataagtcataccttcttaaaacagaaaatttaagtaaagtcttttaaatgaaacctgtaaaagtattgactcttctaccaagttggtatgatattccaggcagctcaatgattatcacatttgagaccctgtgtttgaagcatttacaggcaatgtacagcaacagaggtacctcttggtgtatagtatttacattctcttttaggtagaagaggcaattttacccttatttcacatggttagaaatttaaagcaagatcatttacccaaggataggtgtttggtaatgttgaaggagttagtctggcttcatgttttacatcttcaactaaaatcccatactatctgcttggatttggagagccaaaaaataaagctgattgtcatgtgattaaatatctgatcaacaggtatgaatataacttaaatcagcatatttttgccatggtaataaattgtcctataaactatttatatatttttgttcttcataattatcactaataagcatcagtttgttgtttttaaaaggatatttaagtgagcattttctagttcatatgaaaataaccatagtacaggatgatttctgtccacacaaaggttaaattagattgcacagttaattttcacttatatttatggtactattatgtgggtgatgcctttttcttttaagcccagtacatatattatgcctgcctaagttctgaactggggctgtatttcagtagttgtagaattattgatatttagttttgatagctaatgtttaattgtttggatctgcacagtttggtttttgcacaaaagtcatttaaaaaaatctgagtaattgtcaaatattaaaagaaagatattcttcctgtaaggaatacagtttttagtcaaagtggccattacatcctctttttaatttacataatacagatacttgagaaagttgttgtggtgttgtatgccaagaaaattctttttattggtgcctatattgtaacaattatttttaatgcattgtattttgaagtaacggttcagttaaatttttcacctgctgtgtaactgaaacacaattacagtttataatcatctgtagaagtctggagataattttgcaactcatgttatgggttaaatgaatatttttgtaaaagtaaaagcaacaaatttataaattgattatttgaaactttacaacacaattgcatcccaaatacaaattgtattgcttattcattatagctattcgtcctgtaatctgtttctaggtgaagcatactccagtgttttaggggttttgaaaataaatatttaaatttcacagtcaaaaaaaaacacaaaaacgatataaaacaacatctttgtggcctctgggccccaaagagactttcaacaccatctcttgggacgcgggcccaaagtggagggacacaaatggcgcaaagggcgccaaaagacg

SEQ ID NO: 456436 - DNA, 685 bp, Homo sapiens
gcacgaggtgcaaaaaccaaactgtgcagtgcacaaaagtcatttaaaaaaatctgagtaattgtcaaatattaaaagaaagatattcttcctgtaaggaatacagtttttagtcaaagtggccattacatcctctttttaatttacataatacagatacttgagaaagttgttgtggtgttgtatgccaagaaaattctttttattggtgcctatattgtaacaattatttttaatgcattgtattttgaagtaacggttcagttaaatttttcacctgctgtgtaactgaaacacaattacagtttataatcatctgtagaagtctggagataattttgcaactcatgttatgggttaaatgaatatttttgtaaaagtaaaagcaacaaatttataaattgattatttgaaactttacaacacaattgcatcccaaatacaaattgtattgcttattcattatagctattcgtcctgtaatctgtttctaggtgaagcatactccagtgttttaggggttttgaaaataaatatttaaatttcacagtcaaaaaaaaacacaaaaacgatataaaacaacatctttgtggcctctgggccccaaagagactttcaacaccatctcttgggacgcgggcccaaagtggagggacacaaatggcgcaaagggcgccaaaagacg

SEQ ID NO: 456437 - DNA, 3443 bp, Homo sapiens
cgggtggctggggcgcctccacctcctcttcctaaagcggcgaggcgcagaggagcggcatcactcgagcccaggtcccagccaccaccactcacagcgctcggcgttcaggaagaggagcagcagcggaggcggctgcttcagcggcgggcgggcgccagaaaggccccgatcgaaaagcctgggagggccgccgaactacccccggagggaggagccagtccgaacccaaggcgccaccgccgcagaagcggagcgaggcagcattcgcctccatggcccactcgccggtggctgtccaagtgcctgggatgcagaataacatagctgatccagaagaactgttcacaaaattagagcgcattgggaaaggctcatttggggaagttttcaaaggaattgataaccgtacccagcaagtcgttgctattaaaatcatagaccttgaggaagccgaagatgaaatagaagacattcagcaagaaataactgtcttgagtcaatgtgacagctcatatgtaacaaaatactatgggtcatatttaaaggggtctaaattatggataataatggaatacctgggcggtggttcagcactggatcttcttcgagctggtccatttgatgagttccagattgctaccatgctaaaggaaattttaaaaggtctggactatctgcattcagaaaagaaaattcaccgagacataaaagctgccaatgtcttgctctcagaacaaggagatgttaaacttgctgattttggagttgctggtcagctgacagatacacagattaaaagaaatacctttgtgggaactccattttggatggctcctgaagttattcaacagtcagcttatgactcaaaagctgacatttggtcattgggaattactgctattgaactagccaagggagagccacctaactccgatatgcatccaatgagagttctgtttcttattcccaaaaacaatcctccaactcttgttggagactttactaagtcttttaaggagtttattgatgcttgcctgaacaaagatccatcatttcgtcctacagcaaaagaacttctgaaacacaaattcattgtaaaaaattcaaagaagacttcttatctgactgaactgatagatcgttttaagagatggaaggcagaaggacacagtgatgatgaatctgattccgagggctctgattcggaatctaccagcagggaaaacaatactcatcctgaatggagctttaccaccgtacgaaagaagcctgatccaaagaaagtacagaatggggcagagcaagatcttgtgcaaaccctgagttgtttgtctatgataatcacacctgcatttgctgaacttaaacagcaggacgagaataacgctagcaggaatcaggcgattgaagaactcgagaaaagtattgctgtggctgaagccgcctgtcccggcatcacagataaaatggtgaagaaactaattgaaaaatttcaaaagtgttcagcagacgaatccccctaagaaacttattattggcttctgtttcatatggacccagagagccccaccaaacctacgtcaagattaacaatgcttaacccatgagctccatgtgccttttggatctttgcaacactgaagatttggaagaagctattaaactattttgtgatggcgtttatcattttatattttgaaaggattattttgtaaggaataacttttaatactatagtttcacctgtattctagtaaatgttgagacaccgttttgcttttaagtatccctatttcttaagttacgaggatgaatacctttcacattttgatctttagttgactctacagtcatgaaacatacaggtctttcaaagtcattctcaatattcagcttttgtaaattatcaagcttcaaaaagctttttttttaaaaaaaaaacatgcatattctaaaaatgactattggtggggaggtgtaaataagtcataccttcttaaaacagaaaatttaagtaaagtcttttaaatgaaacctgtaaaagtattgactcttctaccaagttggtatgatattccaggcagctcaatgattatcacatttgagaccctgtgtttgaagcatttacaggcaatgtacagcaacagaggtacctcttggtgtatagtatttacattctcttttaggtagaagaggcaattttacccttatttcacatggttagaaatttaaagcaagatcatttacccaaggataggtgtttggtaatgttgaaggagttagtctggcttcatgttttacatcttcaactaaaatcccatactatctgcttggatttggagagccaaaaaataaagctgattgtcatgtgattaaatatctgatcaacaggtatgaatataacttaaatcagcatatttttgccatggtaataaattgtcctataaactatttatatatttttgttcttcataattatcactaataagcatcagtttgttgtttttaaaaggatatttaagtgagcattttctagttcatatgaaaataaccatagtacaggatgatttctgtccacacaaaggttaaattagattgcacagttaattttcacttatatttatggtactattatgtgggtgatgcctttttcttttaagcccagtacatatattatgcctgcctaagttctgaactggggctgtatttcagtagttgtagaattattgatatttagttttgatagctaatgtttaattgtttggatctgcacagtttggtttttgcacaaaagtcatttaaaaaaatctgagtaattgtcaaatattaaaagaaagatattcttcctgtaaggaatacagtttttagtcaaagtggccattacatcctctttttaatttacataatacagatacttgagaaagttgttgtggtgttgtatgccaagaaaattctttttattggtgcctatattgtaacaattatttttaatgcattgtattttgaagtaacggttcagttaaatttttcacctgctgtgtaactgaaacacaattacagtttataatcatctgtagaagtctggagataattttgcaactcatgttatgggttaaatgaatatttttgtaaaagtaaaagcaacaaatttataaattgattatttgaaactttacaacacaattgcatcccaaatacaaattgtattgcttattcattatagctattcgtcctgtaatctgtttctaggtgaagcatactccagtgttttaggggttttgaaaataaatatttaaatttcacagtcaaaaaaaaacacaaaaacgatataaaacaacatctttgtggcctctgggccccaaagagactttcaacaccatctcttgggacgcgggcccaaagtggagggacacaaatggcgcaaagggcgccaaaagacg

SEQ ID NO: 456438 - DNA, 3389 bp, Homo sapiens
cgggtggctggggcgcctccacctcctcttcctaaagcggcgaggcgcagaggagcggcatcactcgagcccaggtcccagccaccaccactcacagcgctcggcgttcaggaagaggagcagcagcggaggcggctgcttcagcggcgggcgggcgccagaaaggccccgatcgaaaagcctgggagggccgccgaactacccccggagggaggagccagtccgaacccaaggcgccaccgccgcagaagcggagcgaggcagcattcgcctccatggcccactcgccggtggctgtccaagtgcctgggatgcagaataacatagctgatccagaagaactgttcacaaaattagagcgcattgggaaaggctcatttggggaagttttcaaaggaattgataaccgtacccagcaagtcgttgctattaaaatcatagaccttgaggaagccgaagatgaaatagaagacattcagcaagaaataactgtcttgagtcaatgtgacagctcatatgtaacaaaatactatgggtcatatttaaaggggtctaaattatggataataatggaatacctgggcggtggttcagcactggatcttcttcgagctggtccatttgatgagttccagattgctaccatgctaaaggaaattttaaaaggtctggactatctgcattcagaaaagaaaattcaccgagacataaaagctgccaatgtcttgctctcagaacaaggagatgttaaacttgctgattttggagttgctggtcagctgacagatacacagattaaaagaaatacctttgtgggaactccattttggatggctcctgaagttattcaacagtcagcttatgactcaaaagctgacatttggtcattgggaattactgctattgaactagccaagggagagccacctaactccgatatgcatccaatgagagttctgtttcttattcccaaaaacaatcctccaactcttgttggagactttactaagtcttttaaggagtttattgatgcttgcctgaacaaagatccatcatttcgtcctacagcaaaagaacttctgaaacacaaattcattgtaaaaaattcaaagaagacttcttatctgactgaactgatagatcgttttaagagatggaaggcagaaggacacagtgatgatgaatctgattccgagggctctgattcggaatctaccagcagggaaaacaatactcatcctgaatggagctttaccaccgtacgaaagaagcctgatccaaagaaagtacagaatggggcagagcaagatcttgtgcaaaccctgagttgtttgtctatgataatcacacctgcatttgctgaacttaaacagcaggacgagaataacgctagcaggaatcaggcgattgaagaactcgagaaaagtattgctgtggctgaagccgcctgtcccggcatcacagataaaatggtgaagaaactaattgaaaaatttcaaaagtgttcagcagacgaatccccctaagaaacttattattggcttctgtttcatatggacccagagagccccaccaaacctacgtcaagattaacaatgcttaacccatgagctccatgtgccttttggatctttgcaacactgaagatttggaagaagctattaaactattttgtgatggcgtttatcattttatattttgaaaggattattttgtaaggaataacttttaatactatagtttcacctgtattctagtaaatgttgagacaccgttttgcttttaagtatccctatttcttaagttacgaggatgaatacctttcacattttgatctttagttgactctacagtcatgaaacatacaggtctttcaaagtcattctcaatattcagcttttgtaaattatcaagcttcaaaaagctttttttttaaaaaaaaaacatgcatattctaaaaatgactattggtggggaggtgtaaataagtcataccttcttaaaacagaaaatttaagtaaagtcttttaaatgaaacctgtaaaagtattgactcttctaccaagttggtatgatattccaggcagctcaatgattatcacatttgagaccctgtgtttgaagcatttacaggcaatgtacagcaacagaggtacctcttggtgtatagtatttacattctcttttaggtagaagaggcaattttacccttatttcacatggttagaaatttaaagcaagatcatttacccaaggataggtgtttggtaatgttgaaggagttagtctggcttcatgttttacatcttcaactaaaatcccatactatctgcttggatttggagagccaaaaaataaagctgattgtcatgtgattaaatatctgatcaacaggtatgaatataacttaaatcagcatatttttgccatggtaataaattgtcctataaactatttatatatttttgttcttcataattatcactaataagcatcagtttgttgtttttaaaaggatatttaagtgagcattttctagttcatatgaaaataaccatagtacaggatgatttctgtccacacaaaggttaaattagattgcacagttaattttcacttatatttatggtactattatgtgggtgatgcctttttcttttaagcccagtacatatattatgcctgcctaagttctgaactggggctgtatttcagtagttgtagaattattgatatttagttttgatagctaatgtttaattgtttggatctgcacagtttggtttttgcacaaaagtcatttaaaaaaatctgagtaattgtcaaatattaaaagaaagatattcttcctgtaaggaatacagtttttagtcaaagtggccattacatcctctttttaatttacataatacagatacttgagaaagttgttgtggtgttgtatgccaagaaaattctttttattggtgcctatattgtaacaattatttttaatgcattgtattttgaagtaacggttcagttaaatttttcacctgctgtgtaactgaaacacaattacagtttataatcatctgtagaagtctggagataattttgcaactcatgttatgggttaaatgaatatttttgtaaaagtaaaagcaacaaatttataaattgattatttgaaactttacaacacaattgcatcccaaatacaaattgtattgcttattcattatagctattcgtcctgtaatctgtttctaggtgaagcatactccagtgttttaggggttttgaaaaataacttccaaatttcccacgccgaaaaaacacacccgaccccccagggcccgccccggtacccaacccgcccctattagggagtcgattaccaaattcac

SEQ ID NO: 456439 - DNA, 2806 bp, Homo sapiens
cgggtggctggggcgcctccacctcctcttcctaaagcggcgaggcgcagaggagcggcatcactcgagcccaggtcccagccaccaccactcacagcgctcggcgttcaggaagaggagcagcagcggaggcggctgcttcagcggcgggcgggcgccagaaaggccccgatcgaaaagcctgggagggccgccgaactacccccggagggaggagccagtccgaacccaaggcgccaccgccgcagaagcggagcgaggcagcattcgcctccatggcccactcgccggtggctgtccaagtgcctgggatgcagaataacatagctgatccagaagaactgttcacaaaattagagcgcattgggaaaggctcatttggggaagttttcaaaggaattgataaccgtacccagcaagtcgttgctattaaaatcatagaccttgaggaagccgaagatgaaatagaagacattcagcaagaaataactgtcttgagtcaatgtgacagctcatatgtaacaaaatactatgggtcatatttaaaggggtctaaattatggataataatggaatacctgggcggtggttcagcactggatcttaatggagctttaccaccgtacgaaagaagcctgatccaaagaaagtacagaatggggcagagcaagatcttgtgcaaaccctgagttgtttgtctatgataatcacacctgcatttgctgaacttaaacagcaggacgagaataacgctagcaggaatcaggcgattgaagaactcgagaaaagtattgctgtggctgaagccgcctgtcccggcatcacagataaaatggtgaagaaactaattgaaaaatttcaaaagtgttcagcagacgaatccccctaagaaacttattattggcttctgtttcatatggacccagagagccccaccaaacctacgtcaagattaacaatgcttaacccatgagctccatgtgccttttggatctttgcaacactgaagatttggaagaagctattaaactattttgtgatggcgtttatcattttatattttgaaaggattattttgtaaggaataacttttaatactatagtttcacctgtattctagtaaatgttgagacaccgttttgcttttaagtatccctatttcttaagttacgaggatgaatacctttcacattttgatctttagttgactctacagtcatgaaacatacaggtctttcaaagtcattctcaatattcagcttttgtaaattatcaagcttcaaaaagctttttttttaaaaaaaaaacatgcatattctaaaaatgactattggtggggaggtgtaaataagtcataccttcttaaaacagaaaatttaagtaaagtcttttaaatgaaacctgtaaaagtattgactcttctaccaagttggtatgatattccaggcagctcaatgattatcacatttgagaccctgtgtttgaagcatttacaggcaatgtacagcaacagaggtacctcttggtgtatagtatttacattctcttttaggtagaagaggcaattttacccttatttcacatggttagaaatttaaagcaagatcatttacccaaggataggtgtttggtaatgttgaaggagttagtctggcttcatgttttacatcttcaactaaaatcccatactatctgcttggatttggagagccaaaaaataaagctgattgtcatgtgattaaatatctgatcaacaggtatgaatataacttaaatcagcatatttttgccatggtaataaattgtcctataaactatttatatatttttgttcttcataattatcactaataagcatcagtttgttgtttttaaaaggatatttaagtgagcattttctagttcatatgaaaataaccatagtacaggatgatttctgtccacacaaaggttaaattagattgcacagttaattttcacttatatttatggtactattatgtgggtgatgcctttttcttttaagcccagtacatatattatgcctgcctaagttctgaactggggctgtatttcagtagttgtagaattattgatatttagttttgatagctaatgtttaattgtttggatctgcacagtttggtttttgcacaaaagtcatttaaaaaaatctgagtaattgtcaaatattaaaagaaagatattcttcctgtaaggaatacagtttttagtcaaagtggccattacatcctctttttaatttacataatacagatacttgagaaagttgttgtggtgttgtatgccaagaaaattctttttattggtgcctatattgtaacaattatttttaatgcattgtattttgaagtaacggttcagttaaatttttcacctgctgtgtaactgaaacacaattacagtttataatcatctgtagaagtctggagataattttgcaactcatgttatgggttaaatgaatatttttgtaaaagtaaaagcaacaaatttataaattgattatttgaaactttacaacacaattgcatcccaaatacaaattgtattgcttattcattatagctattcgtcctgtaatctgtttctaggtgaagcatactccagtgttttaggggttttgaaaataaatatttaaatttcacagtcaaaaaaaaacacaaaaacgatataaaacaacatctttgtggcctctgggccccaaagagactttcaacaccatctcttgggacgcgggcccaaagtggagggacacaaatggcgcaaagggcgccaaaagacg

SEQ ID NO: 456440 - DNA, 1253 bp, Homo sapiens
ggcaccgctgcctgaaagacctttctaggccagtcggggtccggcacccagttgacgagacagcgcggcgctttcagagctggggagaggcgaaaactcttccggccccccgatcccccggccagccgcccccggcagctccttgccgcctcccggcctgggcccgcccagccgttctcggcctgccgtcaggcgatctcggcggccagcccagccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggcattttgggctttccctcttttttgtaaagcaatgtctgcctagtttattgtccagttaactttagtgaccttttaaaagttggcattgtaaataaaacaacttgcaaaaaa

SEQ ID NO: 456441 - DNA, 648 bp, Homo sapiens
cgcgggggagccccccggcccgcccgttcgtttttgaagaaagtacgttttattaaaaccgtgtttcgtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggca

SEQ ID NO: 456442 - DNA, 632 bp, Homo sapiens
  misc_feature (10)..(10): n is a, c, g, or t
  misc_feature (15)..(15): n is a, c, g, or t
  misc_feature (22)..(22): n is a, c, g, or t
  misc_feature (41)..(41): n is a, c, g, or t
gcacgagggnccgcnaggggcngaacagtttagttttggangggcttgcgggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggca

SEQ ID NO: 456443 - DNA, 610 bp, Homo sapiens
  misc_feature (7)..(7): n is a, c, g, or t
aaactcnagttcattaaaacctcgttttcgtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggca

SEQ ID NO: 456444 - DNA, 502 bp, Homo sapiens
  misc_feature (33)..(33): n is a, c, g, or t
  misc_feature (52)..(52): n is a, c, g, or t
gacaagaagcgacgggatacctgggaccagatncctgaaattgcccaggacncgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggca

SEQ ID NO: 456445 - DNA, 250 bp, Homo sapiens
  misc_feature (18)..(18): n is a, c, g, or t
acagatacgaatcgagcntgaccgacaaacagggacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggcacgataaacaccaggtggcatcgataaacaccaggtggcatcgataaaca

SEQ ID NO: 456446 - DNA, 1395 bp, Homo sapiens
tcaaaggggttataccaatttatactctctagaagagtttgtgtttcctttccactattgcccaacaattagtatcagtttcttgattttttttcaatctagagaagtatctgtagtgttagttttgcttctagtaaagttgagcgttccttatgtttggctattcagatttcatttattggctgtacatattaacccatttctctttaatgatttttgaaagattttatattctctcagctaatcattgttgtacatattgcaggtatcttccagtcattgtcctaacttttctttttgcatagaagctttttaatgtagtcaagtacagtactctgtctgcatggcttgcttttatctaataagatcttctcccttctagggttataatgattcttcaagcttcatttttgtttttcaagcttggctgttaatggctcaagtcaacctctagctagttattattccaatatagggataagttgtcccagcagtggaatgagtaccttgtgacaaagtgccacagaggaatgaacttttgttgttgtaggtgtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtaggtagcacacagttttgtctttgatcacatgctcttaaaaagggagtaacacctataacatgccagcaaaagaggtgactgtatcaagtagtcttgatactttagggataatatgtacttaatgtgtcttaaacatactcttactgttctgtctttatgaatctgaacacttagatgatactgcattttaagcataagaacaattagttttcaatgagaagagctcttgttaatgtattaacagttactagttttggcacctgcaactttctgtatagaccatacatatctgacatcagaaaagcaggccctagagagaagtatatactagggtactttagagcaacttaatgaggggaggaatgaaagaatagatcagaatgattttgttgacatgactacagactgaaataatgtgaatgaattaactgaatttgctctgtcaactttagtaaattgcccattgcctttgctttgttcataatttcagcagggcagaataaaaaccatgggaggcaaagaaaggaaatccggaaatatagtcttaacctggtg

SEQ ID NO: 456447 - DNA, 624 bp, Homo sapiens
cgcgagggcgctgggagagagttagtttgaaaagcctgggggagtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggca

SEQ ID NO: 456448 - DNA, 638 bp, Homo sapiens
  misc_feature (51)..(51): n is a, c, g, or t
ggcaggggggccgcgggcccgaaagttaagttttggaaggcctgggcggtncttccagtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggca

SEQ ID NO: 456449 - DNA, 2239 bp, Homo sapiens
ggcaccgctgcctgaaagacctttctaggccagtcggggtccggcacccagttgacgagacagcgcggcgctttcagagctggggagaggcgaaaactcttccggccccccgatcccccggccagccgcccccggcagctccttgccgcctcccggcctgggcccgcccagccgttctcggcctgccgtcaggcgatctcggcggccagcccagccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggcattttgggctttccctcttttttgtaaagcaatgtctgcctagtttattgtccagttaactttagtgaccttttaaaagttggcattgtaaataaaacaacttgcaaaaaagttttctggaatagaattaacaaaatattatctttattcatgagttggaaactggaaaaaggcttcttgaagtaaatgttctgagtggagctactaggatgtcttccagcctcctgcagtcaaggagtaccactgtattgattagcctgtatgtagcagggctcccttcattgcatctgaggacttgttttctttttctttatttttaatcctcttagttttaaatatattgcctagagactcagttactacccagtttgtggttttttgggagaaatgtaactggacagttagcttttcaattaaaaagacacttaacccatgtgggatgtcatctttttataattagtgttcccatgtggagaaaattattcacactacttgcatgtaaagaataatttaacttttaacattaaaatatgtggtaaaacccagaaagcatccatcatgaatgcaagatactttcaataaaaagtaagttatatagtaggtagttaagtttgcttttgtggacttaaatgtgtctcttcacttaaatgggttgaatgtgtatatatttgttcagcttgaaaagacttagtttatatcctagctcactggaggctgctgacataaccataacttctgtcccttctaattgtcatttatatgcctaactggagctagtactttaattcttaacacaaaattactctgccattgtttccagcttccctcctacaatagaatgaagtttttttgatggcttgagatggctcacaaattttgatttttttttcttccttgtgctccctttttttctccttgcttttccagttaacatctatattcacatgtaatcttgttttctcttcacattcactgagttgttcaggctcagatcatcccttgacagtagtttgccttcatctcacctttcatttgtcccaaattcaccttatttaataaagtcccatatgttgtctcacttaaaattaaaaataatt

SEQ ID NO: 456450 - DNA, 2035 bp, Homo sapiens
ggcaccgctgcctgaaagacctttctaggccagtcggggtccggcacccagttgacgagacagcgcggcgctttcagagctggggagaggcgaaaactcttccggccccccgatcccccggccagccgcccccggcagctccttgccgcctcccggcctgggcccgcccagccgttctcggcctgccgtcaggcgatctcggcggccagcccagccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggcattttgggctttccctcttttttgtaaagcaatgtctgcctagtttattgtccagttaactttagtgaccttttaaaagttggcattgtaaataaaacaacttgcaaaaaagttttctggaatagaattaacaaaatattatctttattcatgagttggaaactggaaaaaggcttcttgaagtaaatgttctgagtggagctactaggatgtcttccagcctcctgcagtcaaggagtaccactgtattgattagcctgtatgtagcagggctcccttcattgcatctgaggacttgttttctttttctttatttttaatcctcttagttttaaatatattgcctagagactcagttactacccagtttgtggttttttgggagaaatgtaactggacagttagcttttcaattaaaaagacacttaacccatgtgggatgtcatctttttataattagtgttcccatgtggagaaaattattcacactacttgcatgtaaagaataatttaacttttaacattaaaatatgtggtaaaacccagaaagcatccatcatgaatgcaagatactttcaataaaaagtaagttatataaaaaaaaaaaaaaaaaaaaaaaaaaacctacaatagaatgaagtttttttgatggcttgagatggctcacaaattttgatttttttttcttccttgtgctccctttttttctccttgcttttccagttaacatctatattcacatgtaatcttgttttctcttcacattcactgagttgttcaggctcagatcatcccttgacagtagtttgccttcatctcacctttcatttgtcccaaattcaccttatttaataaagtcccatatgttgtctcacttaaaattaaaaataatt

SEQ ID NO: 456451 - DNA, 1757 bp, Homo sapiens
ggcaccgctgcctgaaagacctttctaggccagtcggggtccggcacccagttgacgagacagcgcggcgctttcagagctggggagaggcgaaaactcttccggccccccgatcccccggccagccgcccccggcagctccttgccgcctcccggcctgggcccgcccagccgttctcggcctgccgtcaggcgatctcggcggccagcccagccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggcattttgggctttccctcttttttgtaaagcaatgtctgcctagtttattgtccagttaactttagtgaccttttaaaagttggcattgtaaataaaacaacttgcaaaaaagttttctggaatagaattaacaaaatattatctttattcatgagttggaaactggaaaaaggcttcttgaagtaaatgttctgagtggagctactaggatgtcttccagcctcctgcagtcaaggagtaccactgtattgattagcctgtatgtagcagggctcccttcattgcatctgaggacttgttttctttttctttatttttaatcctcttagttttaaatatattgcctagagactcagttactacccagtttgtggttttttgggagaaatgtaactggacagttagcttttcaattaaaaagacacttaacccatgtgggatgtcatctttttataattagtgttcccatgtggagaaaattattcacactacttgcatgtaaagaataatttaacttttaacattaaaatatgtggtaaaacccagaaagcatccatcatacgccggatacttcaatatgtatccggccggaggggcgggggggggggagggggg

SEQ ID NO: 456452 - DNA, 859 bp, Homo sapiens
aggatcctcgaggccacgaaggcccgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggca

SEQ ID NO: 456453 - DNA, 1574 bp, Homo sapiens
ggcaccgctgcctgaaagacctttctaggccagtcggggtccggcacccagttgacgagacagcgcggcgctttcagagctggggagaggcgaaaactcttccggccccccgatcccccggccagccgcccccggcagctccttgccgcctcccggcctgggcccgcccagccgttctcggcctgccgtcaggcgatctcggcggccagcccagccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggcattttgggctttccctcttttttgtaaagcaatgtctgcctagtttattgtccagttaactttagtgaccttttaaaagttggcattgtaaataaaacaacttgcaaaaaagttttctggaatagaattaacaaaaaaaaaaaaaaaaaaaaaaaaaaaaaacctacaatagaatgaagtttttttgatggcttgagatggctcacaaattttgatttttttttcttccttgtgctccctttttttctccttgcttttccagttaacatctatattcacatgtaatcttgttttctcttcacattcactgagttgttcaggctcagatcatcccttgacagtagtttgccttcatctcacctttcatttgtcccaaattcaccttatttaataaagtcccatatgttgtctcacttaaaattaaaaataatt

SEQ ID NO: 456454 - DNA, 1542 bp, Homo sapiens
ggcaccgctgcctgaaagacctttctaggccagtcggggtccggcacccagttgacgagacagcgcggcgctttcagagctggggagaggcgaaaactcttccggccccccgatcccccggccagccgcccccggcagctccttgccgcctcccggcctgggcccgcccagccgttctcggcctgccgtcaggcgatctcggcggccagcccagccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggcattttgggctttccctcttttttgtaaagcaatgtctgcctagtttattgtccagttaactttagtgaccttttaaaagttggcattgtaaataaaacaacttgcaaaaaaaacacacacacgaaaaacgcaagaaaaacagatagaaacaagaggtagacaggcacattcacaaggacaacaccaacaagaaacagaggccacaccacagttcacacaaacaacacaccgccaaaacggaacacaaaacacccagacaagcaccagaaaaacagccaagcaaaaacaaaaacaaaccagagcaccaagaaaaaaaacggaacaaaaaaggaaacgagatagacggagaaaaaacactgaagaccaaaaccacagagagacaacaaccgaacagcaaccg

SEQ ID NO: 456455 - DNA, 1262 bp, Homo sapiens
ggcaccgctgcctgaaagacctttctaggccagtcggggtccggcacccagttgacgagacagcgcggcgctttcagagctggggagaggcgaaaactcttccggccccccgatcccccggccagccgcccccggcagctccttgccgcctcccggcctgggcccgcccagccgttctcggcctgccgtcaggcgatctcggcggccagcccagccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggcattttgggctttccctcttttttgtaaagcaatgtctgcctagtttattgtccagttaactttagtgaccttttaaagtgcctgtatacacgcttgctaaaaaaaaaagggggcgtcaat

SEQ ID NO: 456456 - DNA, 874 bp, Homo sapiens
cccacgcgtacgcggacgcgtgggcgacccacgcgtccgcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggca

SEQ ID NO: 456457 - DNA, 1277 bp, Homo sapiens
  misc_feature (1152)..(1153): n is a, c, g, or t
  misc_feature (1156)..(1156): n is a, c, g, or t
  misc_feature (1173)..(1173): n is a, c, g, or t
  misc_feature (1182)..(1182): n is a, c, g, or t
  misc_feature (1184)..(1184): n is a, c, g, or t
ggcaccgctgcctgaaagacctttctaggccagtcggggtccggcacccagttgacgagacagcgcggcgctttcagagctggggagaggcgaaaactcttccggccccccgatcccccggccagccgcccccggcagctccttgccgcctcccggcctgggcccgcccagccgttctcggcctgccgtcaggcgatctcggcggccagcccagccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggcagtaagcagnngcngttatgccgattgggcntaaatggtngntaacactgcgaggttgggattccttttttggtggagagaggggggagggtggggggaaaaaacggttggggggagggggggggggagaaggtg

SEQ ID NO: 456458 - DNA, 1216 bp, Homo sapiens
  misc_feature (1206)..(1206): n is a, c, g, or t
  misc_feature (1208)..(1208): n is a, c, g, or t
ggcaccgctgcctgaaagacctttctaggccagtcggggtccggcacccagttgacgagacagcgcggcgctttcagagctggggagaggcgaaaactcttccggccccccgatcccccggccagccgcccccggcagctccttgccgcctcccggcctgggcccgcccagccgttctcggcctgccgtcaggcgatctcggcggccagcccagccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggcaaaaaaaaaaaaaaaaaaaaaaaaaaaaaaaaaacaaaaaaaaaaaaaaaaaaaagaaaaaacnanccgggacg

SEQ ID NO: 456459 - DNA, 1200 bp, Homo sapiens
  misc_feature (1190)..(1190): n is a, c, g, or t
  misc_feature (1192)..(1192): n is a, c, g, or t
ggcaccgctgcctgaaagacctttctaggccagtcggggtccggcacccagttgacgagacagcgcggcgctttcagagctggggagaggcgaaaactcttccggccccccgatcccccggccagccgcccccggcagctccttgccgcctcccggcctgggcccgcccagccgttctcggcctgccgtcaggcgatctcggcggccagcccagccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggcaaaaaaaaaaaaaaaaaaaaaaaaaaaaaaaaaaaaaaagaaaaaacnanccgggacg

SEQ ID NO: 456460 - DNA, 2144 bp, Homo sapiens
ggcaccgctgcctgaaagacctttctaggccagtcggggtccggcacccagttgacgagacagcgcggcgctttcagagctggggagaggcgaaaactcttccggccccccgatcccccggccagccgcccccggcagctccttgccgcctcccggcctgggcccgcccagccgttctcggcctgccgtcaggcgatctcggcggccagcccagccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagactagtatgatggaaagtttcttttttctttgctctgaataaaactgaactgtgggttctctataagtggcattttgggctttccctcttttttgtaaagcaatgtctgcctagtttattgtccagttaactttagtgaccttttaaaagttggcattgtaaataaaacaacttgcaaaaaagttttctggaatagaattaacaaaatattatctttattcatgagttggaaactggaaaaaggcttcttgaagtaaatgttctgagtggagctactaggatgtcttccagcctcctgcagtcaaggagtaccactgtattgattagcctgtatgtagcagggctcccttcattgcatctgaggacttgttttctttttctttatttttaatcctcttagttttaaatatattgcctagagactcagttactacccagtttgtggttttttgggagaaatgtaactggacagttagcttttcaattaaaaagacacttaacccatgtgggatgtcatctttttataattagtgttcccatgtggagaaaattattcacactacttgcatgtaaagaataatttaacttttaacattaaaatatgtggtaaaacccagaaagcatccatcatgaatgcaagatactttcaataaaaagtaagttatatagtaggtagttaagtttgcttttgtggacttaaatgtgtctcttcacttaaatgggttgaatgtgtatatatttgttcagcttgaaaagacttagtttatatcctagctcactggaggctgctgacataaccataacttctgtcccttctaattgtcatttatatgcctaactggagctagtactttaattcttaacacaaaattactctgccattgtttccagcttccctcctacaatagaatgaagtttttttgatggcttgagatggctcacaaattttgatttttttttcttccttgtgctccctttttttctccttgcttttccagttaacatctatattcacatgtaatcttgttttctcttcacattcactgagttgttcaggctcagatcatcccttgacagtagtttgccttcatctcacctttcatttgtcccaaattcaccttatttaataaagtcccatatgttgtctcacttaaaattaaaaataatt

SEQ ID NO: 456461 - DNA, 1196 bp, Homo sapiens
ggcaccgctgcctgaaagacctttctaggccagtcggggtccggcacccagttgacgagacagcgcggcgctttcagagctggggagaggcgaaaactcttccggccccccgatcccccggccagccgcccccggcagctccttgccgcctcccggcctgggcccgcccagccgttctcggcctgccgtcaggcgatctcggcggccagcccagccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccacataaatgagcatattctgatgtactctttggatctgaactcatcttcacagatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggca

SEQ ID NO: 456462 - DNA, 1636 bp, Homo sapiens
ggcaccgctgcctgaaagacctttctaggccagtcggggtccggcacccagttgacgagacagcgcggcgctttcagagctggggagaggcgaaaactcttccggccccccgatcccccggccagccgcccccggcagctccttgccgcctcccggcctgggcccgcccagccgttctcggcctgccgtcaggcgatctcggcggccagcccagccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccacataaatgagcatattctgatgtactctttggatctgaactcatcttcacaggtaggactcactgtggggaaaatttctatcttatttagtagcgttgtttgttttggactgaccttcctcaggttcgcatgtagttaattgtggcagttaactgttcagatggagtccagtattcagtgggagacgaaaggcaggcagaaagcaaatacaaatatgtatgttttattaaatttataccaatagtgagttcagtagggcaggccttaaaagcttctgttcctagtagttatactttgaaaaaattttaatagaaatactcggagactaacttgtgaataactgcttacaacagtgctttacagggttatgtattgtaggttcttagaactttgtggtcaataagttagagccttctgatggactgtagttgatgaaatgtcatgtagaactctctctcttaaattttatatttaatgtccttttttttttagatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggca

SEQ ID NO: 456463 - DNA, 782 bp, Homo sapiens
tcccgggagtaactcgatgcgttctgtaatcaagatccttaggatggtagttcttgaggtcattactgtggtctatactatcagagacgtcgcaagcgagacctcggtatctggattactccccgcgatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggca

SEQ ID NO: 456464 - DNA, 1875 bp, Homo sapiens
cccacgcgtacgcggacgcgtgggcgacccacgcgtccgcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagactagtatgatggaaagtttcttttttctttgctctgaataaaactgaactgtgggttctctataagtggcattttgggctttccctcttttttgtaaagcaatgtctgcctagtttattgtccagttaactttagtgaccttttaaaagttggcattgtaaataaaacaacttgcaaaaaagttttctggaatagaattaacaaaatattatctttattcatgagttggaaactggaaaaaggcttcttgaagtaaatgttctgagtggagctactaggatgtcttccagcctcctgcagtcaaggagtaccactgtattgattagcctgtatgtagcagggctcccttcattgcatctgaggacttgttttctttttctttatttttaatcctcttagttttaaatatattgcctagagactcagttactacccagtttgtggttttttgggagaaatgtaactggacagttagcttttcaattaaaaagacacttaacccatgtgggatgtcatctttttataattagtgttcccatgtggagaaaattattcacactacttgcatgtaaagaataatttaacttttaacattaaaatatgtggtaaaacccagaaagcatccatcatgaatgcaagatactttcaataaaaagtaagttatatagtaggtagttaagtttgcttttgtggacttaaatgtgtctcttcacttaaatgggttgaatgtgtatatatttgttcagcttgaaaagacttagtttatatcctagctcactggaggctgctgacataaccataacttctgtcccttctaattgtcatttatatgcctaactggagctagtactttaattcttaacacaaaattactctgccattgtttccagcttccctcctacaatagaatgaagtttttttgatggcttgagatggctcacaaattttgatttttttttcttccttgtgctccctttttttctccttgcttttccagttaacatctatattcacatgtaatcttgttttctcttcacattcactgagttgttcaggctcagatcatcccttgacagtagtttgccttcatctcacctttcatttgtcccaaattcaccttatttaataaagtcccatatgttgtctcacttaaaattaaaaataatt

SEQ ID NO: 456465 - DNA, 2078 bp, Homo sapiens
ggcaccgctgcctgaaagacctttctaggccagtcggggtccggcacccagttgacgagacagcgcggcgctttcagagctggggagaggcgaaaactcttccggccccccgatcccccggccagccgcccccggcagctccttgccgcctcccggcctgggcccgcccagccgttctcggcctgccgtcaggcgatctcggcggccagcccagccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgatttgagcacagatcccaaaccttacggccaagtttcttctagtatgatggaaagtttcttttttctttgctctgaataaaactgaactgtgggttctctataagtggcattttgggctttccctcttttttgtaaagcaatgtctgcctagtttattgtccagttaactttagtgaccttttaaaagttggcattgtaaataaaacaacttgcaaaaaagttttctggaatagaattaacaaaatattatctttattcatgagttggaaactggaaaaaggcttcttgaagtaaatgttctgagtggagctactaggatgtcttccagcctcctgcagtcaaggagtaccactgtattgattagcctgtatgtagcagggctcccttcattgcatctgaggacttgttttctttttctttatttttaatcctcttagttttaaatatattgcctagagactcagttactacccagtttgtggttttttgggagaaatgtaactggacagttagcttttcaattaaaaagacacttaacccatgtgggatgtcatctttttataattagtgttcccatgtggagaaaattattcacactacttgcatgtaaagaataatttaacttttaacattaaaatatgtggtaaaacccagaaagcatccatcatgaatgcaagatactttcaataaaaagtaagttatatagtaggtagttaagtttgcttttgtggacttaaatgtgtctcttcacttaaatgggttgaatgtgtatatatttgttcagcttgaaaagacttagtttatatcctagctcactggaggctgctgacataaccataacttctgtcccttctaattgtcatttatatgcctaactggagctagtactttaattcttaacacaaaattactctgccattgtttccagcttccctcctacaatagaatgaagtttttttgatggcttgagatggctcacaaattttgatttttttttcttccttgtgctccctttttttctccttgcttttccagttaacatctatattcacatgtaatcttgttttctcttcacattcactgagttgttcaggctcagatcatcccttgacagtagtttgccttcatctcacctttcatttgtcccaaattcaccttatttaataaagtcccatatgttgtctcacttaaaattaaaaataatt

SEQ ID NO: 456466 - DNA, 650 bp, Homo sapiens
  misc_feature (51)..(51): n is a, c, g, or t
  misc_feature (53)..(54): n is a, c, g, or t
cggaggggggggccccgtcatgggcgatgtacatgtttttagtttttaggnanngggccctcggcgcgagtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggca

SEQ ID NO: 456467 - DNA, 2184 bp, Homo sapiens
ggcaccgctgcctgaaagacctttctaggccagtcggggtccggcacccagttgacgagacagcgcggcgctttcagagctggggagaggcgaaaactcttccggccccccgatcccccggccagccgcccccggcagctccttgccgcctcccggcctgggcccgcccagccgttctcggcctgccgtcaggcgatctcggcggccagcccagccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggcattttgggctttccctcttttttgtaaagcaatgtctgcctagtttattgtccagttaactttagtgaccttttaaaagttggcattgtaaataaaacaacttgcaaaaaagttttctggaatagaattaacaaaatattatctttattcatgagttggaaactggaaaaaggcttcttgaagtaaatgttctgagtggagctactaggatgtcttccagcctcctgcagtcaaggagtaccactgtattgattagcctgtatgtagcagggctcccttcattgcatctgaggacttgttttctttttctttatttttaatcctcttagttttaaatatattgcctagagactcagttactacccagtttgtggttttttgggagaaatgtaactggacagttagcttttcaattaaaaagacacttaacccatgtgggatgtcatctttttataattagtgttcccatgtggagaaaattattcacactacttgcatgtaaagaataatttaacttttaacattaaaatatgtggtaaaacccagaaagcatccatcatgaatgcaagatactttcaataaaaagtaagttatatagtaggtagttaagtttgcttttgtggacttaaatgtgtctcttcacttaaatgggttgaatgtgtatatatttgttcagcttgaaaagacttagtttatatcctagctcactggaggctgctgacataaccataacttctgtcccttctaattgtcatttatatgcctaactggagctagtactttaattcttaacacaaaattactctgccattgtttccagcttccctcctacaatagaatgaagtttttttgatggcttgagatggctcacaaattttgatttttttttcttccttgtgctccctttttttctccttgcttttccagttaacatctatattcacatgtaatcttgttttctcttcacattcactgagttgttcaggctcagatcatcccttgacagtagtttgccttcatctcacctttcatttgtcccaaattcaccttatttaataaagtcccatatgttgtctcacttaaaattaaaaataatt

SEQ ID NO: 456468 - DNA, 1586 bp, Homo sapiens
gctgacttagaggaccccgactagtccaaccatacctttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggcattttgggctttccctcttttttgtaaagcaatgtctgcctagtttattgtccagttaactttagtgaccttttaaaagttggcattgtaaataaaacaacttgcaaaaaagttttctggaatagaattaacaaaatattatctttattcatgagttggaaactggaaaaaggcttcttgaagtaaatgttctgagtggagctactaggatgtcttccagcctcctgcagtcaaggagtaccactgtattgattagcctgtatgtagcagggctcccttcattgcatctgaggacttgttttctttttctttatttttaatcctcttagttttaaatatattgcctagagactcagttactacccagtttgtggttttttgggagaaatgtaactggacagttagcttttcaattaaaaagacacttaacccatgtgggatgtcatctttttataattagtgttcccatgtggagaaaattattcacactacttgcatgtaaagaataatttaacttttaacattaaaatatgtggtaaaacccagaaagcatccatcatgaatgcaagatactttcaataaaaagtaagttatatagtaggtagttaagtttgcttttgtggacttaaatgtgtctcttcacttaaatgggttgaatgtgtatatatttgttcagcttgaaaagacttagtttatatcctagctcactggaggctgctgacataaccataacttctgtcccttctaattgtcatttatatgcctaactggagctagtactttaattcttaacacaaaattactctgccattgtttccagcttccctcctacaatagaatgaagtttttttgatggcttgagatggctcacaaattttgatttttttttcttccttgtgctccctttttttctccttgcttttccagttaacatctatattcacatgtaatcttgttttctcttcacattcactgagttgttcaggctcagatcatcccttgacagtagtttgccttcatctcacctttcatttgtcccaaattcaccttatttaataaagtcccatatgttgtctcacttaaaattaaaaataatt

SEQ ID NO: 456469 - DNA, 1405 bp, Homo sapiens
ggcaccgctgcctgaaagacctttctaggccagtcggggtccggcacccagttgacgagacagcgcggcgctttcagagctggggagaggcgaaaactcttccggccccccgatcccccggccagccgcccccggcagctccttgccgcctcccggcctgggcccgcccagccgttctcggcctgccgtcaggcgatctcggcggccagcccagccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtaggtagcacacagttttgtctttgatcacatgctcttaaaaagggagtaacacctataacatgccagcaaaagaggtgactgtatcaagtagtcttgatactttagggataatatgtacttaatgtgtcttaaacatactcttactgttctgtctttatgaatctgaacacttagatgatactgcattttaagcataagaacaattagttttcaatgagaagagctcttgttaatgtattaacagttactagttttggcacctgcaactttctgtatagaccatacatatctgacatcagaaaagcaggccctagagagaagtatatactagggtactttagagcaacttaatgaggggaggaatgaaagaatagatcagaatgattttgttgacatgactacagactgaaataatgtgaatgaattaactgaatttgctctgtcaactttagtaaattgcccattgcctttgctttgttcataatttcagcagggcagaataaaaaccatgggaggcaaagaaaggaaatccggaaatatagtcttaacctggtg

SEQ ID NO: 456470 - DNA, 1090 bp, Homo sapiens
ggcaccgctgcctgaaagacctttctaggccagtcggggtccggcacccagttgacgagacagcgcggcgctttcagagctggggagaggcgaaaactcttccggccccccgatcccccggccagccgcccccggcagctccttgccgcctcccggcctgggcccgcccagccgttctcggcctgccgtcaggcgatctcggcggccagcccagccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagcaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggca

SEQ ID NO: 456471 - DNA, 1258 bp, Homo sapiens
aagatcgaatcgagcctgtaccagtaatctggcccgcgagtattctggcggtatttgagcacagatcccaaaccttacggccaagtttcttctagtatgatggaaagtttcttttttctttgctctgaataaaactgaactgtgggttctctataagtggcattttgggctttccctcttttttgtaaagcaatgtctgcctagtttattgtccagttaactttagtgaccttttaaaagttggcattgtaaataaaacaacttgcaaaaaagttttctggaatagaattaacaaaatattatctttattcatgagttggaaactggaaaaaggcttcttgaagtaaatgttctgagtggagctactaggatgtcttccagcctcctgcagtcaaggagtaccactgtattgattagcctgtatgtagcagggctcccttcattgcatctgaggacttgttttctttttctttatttttaatcctcttagttttaaatatattgcctagagactcagttactacccagtttgtggttttttgggagaaatgtaactggacagttagcttttcaattaaaaagacacttaacccatgtgggatgtcatctttttataattagtgttcccatgtggagaaaattattcacactacttgcatgtaaagaataatttaacttttaacattaaaatatgtggtaaaacccagaaagcatccatcatgaatgcaagatactttcaataaaaagtaagttatatagtaggtagttaagtttgcttttgtggacttaaatgtgtctcttcacttaaatgggttgaatgtgtatatatttgttcagcttgaaaagacttagtttatatcctagctcactggaggctgctgacataaccataacttctgtcccttctaattgtcatttatatgcctaactggagctagtactttaattcttaacacaaaattactctgccattgtttccagcttccctcctacaatagaatgaagtttttttgatggcttgagatggctcacaaattttgatttttttttcttccttgtgctccctttttttctccttgcttttccagttaacatctatattcacatgtaatcttgttttctcttcacattcactgagttgttcaggctcagatcatcccttgacagtagtttgccttcatctcacctttcatttgtcccaaattcaccttatttaataaagtcccatatgttgtctcacttaaaattaaaaataatt

SEQ ID NO: 456472 - DNA, 1143 bp, Homo sapiens
ggcaccgctgcctgaaagacctttctaggccagtcggggtccggcacccagttgacgagacagcgcggcgctttcagagctggggagaggcgaaaactcttccggccccccgatcccccggccagccgcccccggcagctccttgccgcctcccggcctgggcccgcccagccgttctcggcctgccgtcaggcgatctcggcggccagcccagccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggca

SEQ ID NO: 456473 - DNA, 1077 bp, Homo sapiens
ggcaccgctgcctgaaagacctttctaggccagtcggggtccggcacccagttgacgagacagcgcggcgctttcagagctggggagaggcgaaaactcttccggccccccgatcccccggccagccgcccccggcagctccttgccgcctcccggcctgggcccgcccagccgttctcggcctgccgtcaggcgatctcggcggccagcccagccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaattttgggctttccctcttttttgtaaagcaatgtctgcctagtttattgtccagttaactttagtgaccttttaaaagttggcattgtaaataaaacaacttgcaaaaaagttttctggaatagaattaacaaaatattatctttattcatgagttggaacttggggttttgaagtggcttggggggggtcctaggtggtttcagcctcctcggcaagggagcactgttttggttaccctttggtgaggggtccttttg

SEQ ID NO: 456474 - DNA, 1577 bp, Homo sapiens
ggcaccgctgcctgaaagacctttctaggccagtcggggtccggcacccagttgacgagacagcgcggcgctttcagagctggggagaggcgaaaactcttccggccccccgatcccccggccagccgcccccggcagctccttgccgcctcccggcctgggcccgcccagccgttctcggcctgccgtcaggcgatctcggcggccagcccagccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggcattttgggctttccctcttttttgtaaagcaatgtctgcctagtttattgtccagttaactttagtgaccttttaaaagttggcattgtaaataaaacaacttgcaaaaaagttttctggaatagaattaacaaaatattatctttattcatgagttggaaactggaaaaaggcttcttgaagtaaatgttctgagtggagctactaggatgtcttccagcctcctgcagtcaaggagtaccactgtattgattagcctgtatgtagcagggctcccttcattgcatctgaggacttgttttctttttctttatttttaatcctcttagttttaaatatattgcctagagactcagttactacccagtttgtggttttttgggagaaatgtaactggacagttagcttttcaattaaaaagacacttaacccatg

SEQ ID NO: 456475 - DNA, 1670 bp, Homo sapiens
  misc_feature (1656)..(1656): n is a, c, g, or t
  misc_feature (1659)..(1659): n is a, c, g, or t
  misc_feature (1664)..(1664): n is a, c, g, or t
ggcaccgctgcctgaaagacctttctaggccagtcggggtccggcacccagttgacgagacagcgcggcgctttcagagctggggagaggcgaaaactcttccggccccccgatcccccggccagccgcccccggcagctccttgccgcctcccggcctgggcccgcccagccgttctcggcctgccgtcaggcgatctcggcggccagcccagccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggcattttgggctttccctcttttttgtaaagcaatgtctgcctagtttattgtccagttaactttagtgaccttttaaaagttggcattgtaaataaaacaacttgcaaaaaagttttctggaatagaattaacaaaatattatctttattcatgagttggaaactggaaaaaggcttcttgaagtaaatgttctgagtggagctactaggatgtcttccagcctcctgcagtcaaggagtaccactgtattgattagcctgtatgtagcagggctcccttcattgcatctgaggacttgttttctttttctttatttttaatcctcttagttttaaatatattgcctagagactcagttactacccagtttgtggttttttgggagaaatgtaactggacagttagcttttcaattaaaaagacacttaacccatgaaaaaaaaaaaaaaaaaaaaaaaaaaaaaaaacaaaaagggggggggggcaaaaaaataccccccgggggggcccattngcnccccngttttt

SEQ ID NO: 456476 - DNA, 1320 bp, Homo sapiens
  misc_feature (1306)..(1306): n is a, c, g, or t
  misc_feature (1309)..(1309): n is a, c, g, or t
  misc_feature (1314)..(1314): n is a, c, g, or t
ggcaccgctgcctgaaagacctttctaggccagtcggggtccggcacccagttgacgagacagcgcggcgctttcagagctggggagaggcgaaaactcttccggccccccgatcccccggccagccgcccccggcagctccttgccgcctcccggcctgggcccgcccagccgttctcggcctgccgtcaggcgatctcggcggccagcccagccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggcattttgggctttccctcttttttgtaaagcaatgtctgcctagtttattgtccagttaactttagtgaccttttaaaagttggcattgtaaataaaacaacttgcaaaaaaaaaaaacaaaaagggggggggggcaaaaaaataccccccgggggggcccattngcnccccngttttt

SEQ ID NO: 456477 - DNA, 1336 bp, Homo sapiens
  misc_feature (1290)..(1290): n is a, c, g, or t
ggcaccgctgcctgaaagacctttctaggccagtcggggtccggcacccagttgacgagacagcgcggcgctttcagagctggggagaggcgaaaactcttccggccccccgatcccccggccagccgcccccggcagctccttgccgcctcccggcctgggcccgcccagccgttctcggcctgccgtcaggcgatctcggcggccagcccagccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggcaaaaaaaaaaaaatgggcctcattggcctcagggggaggagctctggggccgctcccctttaaggagggttaagtcatgatcctacctcactgacccctgcgcctcggatggttcagctggggggagcggttcatcttcactcagggncgtgatccgggattccctagatgagggagacagcgacgcaaaaacg

SEQ ID NO: 456478 - DNA, 1431 bp, Homo sapiens
ggcaccgctgcctgaaagacctttctaggccagtcggggtccggcacccagttgacgagacagcgcggcgctttcagagctggggagaggcgaaaactcttccggccccccgatcccccggccagccgcccccggcagctccttgccgcctcccggcctgggcccgcccagccgttctcggcctgccgtcaggcgatctcggcggccagcccagccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggcaaaaaaaacaaaaaaaatgtgctttttgtcctcacgcggggagctttgcggccgctccccttaatgagggtaatttcagaacctcgctcattgactcgctcgcttcggccgttagttgcggggacggttcagctccttaaggcggcaatccggtttcccaaaatccgggttacgcggaaaaacattgccaaaagccccacaggcccgaacctaaatggccggtgtggggtttaccatagtcccgcccccagagattaaaaaatatcttaattaaggggccacccccccg

SEQ ID NO: 456479 - DNA, 1251 bp, Homo sapiens
  misc_feature (1144)..(1144): n is a, c, g, or t
  misc_feature (1149)..(1150): n is a, c, g, or t
  misc_feature (1154)..(1154): n is a, c, g, or t
  misc_feature (1156)..(1156): n is a, c, g, or t
  misc_feature (1167)..(1168): n is a, c, g, or t
  misc_feature (1172)..(1173): n is a, c, g, or t
  misc_feature (1180)..(1180): n is a, c, g, or t
  misc_feature (1184)..(1184): n is a, c, g, or t
  misc_feature (1188)..(1188): n is a, c, g, or t
ggcaccgctgcctgaaagacctttctaggccagtcggggtccggcacccagttgacgagacagcgcggcgctttcagagctggggagaggcgaaaactcttccggccccccgatcccccggccagccgcccccggcagctccttgccgcctcccggcctgggcccgcccagccgttctcggcctgccgtcaggcgatctcggcggccagcccagccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggcanttggnntccncntttgaagcagnngccnnttatgcncganttgngccttaaagtgttgtgtaacactgcaaaaaaaaaacccggtttttggggggaaagaaagcctg

SEQ ID NO: 456480 - DNA, 1076 bp, Homo sapiens
ggcaccgctgcctgaaagacctttctaggccagtcggggtccggcacccagttgacgagacagcgcggcgctttcagagctggggagaggcgaaaactcttccggccccccgatcccccggccagccgcccccggcagctccttgccgcctcccggcctgggcccgcccagccgttctcggcctgccgtcaggcgatctcggcggccagcccagccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtgctctgaataaaactgaactgtgggttctctataagtggca

SEQ ID NO: 456481 - DNA, 1312 bp, Homo sapiens
ggcaccgctgcctgaaagacctttctaggccagtcggggtccggcacccagttgacgagacagcgcggcgctttcagagctggggagaggcgaaaactcttccggccccccgatcccccggccagccgcccccggcagctccttgccgcctcccggcctgggcccgcccagccgttctcggcctgccgtcaggcgatctcggcggccagcccagccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccgtgagtagccgcccactgaactggaaagggtcgtggctaccggattgcgtgccggctggcctcaccgctgcggtttgggcctgcccgcggcgggcggtgactgggcctggccttctttcgggcccggtggatcgcgttgtcgaccctgttcttcgggagacactaccagatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggca

SEQ ID NO: 456482 - DNA, 1158 bp, Homo sapiens
ggcaccgctgcctgaaagacctttctaggccagtcggggtccggcacccagttgacgagacagcgcggcgctttcagagctggggagaggcgaaaactcttccggccccccgatcccccggccagccgcccccggcagctccttgccgcctcccggcctgggcccgcccagccgttctcggcctgccgtcaggcgatctcggcggccagcccagccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagactagtatgatggaaagtttcttttttctttgctctgaataaaactgaactgtgggttctctataagtggcattttgggctttccctcttttttgtaaagcaatgtctgcctagtttattgtccagttaactttagtgaccttttaaaagttggcattgtaaataaaacaacttgcaaaaaa

SEQ ID NO: 456483 - DNA, 1914 bp, Homo sapiens
ggcaccgctgcctgaaagacctttctaggccagtcggggtccggcacccagttgacgagacagcgcggcgctttcagagctggggagaggcgaaaactcttccggccccccgatcccccggccagccgcccccggcagctccttgccgcctcccggcctgggcccgcccagccgttctcggcctgccgtcaggcgatctcggcggccagcccagccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaattttgggctttccctcttttttgtaaagcaatgtctgcctagtttattgtccagttaactttagtgaccttttaaaagttggcattgtaaataaaacaacttgcaaaaaagttttctggaatagaattaacaaaatattatctttattcatgagttggaaactggaaaaaggcttcttgaagtaaatgttctgagtggagctactaggatgtcttccagcctcctgcagtcaaggagtaccactgtattgattagcctgtatgtagcagggctcccttcattgcatctgaggacttgttttctttttctttatttttaatcctcttagttttaaatatattgcctagagactcagttactacccagtttgtggttttttgggagaaatgtaactggacagttagcttttcaattaaaaagacacttaacccatgtgggatgtcatctttttataattagtgttcccatgtggagaaaattattcacactacttgcatgtaaagaataatttaacttttaacattaaaatatgtggtaaaacccagaaagcatccatcatgaatgcaagatactttcaataaaaagtaagttatatagtaggtagttaagtttgcttttgtggacttaaatgtgtctcttcacttaaatgggttgaatgtgtatatatttgttcagcttgaaaagacttagtttatatcctagctcactggaggctgctgacataaccataacttctgtcccttctaattgtcatttatatgcctaactggagctagtactttaattcttaacacaaaattactctgccattgtttccagcttccctcctacaatagaatgaagtttttttgatggcttgagatggctcacaaattttgatttttttttcttccttgtgctccctttttttctccttgcttttccagttaacatctatattcacatgtaatcttgttttctcttcacattcactgagttgttcaggctcagatcatcccttgacagtagtttgccttcatctcacctttcatttgtcccaaattcaccttatttaataaagtcccatatgttgtctcacttaaaattaaaaataatt

SEQ ID NO: 456484 - DNA, 2186 bp, Homo sapiens
ggcaccgctgcctgaaagacctttctaggccagtcggggtccggcacccagttgacgagacagcgcggcgctttcagagctggggagaggcgaaaactcttccggccccccgatcccccggccagccgcccccggcagctccttgccgcctcccggcctgggcccgcccagccgttctcggcctgccgtcaggcgatctcggcggccagcccagccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagcaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggcattttgggctttccctcttttttgtaaagcaatgtctgcctagtttattgtccagttaactttagtgaccttttaaaagttggcattgtaaataaaacaacttgcaaaaaagttttctggaatagaattaacaaaatattatctttattcatgagttggaaactggaaaaaggcttcttgaagtaaatgttctgagtggagctactaggatgtcttccagcctcctgcagtcaaggagtaccactgtattgattagcctgtatgtagcagggctcccttcattgcatctgaggacttgttttctttttctttatttttaatcctcttagttttaaatatattgcctagagactcagttactacccagtttgtggttttttgggagaaatgtaactggacagttagcttttcaattaaaaagacacttaacccatgtgggatgtcatctttttataattagtgttcccatgtggagaaaattattcacactacttgcatgtaaagaataatttaacttttaacattaaaatatgtggtaaaacccagaaagcatccatcatgaatgcaagatactttcaataaaaagtaagttatatagtaggtagttaagtttgcttttgtggacttaaatgtgtctcttcacttaaatgggttgaatgtgtatatatttgttcagcttgaaaagacttagtttatatcctagctcactggaggctgctgacataaccataacttctgtcccttctaattgtcatttatatgcctaactggagctagtactttaattcttaacacaaaattactctgccattgtttccagcttccctcctacaatagaatgaagtttttttgatggcttgagatggctcacaaattttgatttttttttcttccttgtgctccctttttttctccttgcttttccagttaacatctatattcacatgtaatcttgttttctcttcacattcactgagttgttcaggctcagatcatcccttgacagtagtttgccttcatctcacctttcatttgtcccaaattcaccttatttaataaagtcccatatgttgtctcacttaaaattaaaaataatt

SEQ ID NO: 456485 - DNA, 928 bp, Homo sapiens
ggcaccgctgcctgaaagacctttctaggccagtcggggtccggcacccagttgacgagacagcgcggcgctttcagagctggggagaggcgaaaactcttccggccccccgatcccccggccagccgcccccggcagctccttgccgcctcccggcctgggcccgcccagccgttctcggcctgccgtcaggcgatctcggcggccagcccagccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaattttgggctttccctcttttttgtaaagcaatgtctgcctagtttattgtccagttaactttagtgaccttttaaaagttggcattgtaaataaaacaacttgcaaaaaa

SEQ ID NO: 456486 - DNA, 2163 bp, Homo sapiens
ccggggcaagggaagctagtagcggagccggaagtgaggcaccctcgggctcgagacagcggcgacgtttaaagctgagcgacccagtgccactggagacggtcagcttctccactcaggctcctccagcccgagccagaagaccccctcccccagaattctgggggccgatggaagggagccgagtcagatcgcgaggtacccagagccgacagaccggagcgacagggagttgccagaagccccgcccctaggagtgatcggaaagcctcacccatccgggtgaggaacccggagggaccgcctccgggcggagcccgccgaccatggctacgcccctggtggcgggtcccgcagctctacgcttcgccgccgcggctagctggcaggttgtgcgcggacgctgcgtggaacattttccgcgagtactggagtttctgcgatctctgcgcgctgttgcccctggcttggttcgctaccggcaccacgaacgcctttgtatgggcctaaaggccaaggtggtggtggagctgatcctgcagggccggccttgggcccaagtcctgaaagccctgaatcaccactttccagaatctggacctatagtgcgggatcccaaggctacaaagcaggatctgaggaagattttggaggcacaggaaactttttaccagcaggtgaagcagctgtcagaggctcctgtggatttggcctcgaagctgcaggaacttgaacaagagtatggggaaccctttctggctgccatggaaaagctgctttttgagtacttgtgtcagctggagaaagcactgcctacaccgcaggcacagcagcttcaggatgtgctgagttggatgcagcctggagtctctatcacctcttctcttgcctggagacaatatggtgtggacatggggtggctgcttccagagtgctctgttactgactcagtgaacctggctgagcccatggaacagaatcctcctcagcaacaaagactagcactccacaatcccctgccaaaagccaagcctggcacacatcttcctcagggaccatcttcaaggacgcacccagaacctctagctggccgacacttcaatctggcccctctaggccgacgaagagttcagtcccaatgggcctccactaggggaggccataaggagcgccccacagtcatgctgtttccctttaggaatctcggctcaccaacccaggtcatatctaagcctgagagcaaggaagaacatgcgatatacacagcagacctagccatgggcacaagagcagcctccactgggaagtctaagagtccatgccagaccctggggggaagggctctgaaggagaacccagttgacttgcctgccacagagcaaaaggagtgagtggaacagagttgcttcttactaggagcacattctttgcctgccttcccttcatcctatcctctttgcttgctctcacctcaggaattgcttggattgctacatggaccccctgagactatcattattacctcctagggccaggaagccaggtaggtagtctgagtcaggattggatcaacagcctcctctcttggggactctcaagagcctgtgttcatctagaagtagtagtttgattctggtttccctcctacagtgtgtcctccgtctctgtgcagctccgtcattaccataggggacttggttttagactctgatgaggaagaaaatggccagggggaaggaaaggtgagtgggaaggagcagaaagctgggaaaggggatgggtagaacaagactgagaaatccacatgcttcagaattcagagggttcagggaatggtttcggatagtaggctctccctgctcccttctctacaggaatctctggaaaactatcagaagacaaagtttgacaccttgatacccactctctgtgaatacctacccccttctggccacggtgccatacctgtttcttcctgtgactgtagagacagttctagacctttgtgatagaactaaaatgctctctgtactctagtctcctgcctcctcagctctgcaagtagtttagtaggaatgaagtggaagtccaggcttggattgcctaactacactgctaaaaatatttgtaatccttaataattaaactttggatttgttaaaa

SEQ ID NO: 456487 - DNA, 1971 bp, Homo sapiens
ccggggcaagggaagctagtagcggagccggaagtgaggcaccctcgggctcgagacagcggcgacgtttaaagctgagcgacccagtgccactggagacggtcagcttctccactcaggctcctccagcccgagccagaagaccccctcccccagaattctgggggccgatggaagggagccgagtcagatcgcgaggtacccagagccgacagaccggagcgacagggagttgccagaagccccgcccctaggagtgatcggaaagcctcacccatccgggtgaggaacccggagggaccgcctccgggcggagcccgccgaccatggctacgcccctggtggcgggtcccgcagctctacgcttcgccgccgcggctagctggcaggttgtgcgcggacgctgcgtggaacattttccgcgagtactggagtttctgcgatctctgcgcgctgttgcccctggcttggttcgctaccggcaccacgaacgcctttgtatgggcctaaaggccaaggtggtggtggagctgatcctgcagggccggccttgggcccaagtcctgaaagccctgaatcaccactttccagaatctggacctatagtgcgggatcccaaggctacaaagcaggatctgaggaagattttggaggcacaggaaactttttaccagcaggtgaagcagctgtcagaggctcctgtggatttggcctcgaagctgcaggaacttgaacaagagtatggggaaccctttctggctgccatggaaaagctgctttttgagtacttgtgtcagctggagaaagcactgcctacaccgcaggcacagcagcttcaggatgtgctgagttggatgcagcctggagtctctatcacctcttctcttgcctggagacaatatggtgtggacatggggtggctgcttccagagtgctctgttactgactcagtgaacctggctgagcccatggaacagaatcctcctcagcaacaaagactagcactccacaatcccctgccaaaagccaagcctggcacacatcttcctcagggaccatcttcaaggacgcacccagaacctctagctggccgacacttcaatctggcccctctaggccgacgaagagttcagtcccaatgggcctccactaggggaggccataaggagcgccccacagtcatgctgtttccctttaggaatctcggctcaccaacccaggtcatatctaagcctgagagcaaggaagaacatgcgatatacacagcagacctagccatgggcacaagagcagcctccactgggaagtctaagagtccatgccagaccctggggggaagggctctgaaggagaacccagttgacttgcctgccacagagcaaaaggatcaggaattgcttggattgctacatggaccccctgagactatcattattacctcctagggccaggaagccatgtgtcctccgtctctgtgcagctccgtcattaccataggggacttggttttagactctgatgaggaagaaaatggccagggggaaggaaaggtgagtgggaaggagcagaaagctgggaaaggggatgggtagaacaagactgagaaatccacatgcttcagaattcagagggttcagggaatggtttcggatagtaggctctccctgctcccttctctacaggaatctctggaaaactatcagaagacaaagtttgacaccttgatacccactctctgtgaatacctacccccttctggccacggtgccatacctgtttcttcctgtgactgtagagacagttctagacctttgtgatagaactaaaatgctctctgtactctagtctcctgcctcctcagctctgcaagtagtttagtaggaatgaagtggaagtccaggcttggattgcctaactacactgctaaaaatatttgtaatccttaataattaaactttggatttgttaaaa

SEQ ID NO: 456488 - DNA, 2613 bp, Homo sapiens
ccggggcaagggaagctagtagcggagccggaagtgaggcaccctcgggctcgagacagcggcgacgtttaaagctgagcgacccagtgccactggagacggtcagcttctccactcaggctcctccagcccgagccagaagaccccctcccccagaattctgggggccgatggaagggagccgagtcagatcgcgaggtacccagagccgacagaccggagcgacagggagttgccagaagccccgcccctaggagtgatcggaaagcctcacccatccgggtgaggaacccggagggaccgcctccgggcggagcccgccgaccatggctacgcccctggtggcgggtcccgcagctctacgcttcgccgccgcggctagctggcaggttgtgcgcggacgctgcgtggaacattttccgcgagtactggagtttctgcgatctctgcgcgctgttgcccctggcttggttcgctaccggcaccacgaacgcctttgtatgggcctaaaggccaaggtggtggtggagctgatcctgcagggccggccttgggcccaagtcctgaaagccctgaatcaccactttccagaatctggacctatagtgcgggatcccaaggctacaaagcaggatctgaggaagattttggaggcacaggaaactttttaccagcaggtgaagcagctgtcagaggctcctgtggatttggcctcgaagctgcaggtgagactggtttgaaggctattatgtggctattttctctaacccatttttttttttttttgaggaatcttgctctgtcgcccaggctggagtgcagtggcacaatctcggctcactgcaacctctgcctcccgggttcaagcgattctcctgcctcagcctcccgagtagctgggattacaaatgcccagctaatttttgtattttagtagagatggggtttcaccatgttggccaggctggtctcgaactcctgacctcaagtgatccgcccacctcggcctcccaaatggccaggattacaggcgtgagccaccgtgcctggccactaacccacttttgacctaatctcccctgctgtaggaacttgaacaagagtatggggaaccctttctggctgccatggaaaagctgctttttgagtacttgtgtcagctggagaaagcactgcctacaccgcaggcacagcaggtttcgctggggcaaaacatgtaagggcagagtgtggggtggctgtttcaaggattgtggtcttcatacctctgtccctgcccacagcttcaggatgtgctgagttggatgcagcctggagtctctatcacctcttctcttgcctggagacaatatggtgtggacatggggtggctgcttccagagtgctctgttactgactcagtgaacctggctgagcccatggaacagaatcctcctcagcaacaaagactagcactccacaatcccctgccaaaagccaagcctggcacacatcttcctcagggaccatcttcaaggacgcacccagaacctctagctggccgacacttcaatctggcccctctaggccgacgaagagttcagtcccaatgggcctccactaggggaggccataaggagcgccccacagtcatgctgtttccctttaggaatctcggctcaccaacccaggtcatatctaagcctgagagcaaggaagaacatgcgatatacacagcagacctagccatgggcacaagagcagcctccactgggaagtctaagagtccatgccagaccctggggggaagggctctgaaggagaacccagttgacttgcctgccacagagcaaaaggagtgagtggaacagagttgcttcttactaggagcacattctttgcctgccttcccttcatcctatcctctttgcttgctctcacctcaggaattgcttggattgctacatggaccccctgagactatcattattacctcctagggccaggaagccaggtaggtagtctgagtcaggattggatcaacagcctcctctcttggggactctcaagagcctgtgttcatctagaagtagtagtttgattctggtttccctcctacagtgtgtcctccgtctctgtgcagctccgtcattaccataggggacttggttttagactctgatgaggaagaaaatggccagggggaaggaaaggtgagtgggaaggagcagaaagctgggaaaggggatgggtagaacaagactgagaaatccacatgcttcagaattcagagggttcagggaatggtttcggatagtaggctctccctgctcccttctctacaggaatctctggaaaactatcagaagacaaagtttgacaccttgatacccactctctgtgaatacctacccccttctggccacggtgccatacctgtttcttcctgtgactgtagagacagttctagacctttgtgatagaactaaaatgctctctgtactctagtctcctgcctcctcagctctgcaagtagtttagtaggaatgaagtggaagtccaggcttggattgcctaactacactgctaaaaatatttgtaatccttaataattaaactttggatttgttaaaa

SEQ ID NO: 456489 - DNA, 1923 bp, Homo sapiens
ccggggcaagggaagctagtagcggagccggaagtgaggcaccctcgggctcgagacagcggcgacgtttaaagctgagcgacccagtgccactggagacggtcagcttctccactcaggctcctccagcccgagccagaagaccccctcccccagaattctgggggccgatggaagggagccgagtcagatcgcgaggtacccagagccgacagaccggagcgacagggagttgccagaagccccgcccctaggagtgatcggaaagcctcacccatccgggtgaggaacccggagggaccgcctccgggcggagcccgccgaccatggctacgcccctggtggcgggtcccgcagctctacgcttcgccgccgcggctagctggcaggttgtgcgcggacgctgcgtggaacattttccgcgagtactggagtttctgcgatctctgcgcgctgttgcccctggcttggttcgctaccggcaccacgaacgcctttgtatgggcctaaaggccaaggtggtggtggagctgatcctgcagggccggccttgggcccaagtcctgaaagccctgaatcaccactttccagaatctggacctatagtgcgggatcccaaggctacaaagcaggatctgaggaagattttggaggcacaggaaactttttaccagcaggtgaagcagctgtcagaggctcctgtggatttggcctcgaagctgcaggaacttgaacaagagtatggggaaccctttctggctgccatggaaaagctgctttttgagtacttgtgtcagctggagaaagcactgcctacaccgcaggcacagcagcttcaggatgtgctgagttggatgcagcctggagtctctatcacctcttctcttgcctggagacaatatggtgtggacatggggtggctgcttccagagtgctctgttactgactcagtgaacctggctgagcccatggaacagaatcctcctcagcaacaaagactagcactccacaatcccctgccaaaagccaagcctggcacacatcttcctcagggaccatcttcaaggacgcacccagaacctctagctggccgacacttcaatctggcccctctaggccgacgaagagttcagtcccaatgggcctccactaggggaggccataaggagcgccccacagtcatgctgtttccctttaggaatctcggctcaccaacccaggtcatatctaagcctgagagcaaggaagaacatgcgatatacacagcagacctagccatgggcacaagagcagcctccactgggaagtctaagagtccatgccagaccctggggggaagggctctgaaggagaacccagttgacttgcctgccacagagcaaaaggagtgagtggaacagagttgcttcttactaggagcacattctttgcctgccttcccttcatcctatcctctttgcttgctctcacctcaggaattgcttggattgctacatggaccccctgagactatcattattacctcctagggccaggaagccatgtgtcctccgtctctgtgcagctccgtcattaccataggggacttggttttagactctgatgaggaagaaaatggccagggggaaggaaaggaatctctggaaaactatcagaagacaaagtttgacaccttgatacccactctctgtgaatacctacccccttctggccacggtgccatacctgtttcttcctgtgactgtagagacagttctagacctttgtgatagaactaaaatgctctctgtactctagtctcctgcctcctcagctctgcaagtagtttagtaggaatgaagtggaagtccaggcttggattgcctaactacactgctaaaaatatttgtaatccttaataattaaactttggatttgttaaaa

SEQ ID NO: 456490 - DNA, 1751 bp, Homo sapiens
ccggggcaagggaagctagtagcggagccggaagtgaggcaccctcgggctcgagacagcggcgacgtttaaagctgagcgacccagtgccactggagacggtcagcttctccactcaggctcctccagcccgagccagaagaccccctcccccagaattctgggggccgatggaagggagccgagtcagatcgcgaggtacccagagccgacagaccggagcgacagggagttgccagaagccccgcccctaggagtgatcggaaagcctcacccatccgggtgaggaacccggagggaccgcctccgggcggagcccgccgaccatggctacgcccctggtggcgggtcccgcagctctacgcttcgccgccgcggctagctggcaggttgtgcgcggacgctgcgtggaacattttccgcgagtactggagtttctgcgatctctgcgcgctgttgcccctggcttggttcgctaccggcaccacgaacgcctttgtatgggcctaaaggccaagagtgctctgttactgactcagtgaacctggctgagcccatggaacagaatcctcctcagcaacaaagactagcactccacaatcccctgccaaaagccaagcctggcacacatcttcctcagggaccatcttcaaggacgcacccagaacctctagctggccgacacttcaatctggcccctctaggccgacgaagagttcagtcccaatgggcctccactaggggaggccataaggagcgccccacagtcatgctgtttccctttaggaatctcggctcaccaacccaggtcatatctaagcctgagagcaaggaagaacatgcgatatacacagcagacctagccatgggcacaagagcagcctccactgggaagtctaagagtccatgccagaccctggggggaagggctctgaaggagaacccagttgacttgcctgccacagagcaaaaggagtgagtggaacagagttgcttcttactaggagcacattctttgcctgccttcccttcatcctatcctctttgcttgctctcacctcaggaattgcttggattgctacatggaccccctgagactatcattattacctcctagggccaggaagccaggtaggtagtctgagtcaggattggatcaacagcctcctctcttggggactctcaagagcctgtgttcatctagaagtagtagtttgattctggtttccctcctacagtgtgtcctccgtctctgtgcagctccgtcattaccataggggacttggttttagactctgatgaggaagaaaatggccagggggaaggaaaggtgagtgggaaggagcagaaagctgggaaaggggatgggtagaacaagactgagaaatccacatgcttcagaattcagagggttcagggaatggtttcggatagtaggctctccctgctcccttctctacaggaatctctggaaaactatcagaagacaaagtttgacaccttgatacccactctctgtgaatacctacccccttctggccacggtgccatacctgtttcttcctgtgactgtagagacagttctagacctttgtgatagaactaaaatgctctctgtactctagtctcctgcctcctcagctctgcaagtagtttagtaggaatgaagtggaagtccaggcttggattgcctaactacactgctaaaaatatttgtaatccttaataattaaactttggatttgttaaaa

SEQ ID NO: 456491 - DNA, 2060 bp, Homo sapiens
ccggggcaagggaagctagtagcggagccggaagtgaggcaccctcgggctcgagacagcggcgacgtttaaagctgagcgacccagtgccactggagacggtcagcttctccactcaggctcctccagcccgagccagaagaccccctcccccagaattctgggggccgatggaagggagccgagtcagatcgcgaggtacccagagccgacagaccggagcgacagggagttgccagaagccccgcccctaggagtgatcggaaagcctcacccatccgggtgaggaacccggagggaccgcctccgggcggagcccgccgaccatggctacgcccctggtggcgggtcccgcagctctacgcttcgccgccgcggctagctggcaggttgtgcgcggacgctgcgtggaacattttccgcgagtactggagtttctgcgatctctgcgcgctgttgcccctggcttggttcgctaccggcaccacgaacgcctttgtatgggcctaaaggccaaggtggtggtggagctgatcctgcagggccggccttgggcccaagtcctgaaagccctgaatcaccactttccagaatctggacggaggcacaggaaactttttaccagcaggtgaagcagctgtcagaggctcctgtggatttggcctcgaagctgcaggaacttgaacaagagtatggggaaccctttctggctgccatggaaaagctgctttttgagtacttgtgtcagctggagaaagcactgcctacaccgcaggcacagcagcttcaggatgtgctgagttggatgcagcctggagtctctatcacctcttctcttgcctggagacaatatggtgtggacatggggtggctgcttccagagtgctctgttactgactcagtgaacctggctgagcccatggaacagaatcctcctcagcaacaaagactagcactccacaatcccctgccagaacctctagctggccgacacttcaatctggcccctctaggccgacgaagagttcagtcccaatgggcctccactaggggaggccataaggagcgccccacagtcatgctgtttccctttaggaatctcggctcaccaacccaggtcatatctaagcctgagagcaaggaagaacatgcgatatacacagcagacctagccatgggcacaagagcagcctccactgggaagtctaagagtccatgccagaccctggggggaagggctctgaaggagaacccagttgacttgcctgccacagagcaaaaggagtgagtggaacagagttgcttcttactaggagcacattctttgcctgccttcccttcatcctatcctctttgcttgctctcacctcaggaattgcttggattgctacatggaccccctgagactatcattattacctcctagggccaggaagccaggtaggtagtctgagtcaggattggatcaacagcctcctctcttggggactctcaagagcctgtgttcatctagaagtagtagtttgattctggtttccctcctacagtgtgtcctccgtctctgtgcagctccgtcattaccataggggacttggttttagactctgatgaggaagaaaatggccagggggaaggaaaggtgagtgggaaggagcagaaagctgggaaaggggatgggtagaacaagactgagaaatccacatgcttcagaattcagagggttcagggaatggtttcggatagtaggctctccctgctcccttctctacaggaatctctggaaaactatcagaagacaaagtttgacaccttgatacccactctctgtgaatacctacccccttctggccacggtgccatacctgtttcttcctgtgactgtagagacagttctagacctttgtgatagaactaaaatgctctctgtactctagtctcctgcctcctcagctctgcaagtagtttagtaggaatgaagtggaagtccaggcttggattgcctaactacactgctaaaaatatttgtaatccttaataattaaactttggatttgttaaaa

SEQ ID NO: 456492 - DNA, 1506 bp, Homo sapiens
ggctagtacgaggctggtttgaatcggccgaggcagaggctcctgtggatttggcctcgaagctgcaggaacttgaacaagagtatggggaaccctttctggctgccatggaaaagctgctttttgagtacttgtgtcagctggagaaagcactgcctacaccgcaggcacagcagcttcaggatgtgctgagttggatgcagcctggagtctctatcacctcttctcttgcctggagacaatatggtgtggacatggggtggctgcttccagagtgctctgttactgactcagtgaacctggctgagcccatggaacagaatcctcctcagcaacaaagactagcactccacaatcccctgccaaaagccaagcctggcacacatcttcctcagggaccatcttcaaggacgcacccagaacctctagctggccgacacttcaatctggcccctctaggccgacgaagagttcagtcccaatgggcctccactaggggaggccataaggagcgccccacagtcatgctgtttccctttaggaatctcggctcaccaacccaggtcatatctaagcctgagagcaaggaagaacatgcgatatacacagcagacctagccatgggcacaagagcagcctccactgggaagtctaagagtccatgccagaccctggggggaagggctctgaaggagaacccagttgacttgcctgccacagagcaaaaggagtgagtggaacagagttgcttcttactaggagcacattctttgcctgccttcccttcatcctatcctctttgcttgctctcacctcaggaattgcttggattgctacatggaccccctgagactatcattattacctcctagggccaggaagccaggtaggtagtctgagtcaggattggatcaacagcctcctctcttggggactctcaagagcctgtgttcatctagaagtagtagtttgattctggtttccctcctacagtgtgtcctccgtctctgtgcagctccgtcattaccataggggacttggttttagactctgatgaggaagaaaatggccagggggaaggaaaggtgagtgggaaggagcagaaagctgggaaaggggatgggtagaacaagactgagaaatccacatgcttcagaattcagagggttcagggaatggtttcggatagtaggctctccctgctcccttctctacaggaatctctggaaaactatcagaagacaaagtttgacaccttgatacccactctctgtgaatacctacccccttctggccacggtgccatacctgtttcttcctgtgactgtagagacagttctagacctttgtgatagaactaaaatgctctctgtactctagtctcctgcctcctcagctctgcaagtagtttagtaggaatgaagtggaagtccaggcttggattgcctaactacactgctaaaaatatttgtaatccttaataattaaactttggatttgttaaaa

SEQ ID NO: 456493 - DNA, 1639 bp, Homo sapiens
ccggggcaagggaagctagtagcggagccggaagtgaggcaccctcgggctcgagacagcggcgacgtttaaagctgagcgacccagtgccactggagacggtcagcttctccactcaggctcctccagcccgagccagaagaccccctcccccagaattctgggggccgatggaagggagccgagtcagatcgcgaggtacccagagccgacagaccggagcgacagggagttgccagaagccccgcccctaggagtgatcggaaagcctcacccatccgggtgaggaacccggagggaccgcctccgggcggagcccgccgaccatggctacgcccctggtggcgggtcccgcagctctacgcttcgccgccgcggctagctggcaggttgtgcgcggacgctgcgtggaacattttccgcgagtactggagtttctgcgatctctgcgcgctgttgcccctggcttggttcgctaccggcaccacgaacgcctttgtatgggcctaaaggccaaggtggtggtggagctgatcctgcagggccggccttgggcccaagtcctgaaagccctgaatcaccactttccagaatctggacctatagtgcgggatcccaaggctacaaagcaggatctgaggaagattttggaggcacaggaaactttttaccagcaggtgaagcagctgtcagaggctcctgtggatttggcctcgaagctgcaggaacttgaacaagagtatggggaaccctttctggctgccatggaaaagctgctttttgagtacttgtgtcagctggagaaagcactgcctacaccgcaggcacagcagcttcaggatgtgctgagttggatgcagcctggagtctctatcacctcttctcttgcctggagacaatatggtgtggacatggggtggctgcttccagagtgctctgttactgactcagtgaacctggctgagcccatggaacagaatcctcctcagcaacaaagactagcactccacaatcccctgccaaaagccaagcctggcacacatcttcctcagggaccatcttcaaggacgcacccagaacctctagctggccgacacttcaatctggcccctctaggccgacgaagagttcagtcccaatgggcctccactaggggaggccataaggagcgccccacagtcatgctgtttccctttaggaatctcggctcaccaacccaggtcatatctaagcctgagagcaaggaagaacatgcgatatacacagcagacctagccatgggcacaagagcagcctccactgggaagtctaagagtccatgccagaccctggggggaagggctctgaaggagaacccagttgacttgcctgccacagagcaaaaggagtgagtggaacagagttgcttcttactaggagcacattctttgcctgccttcccttcatcctatcctctttgcttgctctcacctcaggaattgcttggattgctacatggaccccctgagactatcattattacctcctagggccaggaagccatatgggtcagccagtagtgggtcagccagtagtgggtcagccagtagtgggtcagccagtagtgggtcagccagtagtgggtcagccagtagtgagt

SEQ ID NO: 456494 - DNA, 2060 bp, Homo sapiens
ccggggcaagggaagctagtagcggagccggaagtgaggcaccctcgggctcgagacagcggcgacgtttaaagctgagcgacccagtgccactggagacggtcagcttctccactcaggctcctccagcccgagccagaagaccccctcccccagaattctgggggccgatggaagggagccgagtcagatcgcgaggtacccagagccgacagaccggagcgacagggagttgccagaagccccgcccctaggagtgatcggaaagcctcacccatccgggtgaggaacccggagggaccgcctccgggcggagcccgccgaccatggctacgcccctggtggcgggtcccgcagctctacgcttcgccgccgcggctagctggcaggttgtgcgcggacgctgcgtggaacattttccgcgagtactggagtttctgcgatctctgcgcgctgttgcccctggcttggttcgctaccggcaccacgaacgcctttgtatgggcctaaaggccaaggtggtggtggagctgatcctgcagggccggccttgggcccaagtcctgaaagccctgaatcaccactttccagaatctggacctatagtgcgggatcccaaggctacaaagcaggatctgaggaagattttggaggcacaggaaactttttaccagcaggtgaagcagctgtcagaggctcctgtggatttggcctcgaagctgcaggaacttgaacaagagtatggggaaccctttctggctgccatggaaaagctgctttttgagtacttgtgtcagctggagaaagcactgcctacaccgcaggcacagcagcttcaggatgtgctgagttggatgcagcctggagtctctatcacctcttctcttgcctggagacaatatggtgtggacatggggtggctgcttccagagtgctctgttactgactcagtgaacctggctgagcccatggaacagaatcctcctcagcaacaaagactagcactccacaatcccctgccaaaagccaagcctggcacacatcttcctcagggaccatcttcaaggacgcacccagaacctctagctggccgacacttcaatctggcccctctaggccgacgaagagttcagtcccaatgggcctccactaggggaggccataaggagcgccccacagtcatgctgtttccctttaggaatctcggctcaccaacccaggtcatatctaagcctgagagcaaggaagaacatgcgatatacacagcagacctagccatgggcacaagagcagcctccactgggaagtctaagagtccatgccagaccctggggggaagggctctgaaggagaacccagttgacttgctcaggaattgcttggattgctacatggaccccctgagactatcattattacctcctagggccaggaagccaggtaggtagtctgagtcaggattggatcaacagcctcctctcttggggactctcaagagcctgtgttcatctagaagtagtagtttgattctggtttccctcctacagtgtgtcctccgtctctgtgcagctccgtcattaccataggggacttggttttagactctgatgaggaagaaaatggccagggggaaggaaaggtgagtgggaaggagcagaaagctgggaaaggggatgggtagaacaagactgagaaatccacatgcttcagaattcagagggttcagggaatggtttcggatagtaggctctccctgctcccttctctacaggaatctctggaaaactatcagaagacaaagtttgacaccttgatacccactctctgtgaatacctacccccttctggccacggtgccatacctgtttcttcctgtgactgtagagacagttctagacctttgtgatagaactaaaatgctctctgtactctagtctcctgcctcctcagctctgcaagtagtttagtaggaatgaagtggaagtccaggcttggattgcctaactacactgctaaaaatatttgtaatccttaataattaaactttggatttgttaaaa

SEQ ID NO: 456495 - DNA, 2198 bp, Homo sapiens
ccggggcaagggaagctagtagcggagccggaagtgaggcaccctcgggctcgagacagcggcgacgtttaaagctgagcgacccagtgccactggagacggtcagcttctccactcaggctcctccagcccgagccagaagaccccctcccccagaattctgggggccgatggaagggagccgagtcagatcgcgaggtacccagagccgacagaccggagcgacagggagttgccagaagccccgcccctaggagtgatcggaaagcctcacccatccgggtgaggaacccggagggaccgcctccgggcggagcccgccgaccatggctacgcccctggtggcgggtcccgcagctctacgcttcgccgccgcggctagctggcaggttgtgcgcggacgctgcgtggaacattttccgcgagtactggagtttctgcgatctctgcgcgctgttgcccctggcttggttcgctaccggcaccacgaacgcctttgtatgggcctaaaggccaaggtggtggtggagctgatcctgcagggccggccttgggcccaagtcctgaaagccctgaatcaccactttccagaatctggacctatagtgcgggatcccaaggctacaaagcaggatctgaggaagattttggaggcacaggaaactttttaccagcaggtgaagcagctgtcagaggctcctgtggatttggcctcgaagctgcaggaacttgaacaagagtatggggaaccctttctggctgccatggaaaagctgctttttgagtacttgtgtcagctggagaaagcactgcctacaccgcaggcacagcagcttcaggatgtgctgagttggatgcagcctggagtctctatcacctcttctcttgcctggagacaatatggtgtggacatggggtggctgcttccagagtgctctgttactgactcagtgaacctggctgagcccatggaacagaatcctcctcagcaacaaagactagcactccacaatcccctgccaaaagccaagcctggcacacatcttcctcagggaccatcttcaaggacgcacccagaacctctagctggccgacacttcaatctggcccctctaggccgacgaagagttcagtcccaatgggcctccactaggggaggccataaggagcgccccacagtcatgctgtttccctttaggaatctcggctcaccaacccaggtcatatctaagcctgagagcaaggaagaacatgcgatatacacagcagacctagccatgggcacaagagcagcctccactgggaagtctaagagtccatgccagaccctggggggaagggctctgaaggagaacccagttgacttgcctgccacagagcaaaaggagtgagtggaacagagttgcttcttactaggagcacattctttgcctgccttcccttcatcctatcctctttgcttgctctcacctcaggaattgcttggattgctacatggaccccctgagactatcattattacctcctagggccaggaagccaggtaggtagtctgagtcaggattggatcaacagcctcctctcttggggactctcaagagcctgtgttcatctagaagtagtagtttgattctggtttccctcctacagtgtgtcctccgtctctgtgcagctccgtcattaccataggggacttggttttagactctgatgaggaagaaaatggccagggggaaggaaaggtgagtgggaaggagcagaaagctgggaaaggggatgggtagaacaagactgagaaatccacatgcttcagaattcagagggttcagggaatggtttcggatagtaggctctccctgctcccttctctacaggaatctctggaaaactatcagaagacaaagtttgacaccttgatacccactctctgtgaatacctacccccttctggccacggtgccatacctgtttcttcctgtgactgtagagacagttctagacctttgtgatagaactaaaatgctctctgtactctagtctcctgcctcctcagctctgcaagtagtttagtaggaatgaagtggaagtccaggcttggattgcctaactacactgctaaaaatatttgtaatccttaataattaaactttggatttgttaaaaaaaaaaaacgaacacgacaaacaaaaaaaacttgt

SEQ ID NO: 456496 - DNA, 1839 bp, Homo sapiens
ccggggcaagggaagctagtagcggagccggaagtgaggcaccctcgggctcgagacagcggcgacgtttaaagctgagcgacccagtgccactggagacggtcagcttctccactcaggctcctccagcccgagccagaagaccccctcccccagaattctgggggccgatggaagggagccgagtcagatcgcgaggtacccagagccgacagaccggagcgacagggagttgccagaagccccgcccctaggagtgatcggaaagcctcacccatccgggtgaggaacccggagggaccgcctccgggcggagcccgccgaccatggctacgcccctggtggcgggtcccgcagctctacgcttcgccgccgcggctagctggcaggttgtgcgcggacgctgcgtggaacattttccgcgagtactggagtttctgcgatctctgcgcgctgttgcccctggcttggttcgctaccggcaccacgaacgcctttgtatgggcctaaaggccaaggtggtggtggagctgatcctgcagggccggccttgggcccaagtcctgaaagccctgaatcaccactttccagaatctggacctatagtgcgggatcccaaggctacaaagcaggatctgaggaagattttggaggcacaggaaactttttaccagcaggtgaagcagctgtcagaggctcctgtggatttggcctcgaagctgcaggaacttgaacaagagtatggggaaccctttctggctgccatggaaaagctgctttttgagtacttgtgtcagctggagaaagcactgcctacaccgcaggcacagcagcttcaggatgtgctgagttggatgcagcctggagtctctatcacctcttctcttgcctggagacaatatggtgtggacatggggtggctgcttccagagtgctctgttactgactcagtgaacctggctgagcccatggaacagaatcctcctcagcaacaaagactagcactccacaatcccctgccaaaagccaagcctggcacacatcttcctcagggaccatcttcaaggacgcacccagaacctctagctggccgacacttcaatctggcccctctaggccgacgaagagttcagtcccaatgggcctccactaggggaggccataaggagcgccccacagtcatgctgtttccctttaggaatctcggctcaccaacccaggtcatatctaagcctgagagcaaggaagaacatgcgatatacacagcagacctagccatgggcacaagagcagcctccactgggaagtctaagagtccatgccagaccctggggggaagggctctgaaggagaacccagttgacttgcctgccacagagcaaaaggatcaggaattgcttggattgctacatggaccccctgagactatcattattacctcctagggccaggaagccatgtgtcctccgtctctgtgcagctccgtcattaccataggggacttggttttagactctgatgaggaagaaaatggccagggggaaggaaaggaatctctggaaaactatcagaagacaaagtttgacaccttgatacccactctctgtgaatacctacccccttctggccacggtgccatacctgtttcttcctgtgactgtagagacagttctagacctttgtgatagaactaaaatgctctctgtactctagtctcctgcctcctcagctctgcaagtagtttagtaggaatgaagtggaagtccaggcttggattgcctaactacactgctaaaaatatttgtaatccttaataattaaactttggatttgttaaaa

SEQ ID NO: 456497 - DNA, 1832 bp, Homo sapiens
cagcttggggatgagactagttggaaaaggtcagcttgccccgaagtggggattctgaattcagtaccgtacaggtggtggtggagctgatcctgcagggccggccttgggcccaagtcctgaaagccctgaatcaccactttccagaatctggacctatagtgcgggatcccaaggctgtgagtaatccccggaacaagccctgaccccagttacacttggtgcagcaaagttgctcctcctgtctactggatgttggtgctaacttctctgtcttctgtatcctcaacagacaaagcaggatctgaggaagattttggaggcacaggaaactttttaccagcaggtgaagcagctgtcagaggctcctgtggatttggcctcgaagctgcaggaacttgaacaagagtatggggaaccctttctggctgccatggaaaagctgctttttgagtacttgtgtcagctggagaaagcactgcctacaccgcaggcacagcagcttcaggatgtgctgagttggatgcagcctggagtctctatcacctcttctcttgcctggagacaatatggtgtggacatggggtggctgcttccagagtgctctgttactgactcagtgaacctggctgagcccatggaacagaatcctcctcagcaacaaagactagcactccacaatcccctgccaaaagccaagcctggcacacatcttcctcagggaccatcttcaaggacgcacccagaacctctagctggccgacacttcaatctggcccctctaggccgacgaagagttcagtcccaatgggcctccactaggggaggccataaggagcgccccacagtcatgctgtttccctttaggaatctcggctcaccaacccaggtcatatctaagcctgagagcaaggaagaacatgcgatatacacagcagacctagccatgggcacaagagcagcctccactgggaagtctaagagtccatgccagaccctggggggaagggctctgaaggagaacccagttgacttgcctgccacagagcaaaaggagtgagtggaacagagttgcttcttactaggagcacattctttgcctgccttcccttcatcctatcctctttgcttgctctcacctcaggaattgcttggattgctacatggaccccctgagactatcattattacctcctagggccaggaagccaggtaggtagtctgagtcaggattggatcaacagcctcctctcttggggactctcaagagcctgtgttcatctagaagtagtagtttgattctggtttccctcctacagtgtgtcctccgtctctgtgcagctccgtcattaccataggggacttggttttagactctgatgaggaagaaaatggccagggggaaggaaaggtgagtgggaaggagcagaaagctgggaaaggggatgggtagaacaagactgagaaatccacatgcttcagaattcagagggttcagggaatggtttcggatagtaggctctccctgctcccttctctacaggaatctctggaaaactatcagaagacaaagtttgacaccttgatacccactctctgtgaatacctacccccttctggccacggtgccatacctgtttcttcctgtgactgtagagacagttctagacctttgtgatagaactaaaatgctctctgtactctagtctcctgcctcctcagctctgcaagtagtttagtaggaatgaagtggaagtccaggcttggattgcctaactacactgctaaaaatatttgtaatccttaataattaaactttggatttgttaaaa

SEQ ID NO: 456498 - DNA, 1678 bp, Homo sapiens
ccggggcaagggaagctagtagcggagccggaagtgaggcaccctcgggctcgagacagcggcgacgtttaaagctgagcgacccagtgccactggagacggtcagcttctccactcaggctcctccagcccgagccagaagaccccctcccccagaattctgggggccgatggaagggagccgagtcagatcgcgaggtacccagagccgacagaccggagcgacagggagttgccagaagccccgcccctaggagtgatcggaaagcctcacccatccgggtgaggaacccggagggaccgcctccgggcggagcccgccgaccatggctacgcccctggtggcgggtcccgcagctctacgcttcgccgccgcggctagctggcaggttgtgcgcggacgctgcgtggaacattttccgcgagtactggagtttctgcgatctctgcgcgctgttgcccctggcttggttcgctaccggcaccacgaacgcctttgtatgggcctaaaggccaaggtggtggtggagctgatcctgcagggccggccttgggcccaagtcctgaaagccctgaatcaccactttccagaatctggacctatagtgcgggatcccaaggctacaaagcaggatctgaggaagattttggaggcacaggaaactttttaccagcaggtgaagcagctgtcagaggctcctgtggatttggcctcgaagctgcaggaacttgaacaagagtatggggaaccctttctggctgccatggaaaagctgctttttgagtacttgtgtcagctggagaaagcactgcctacaccgcaggcacagcagcttcaggatgtgctgagttggatgcagcctggagtctctatcacctcttctcttgcctggagacaatatggtgtggacatggggtggctgcttccagagtgctctgttactgactcagtgaacctggctgagcccatggaacagaatcctcctcagcaacaaagactagcactccacaatcccctgccaaaagccaagcctggcacacatcttcctcagggaccatcttcaaggacgcacccagaacctctagctggccgacacttcaatctggcccctctaggccgacgaagagttcagtcccaatgggcctccactaggggaggccataaggagcgccccacagtcatgctgtttccctttaggaatctcggctcaccaacccaggtcatatctaagcctgagagcaaggaagaacatgcgatatacacagcagacctagccatgggcacaagagcagcctccactgggaagtctaagagtccatgccagaccctggggggaagggctctgaaggagaacccagttgacttgcctgccacagagcaaaaggagtgagtggaacagagttgcttcttactaggagcacattctttgcctgccttcccttcatcctatcctctttgcttgctctcacctcaggaattgcttggattgctacatggaccccctgagactatcattattacctcctagggccaggaagccaggtaggtagtctgagtcaggattggatcaacagcctcctctcttggggactctcaagagcctgtgttcctggtttgagtaagttaatgtcctgatatttcttgtgcaggggtgggtggagaacgggggtcctctag

SEQ ID NO: 456499 - DNA, 1716 bp, Homo sapiens
ccggggcaagggaagctagtagcggagccggaagtgaggcaccctcgggctcgagacagcggcgacgtttaaagctgagcgacccagtgccactggagacggtcagcttctccactcaggctcctccagcccgagccagaagaccccctcccccagaattctgggggccgatggaagggagccgagtcagatcgcgaggtacccagagccgacagaccggagcgacagggagttgccagaagccccgcccctaggagtgatcggaaagcctcacccatccgggtgaggaacccggagggaccgcctccgggcggagcccgccgaccatggctacgcccctggtggcgggtcccgcagctctacgcttcgccgccgcggctagctggcaggttgtgcgcggacgctgcgtggaacattttccgcgagtactggagtttctgcgatctctgcgcgctgttgcccctggcttggttcgctaccggcaccacgaacgcctttgtatgggcctaaaggccaaggtggtggtggagctgatcctgcagggccggccttgggcccaagtcctgaaagccctgaatcaccactttccagaatctggacctatagtgcgggatcccaaggctacaaagcaggatctgaggaagattttggaggcacaggaaactttttaccagcaggtgaagcagctgtcagaggctcctgtggatttggcctcgaagctgcaggaacttgaacaagagtatggggaaccctttctggctgccatggaaaagctgctttttgagtacttgtgtcagctggagaaagcactgcctacaccgcaggcacagcagcttcaggatgtgctgagttggatgcagcctggagtctctatcacctcttctcttgcctggagacaatatggtgtggacatggggtggctgcttccagagtgctctgttactgactcagtgaacctggctgagcccatggaacagaatcctcctcagcaacaaagactagcactccacaatcccctgccaaaagccaagcctggcacacatcttcctcagggaccatcttcaaggacgcacccagaacctctagctggccgacacttcaatctggcccctctaggccgacgaagagttcagtcccaatgggcctccactaggggaggccataaggagcgccccacagtcatgctgtttccctttaggaatctcggctcaccaacccaggtcatatctaagcctgagagcaaggaagaacatgcgatatacacagcagacctagccatgggcacaagagcagcctccactgggaagtctaagagtccatgccagaccctggggggaagggctctgaaggagaacccagttgacttgcctgccacagagcaaaaggagtgagtggaacagagttgcttcttactaggagcacattctttgcctgccttcccttcatcctatcctctttgcttgctctcacctcaggaattgcttggattgctacatggaccccctgagactatcattattacctcctagggccaggaagccaacagttctagacctttgtgatagaactaaaatgctctctgtactctagtctcctgcctcctcagctctgcaagtagtttagtaggaatgaagtggaagtccaggcttggattgcctaactacactgctaaaaatatttgtaatccttaataattaaactttggatttgttaaaa

SEQ ID NO: 456500 - DNA, 4524 bp, Homo sapiens
cctggtcgtcctccttgggttcgggtgaaagcgcctgggggttcagtgggccatgatccccgagctgctggagaactgaaggcggacagtctcctgcgaaaccaggcaatggcggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccgcccaccatctcgctgtcagacggggaggagcccccaccctaccagggcccctgcaccctccagcttcgggaccccgagcagcagctggaactgaaccgggagtcggtgcgcgcacccccaaacagaaccatcttcgacagtgacctgatggatagtgccaggctgggcggcccctgcccccccagcagtaactcgggcatcagcgccacgtgctacggcagcggcgggcgcatggaggggccgccgcccacctacagcgaggtcatcggccactacccggggtcctccttccagcaccagcagagcagtgggccgccctccttgctggaggggacccggctccaccacacacacatcgcgcccctagagagcgcagccatctggagcaaagagaaggataaacagaaaggacaccctctctagggtccccaggggggccgggctggggctgcgtaggtgaaaaggcagaacactccgcgcttcttagaagaggagtgagaggaaggcggggggcgcagcaacgcatcgtgtggccctcccctcccacctccctgtgtataaatatttacatgtgatgtctggtctgaatgcacaagctaagagagcttgcaaaaaaaaaaagaaaaaagaaaaaaaaaaaccacgtttctttgttgagctgtgtcttgaaggcaaaagaaaaaaaatttctacagtagtctttcttgtttctagttgagctgcgtgcgtgaatgcttattttcttttgtttatgataatttcacttaactttaaagacatatttgcacaaaacctttgtttaaagatctgcaatattatatatataaatatatataagataagagaaactgtatgtgcgagggcaggagtatttttgtattagaagaggcctattaaaaaaaaaagttgttttctgaactagaagaggaaaaaaatggcaatttttgagtgccaagtcagaaagtgtgtattaccttgtaaagaaaaaaattacaaagcaggggtttagagttatttatataaatgttgagattttgcactattttttaatataaatatgtcagtgcttgcttgatggaaacttctcttgtgtctgttgagactttaagggagaaatgtcggaatttcagagtcgcctgacggcagagggtgagcccccgtggagtctgcagagaggccttggccaggagcggcgggctttcccgaggggccactgtccctgcagagtggatgcttctgcctagtgacaggttatcaccacgttatatattccctaccgaaggagacaccttttcccccctgacccagaacagcctttaaatcacaagcaaaataggaaagttaaccacggaggcaccgagttccaggtagtggttttgcctttcccaaaaatgaaaataaactgttaccgaaggaattagtttttcctcttcttttttccaactgtgaaggtccccgtggggtggagcatggtgcccctcacaagccgcagcggctggtgcccgggctaccagggacatgccagagggctcgatgacttgtctctgcagggcgctttggtggttgttcagctggctaaaggttcaccggtgaaggcaggtgcggtaactgccgcactggaccctaggaagccccaggtattcgcaatctgacctcctcctgtctgtttcccttcacggatcaattctcacttaagaggccaataaacaacccaacatgaaaaggtgacaagcctgggtttctcccaggataggtgaaagggttaaaatgagtaaagcagttgagcaaacaccaacccgagcttcgggcgcagaattcttcaccttctcttcccctttccatctcctttccccgcggaaacaacgcttcccttctggtgtgtctgttgatctgtgttttcatttacatctctcttagactccgctcttgttctccaggttttcaccagatagatttggggttggcgggacctgctggtgacgtgcaggtgaaggacaggaaggggcatgtgagcgtaaatagaggtgaccagaggagagcatgaggggtggggctttgggacccaccggggccagtggctggagcttgaagtctttcctccccatgggggtgggagggcccccagctggaagagcagactcccagctgctaccccctcccttcccatgggagtggctttccattttgggcagaatgctgactagtagactaacataaaagatataaaaggcaataactattgtttgtgagcaacttttttataacttccaaaacaaaaacctgagcacagttttgaagttctagccactcgagctcatgcatgtgaaacgtgtgctttacgaaggtggcagctgacagacgtgggctctgcatgccgccagcctagtagaaagttctcgttcattggcaacagcagaacctgcctctccgtgaagtcgtcagcctaaaatttgtttctctcttgaagaggattctttgaaaaggtcctgcagagaaatcagtacaggttatcccgaaaggtacaaggacgcacttgtaaagatgattaaaacgtatctttcctttatgtgacgcgtctctagtgccttactgaagaagcagtgacactcccgtcgctcggtgaggacgttcccggacagtgcctcactcacctgggactggtatcccctcccagggtccaccaagggctcctgcttttcagacaccccatcatcctcgcgcgtcctcaccctgtctctaccagggaggtgcctagcttggtgaggttactcctgctcctccaacctttttttgccaaggtttgtacacgactcccatctaggctgaaaacctagaagtggaccttgtgtgtgtgcatggtgtcagcccaaagccaggctgagacagtcctcatatcctcttgagccaaactgtttgggtctcgttgcttcatggtatggtctggatttgtgggaatggctttgcgtgagaaaggggaggagagtggttgctgccctcagccggcttgaggacagagcctgtccctctcatgacaactcagtgttgaagcccagtgtcctcagcttcatgtccagtggatggcagaagttcatggggtagtggcctctcaaaggctgggcgcatcccaagacagccagcaggttgtctctggaaacgaccagagttaagctctcggcttctctgctgagggtgcaccctttcctctagatggtagttgtcacgttatctttgaaaactcttggactgctcctgaggaggccctcttttccagtaggaagttagatgggggttctcagaagtggctgattggaaggggacaagcttcgtttcaggggtctgccgttccatcctggttcagagaaggccgagcgtggctttctctagccttgtcactgtctccctgcctgtcaatcaccacctttcctccagaggaggaaaattatctcccctgcaaagcccggttctacacagatttcacaaattgtgctaagaaccgtccgtgttctcagaaagcccagtgtttttgcaaagaatgaaaagggaccccatatgtagcaaaaatcagggctgggggagagccgggttcattccctgtcctcattggtcgtccctatgaattgtacgtttcagagaaattttttttcctatgtgcaacacgaagcttccagaaccataaaatatcccgtcgataaggaaagaaaatgtcgttgttgttgtttttctggaaactgcttgaaatcttgctgtactatagagctcagaaggacacagcccgtcctcccctgcctgcctgattccatggctgttgtgctgattccaatgctttcacgttggttcctggcgtgggaactgctctcctttgcagccccatttcccaagctctgttcaagttaaacttatgtaagctttccgtggcatgcggggcgcgcacccacgtccccgctgcgtaagactctgtatttggatgccaatccacaggcctgaagaaactgcttgttgtgtatcagtaatcattagtggcaatgatgacattctgaaaagctgcaatacttatacaataaattttacaattctttggaa

SEQ ID NO: 456501 - DNA, 5154 bp, Homo sapiens
cctggtcgtcctccttgggttcgggtgaaagcgcctgggggttcagtgggccatgatccccgagctgctggagaactgaaggcggacagtctcctgcgaaaccaggcaatggcggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccgcccaccatctcgctgtcagacggggaggagcccccaccctaccagggcccctgcaccctccagcttcgggaccccgagcagcagctggaactgaaccgggagtcggtgcgcgcacccccaaacagaaccatcttcgacagtgacctgatggatagtgccaggctgggcggcccctgcccccccagcagtaactcgggcatcagcgccacgtgctacggcagcggcgggcgcatggaggggccgccgcccacctacagcgaggtcatcggccactacccggggtcctccttccagcaccagcagagcagtgggccgccctccttgctggaggggacccggctccaccacacacacatcgcgcccctagagagcgcagccatctggagcaaagagaaggataaacagaaaggacaccctctctagggtccccaggggggccgggctggggctgcgtaggtgaaaaggcagaacactccgcgcttcttagaagaggagtgagaggaaggcggggggcgcagcaacgcatcgtgtggccctcccctcccacctccctgtgtataaatatttacatgtgatgtctggtctgaatgcacaagctaagagagcttgcaaaaaaaaaaagaaaaaagaaaaaaaaaaaccacgtttctttgttgagctgtgtcttgaaggcaaaagaaaaaaaatttctacagtagtctttcttgtttctagttgagctgcgtgcgtgaatgcttattttcttttgtttatgataatttcacttaactttaaagacatatttgcacaaaacctttgtttaaagatctgcaatattatatatataaatatatataagataagagaaactgtatgtgcgagggcaggagtatttttgtattagaagaggcctattaaaaaaaaaagttgttttctgaactagaagaggaaaaaaatggcaatttttgagtgccaagtcagaaagtgtgtattaccttgtaaagaaaaaaattacaaagcaggggtttagagttatttatataaatgttgagattttgcactattttttaatataaatatgtcagtgcttgcttgatggaaacttctcttgtgtctgttgagactttaagggagaaatgtcggaatttcagagtcgcctgacggcagagggtgagcccccgtggagtctgcagagaggccttggccaggagcggcgggctttcccgaggggccactgtccctgcagagtggatgcttctgcctagtgacaggttatcaccacgttatatattccctaccgaaggagacaccttttcccccctgacccagaacagcctttaaatcacaagcaaaataggaaagttaaccacggaggcaccgagttccaggtagtggttttgcctttcccaaaaatgaaaataaactgttaccgaaggaattagtttttcctcttcttttttccaactgtgaaggtccccgtggggtggagcatggtgcccctcacaagccgcagcggctggtgcccgggctaccagggacatgccagagggctcgatgacttgtctctgcagggcgctttggtggttgttcagctggctaaaggttcaccggtgaaggcaggtgcggtaactgccgcactggaccctaggaagccccaggtattcgcaatctgacctcctcctgtctgtttcccttcacggatcaattctcacttaagaggccaataaacaacccaacatgaaaaggtgacaagcctgggtttctcccaggataggtgaaagggttaaaatgagtaaagcagttgagcaaacaccaacccgagcttcgggcgcagaattcttcaccttctcttcccctttccatctcctttccccgcggaaacaacgcttcccttctggtgtgtctgttgatctgtgttttcatttacatctctcttagactccgctcttgttctccaggttttcaccagatagatttggggttggcgggacctgctggtgacgtgcaggtgaaggacaggaaggggcatgtgagcgtaaatagaggtgaccagaggagagcatgaggggtggggctttgggacccaccggggccagtggctggagcttgaagtctttcctccccatgggggtgggagggcccccagctggaagagcagactcccagctgctaccccctcccttcccatgggagtggctttccattttgggcagaatgctgactagtagactaacataaaagatataaaaggcaataactattgtttgtgagcaacttttttataacttccaaaacaaaaacctgagcacagttttgaagttctagccactcgagctcatgcatgtgaaacgtgtgctttacgaaggtggcagctgacagacgtgggctctgcatgccgccagcctagtagaaagttctcgttcattggcaacagcagaacctgcctctccgtgaagtcgtcagcctaaaatttgtttctctcttgaagaggattctttgaaaaggtcctgcagagaaatcagtacaggttatcccgaaaggtacaaggacgcacttgtaaagatgattaaaacgtatctttcctttatgtgacgcgtctctagtgccttactgaagaagcagtgacactcccgtcgctcggtgaggacgttcccggacagtgcctcactcacctgggactggtatcccctcccagggtccaccaagggctcctgcttttcagacaccccatcatcctcgcgcgtcctcaccctgtctctaccagggaggtgcctagcttggtgaggttactcctgctcctccaacctttttttgccaaggtttgtacacgactcccatctaggctgaaaacctagaagtggaccttgtgtgtgtgcatggtgtcagcccaaagccaggctgagacagtcctcatatcctcttgagccaaactgtttgggtctcgttgcttcatggtatggtctggatttgtgggaatggctttgcgtgagaaaggggaggagagtggttgctgccctcagccggcttgaggacagagcctgtccctctcatgacaactcagtgttgaagcccagtgtcctcagcttcatgtccagtggatggcagaagttcatggggtagtggcctctcaaaggctgggcgcatcccaagacagccagcaggttgtctctggaaacgaccagagttaagctctcggcttctctgctgagggtgcaccctttcctctagatggtagttgtcacgttatctttgaaaactcttggactgctcctgaggaggccctcttttccagtaggaagttagatgggggttctcagaagtggctgattggaaggggacaagcttcgtttcaggggtctgccgttccatcctggttcagagaaggccgagcgtggctttctctagccttgtcactgtctccctgcctgtcaatcaccacctttcctccagaggaggaaaattatctcccctgcaaagcccggttctacacagatttcacaaattgtgctaagaaccgtccgtgttctcagaaagcccagtgtttttgcaaagaatgaaaagggaccccatatgtagcaaaaatcagggctgggggagagccgggttcattccctgtcctcattggtcgtccctatgaattgtacgtttcagagaaattttttttcctatgtgcaacacgaagcttccagaaccataaaatatcccgtcgataaggaaagaaaatgtcgttgttgttgtttttctggaaactgcttgaaatcttgctgtactatagagctcagaaggacacagcccgtcctcccctgcctgcctgattccatggctgttgtgctgattccaatgctttcacgttggttcctggcgtgggaactgctctcctttgcagccccatttcccaagctctgttcaagttaaacttatgtaagctttccgtggcatgcggggcgcgcacccacgtccccgctgcgtaagactctgtatttggatgccaatccacaggcctgaagaaactgcttgttgtgtatcagtaatcattagtggcaatgatgacattctgaaaagctgcaatacttatacaataaattttacaattctttggaaaaaacacaaaaaacaacaaaaacaaacaaaaaaaaacaaaaacacaaaacaacaaaaaaacaaacaacaaaacacaccaataaacaacaaaaccacaccaaaacaaaaaaaaacacacacacaacaaaaaaaaaaaagcagacgcgcggacgcgcgccaaaaggaaaaaaacacaactcaaaaaaagacgagcagacaaccagactgccgccgccgaccaataagtacagacgaaaaaagcaggaggcacccaaaaagaaggagctctttactaaaacaacacgagaaaagacgagaaagacgcgttttcaattcaaaacaaaagcgagtagagatcaggggcaagaataaacacctggtgttagggttatatatgtatctaagaggaagccagcccttccactttgcttgggtgcgcgataacaacaatagattcagaagaatataactcctagtacgtacgcagagcggttatcccccccggcggcgagccaacaaaaacgagaacccctagacgagacgataattgggtgtggacaaacaccactccacgtaagtgtgagagagagacgtagagataagaatctagcgtccaaaaatatttgcttctacctcaaatagtattcttcg

SEQ ID NO: 456502 - DNA, 4801 bp, Homo sapiens
aacccgatctccttggacttgaatgaggaggaggaggcggcggcggcggcggcggcggaggcgctcggctggggaaagctagcggcagaggctcagccccggcggcagcgcgcgccccgctgccagcccattttccggacgccacccgcgggcactgccgacgcccccggggctgccgaggggaggccgggggggcgcagcggagcgcggtcccgcgcactgagccccgcggcgccccgggaacttggcggcgacccgagcccggcgagccggggcgcgcctcccccgccgcgcgcctcctgcatgcggggccccagctccgggcgccggccggagccccccccggccgcccccgagccccccgcgccccgcgccgcgccgccgcgccgtccatgcaccgcttgatgggggtcaacagcaccgccgccgccgccgccgggcagcccaatgtctcctgcacgtgcaactgcaaacgctctttgttccagagcatggagatcacggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccgcccaccatctcgctgtcagacggggaggagcccccaccctaccagggcccctgcaccctccagcttcgggaccccaatgtctcctgcacgtgcaactgcaaacgctctttgttccagagcatggagatcacggagctggagtttgttcagtcatcggccactacccggggtcctccttccagcaccagcagagcagtgggccgccctccttgctggaggggacccggctccaccacacacacatcgcgcccctagagagcgcagccatctggagcaaagagaaggataaacagaaaggacaccctctctagggtccccaggggggccgggctggggctgcgtaggtgaaaaggcagaacactccgcgcttcttagaagaggagtgagaggaaggcggggggcgcagcaacgcatcgtgtggccctcccctcccacctccctgtgtataaatatttacatgtgatgtctggtctgaatgcacaagctaagagagcttgcaaaaaaaaaaagaaaaaagaaaaaaaaaaaccacgtttctttgttgagctgtgtcttgaaggcaaaagaaaaaaaatttctacagtagtctttcttgtttctagttgagctgcgtgcgtgaatgcttattttcttttgtttatgataatttcacttaactttaaagacatatttgcacaaaacctttgtttaaagatctgcaatattatatatataaatatatataagataagagaaactgtatgtgcgagggcaggagtatttttgtattagaagaggcctattaaaaaaaaaagttgttttctgaactagaagaggaaaaaaatggcaatttttgagtgccaagtcagaaagtgtgtattaccttgtaaagaaaaaaattacaaagcaggggtttagagttatttatataaatgttgagattttgcactattttttaatataaatatgtcagtgcttgcttgatggaaacttctcttgtgtctgttgagactttaagggagaaatgtcggaatttcagagtcgcctgacggcagagggtgagcccccgtggagtctgcagagaggccttggccaggagcggcgggctttcccgaggggccactgtccctgcagagtggatgcttctgcctagtgacaggttatcaccacgttatatattccctaccgaaggagacaccttttcccccctgacccagaacagcctttaaatcacaagcaaaataggaaagttaaccacggaggcaccgagttccaggtagtggttttgcctttcccaaaaatgaaaataaactgttaccgaaggaattagtttttcctcttcttttttccaactgtgaaggtccccgtggggtggagcatggtgcccctcacaagccgcagcggctggtgcccgggctaccagggacatgccagagggctcgatgacttgtctctgcagggcgctttggtggttgttcagctggctaaaggttcaccggtgaaggcaggtgcggtaactgccgcactggaccctaggaagccccaggtattcgcaatctgacctcctcctgtctgtttcccttcacggatcaattctcacttaagaggccaataaacaacccaacatgaaaaggtgacaagcctgggtttctcccaggataggtgaaagggttaaaatgagtaaagcagttgagcaaacaccaacccgagcttcgggcgcagaattcttcaccttctcttcccctttccatctcctttccccgcggaaacaacgcttcccttctggtgtgtctgttgatctgtgttttcatttacatctctcttagactccgctcttgttctccaggttttcaccagatagatttggggttggcgggacctgctggtgacgtgcaggtgaaggacaggaaggggcatgtgagcgtaaatagaggtgaccagaggagagcatgaggggtggggctttgggacccaccggggccagtggctggagcttgaagtctttcctccccatgggggtgggagggcccccagctggaagagcagactcccagctgctaccccctcccttcccatgggagtggctttccattttgggcagaatgctgactagtagactaacataaaagatataaaaggcaataactattgtttgtgagcaacttttttataacttccaaaacaaaaacctgagcacagttttgaagttctagccactcgagctcatgcatgtgaaacgtgtgctttacgaaggtggcagctgacagacgtgggctctgcatgccgccagcctagtagaaagttctcgttcattggcaacagcagaacctgcctctccgtgaagtcgtcagcctaaaatttgtttctctcttgaagaggattctttgaaaaggtcctgcagagaaatcagtacaggttatcccgaaaggtacaaggacgcacttgtaaagatgattaaaacgtatctttcctttatgtgacgcgtctctagtgccttactgaagaagcagtgacactcccgtcgctcggtgaggacgttcccggacagtgcctcactcacctgggactggtatcccctcccagggtccaccaagggctcctgcttttcagacaccccatcatcctcgcgcgtcctcaccctgtctctaccagggaggtgcctagcttggtgaggttactcctgctcctccaacctttttttgccaaggtttgtacacgactcccatctaggctgaaaacctagaagtggaccttgtgtgtgtgcatggtgtcagcccaaagccaggctgagacagtcctcatatcctcttgagccaaactgtttgggtctcgttgcttcatggtatggtctggatttgtgggaatggctttgcgtgagaaaggggaggagagtggttgctgccctcagccggcttgaggacagagcctgtccctctcatgacaactcagtgttgaagcccagtgtcctcagcttcatgtccagtggatggcagaagttcatggggtagtggcctctcaaaggctgggcgcatcccaagacagccagcaggttgtctctggaaacgaccagagttaagctctcggcttctctgctgagggtgcaccctttcctctagatggtagttgtcacgttatctttgaaaactcttggactgctcctgaggaggccctcttttccagtaggaagttagatgggggttctcagaagtggctgattggaaggggacaagcttcgtttcaggggtctgccgttccatcctggttcagagaaggccgagcgtggctttctctagccttgtcactgtctccctgcctgtcaatcaccacctttcctccagaggaggaaaattatctcccctgcaaagcccggttctacacagatttcacaaattgtgctaagaaccgtccgtgttctcagaaagcccagtgtttttgcaaagaatgaaaagggaccccatatgtagcaaaaatcagggctgggggagagccgggttcattccctgtcctcattggtcgtccctatgaattgtacgtttcagagaaattttttttcctatgtgcaacacgaagcttccagaaccataaaatatcccgtcgataaggaaagaaaatgtcgttgttgttgtttttctggaaactgcttgaaatcttgctgtactatagagctcagaaggacacagcccgtcctcccctgcctgcctgattccatggctgttgtgctgattccaatgctttcacgttggttcctggcgtgggaactgctctcctttgcagccccatttcccaagctctgttcaagttaaacttatgtaagctttccgtggcatgcggggcgcgcacccacgtccccgctgcgtaagactctgtatttggatgccaatccacaggcctgaagaaactgcttgttgtgtatcagtaatcattagtggcaatgatgacattctgaaaagctgcaatacttatacaataaattttacaattctttggaa

SEQ ID NO: 456503 - DNA, 3216 bp, Homo sapiens
cctggtcgtcctccttgggttcgggtgaaagcgcctgggggttcagtgggccatgatccccgagctgctggagaactgaaggcggacagtctcctgcgaaaccaggcaatggcggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccgcccaccatctcgctgtcagacggggaggagcccccaccctaccagggcccctgcaccctccagcttcgggaccccgagcagcagctggaactgaaccgggagtcggtgcgcgcacccccaaacagaaccatcttcgacagtgacctgatggatagtgccaggctgggcggcccctgcccccccagcagtaactcgggcatcagcgccacgtgctacggcagcggcgggcgcatggaggggccgccgcccacctacagcgaggtcatcggccactacccggggtcctccttccagcaccagcagagcagtgggccgccctccttgctggaggggacccggctccaccacacacacatcgcgcccctagagagcgcagccatctggagcaaagagaaggataaacagaaaggacaccctctctagggtccccaggggggccgggctggggctgcgtaggtgaaaaggcagaacactccgcgcttcttagaagaggagtgagaggaaggcggggggcgcagcaacgcatcgtgtggccctcccctcccacctccctgtgtataaatatttacatgtgatgtctggtctgaatgcacaagctaagagagcttgcaaaaaaaaaaagaaaaaagaaaaaaaaaaaccacgtttctttgttgagctgtgtcttgaaggcaaaagaaaaaaaatttctacagtagtctttcttgtttctagttgagctgcgtgcgtgaatgcttattttcttttgtttatgataatttcacttaactttaaagacatatttgcacaaaacctttgtttaaagatctgcaatattatatatataaatatatataagataagagaaactgtatgtgcgagggcaggagtatttttgtattagaagaggcctattaaaaaaaaaagttgttttctgaactagaagaggaaaaaaatggcaatttttgagtgccaagtcagaaagtgtgtattaccttgtaaagaaaaaaattacaaagcaggggtttagagttatttatataaatgttgagattttgcactattttttaatataaatatgtcagtgcttgcttgatggaaacttctcttgtgtctgttgagactttaagggagaaatgtcggaatttcagagtcgcctgacggcagagggtgagcccccgtggagtctgcagagaggccttggccaggagcggcgggctttcccgaggggccactgtccctgcagagtggatgcttctgcctagtgacaggttatcaccacgttatatattccctaccgaaggagacaccttttcccccctgacccagaacagcctttaaatcacaagcaaaataggaaagttaaccacggaggcaccgagttccaggtagtggttttgcctttcccaaaaatgaaaataaactgttaccgaaggaattagtttttcctcttcttttttccaactgtgaaggtccccgtggggtggagcatggtgcccctcacaagccgcagcggctggtgcccgggctaccagggacatgccagagggctcgatgacttgtctctgcagggcgctttggtggttgttcagctggctaaaggttcaccggtgaaggcaggtgcggtaactgccgcactggaccctaggaagccccaggtattcgcaatctgacctcctcctgtctgtttcccttcacggatcaattctcacttaagaggccaataaacaacccaacatgaaaaggtgacaagcctgggtttctcccaggataggtgaaagggttaaaatgagtaaagcagttgagcaaacaccaacccgagcttcgggcgcagaattcttcaccttctcttcccctttccatctcctttccccgcggaaacaacgcttcccttctggtgtgtctgttgatctgtgttttcatttacatctctcttagactccgctcttgttctccaggttttcaccagatagatttggggttggcgggacctgctggtgacgtgcaggtgaaggacaggaaggggcatgtgagcgtaaatagaggtgaccagaggagagcatgaggggtggggctttgggacccaccggggccagtggctggagcttgaagtctttcctccccatgggggtgggagggcccccagctggaagagcagactcccagctgctaccccctcccttcccatgggagtggctttccattttgggcagaatgctgactagtagactaacataaaagatataaaaggcaataactattgtttgtgagcaacttttttataacttccaaaacaaaaacctgagcacagttttgaagttctagccactcgagctcatgcatgtgaaacgtgtgctttacgaaggtggcagctgacagacgtgggctctgcatgccgccagcctagtagaaagttctcgttcattggcaacagcagaacctgcctctccgtgaagtcgtcagcctaaaatttgtttctctcttgaagaggattctttgaaaaggtcctgcagagaaatcagtacaggttatcccgaaaggtacaaggacgcacttgtaaagatgattaaaacgtatctttcctttatgtgacgcgtctctagtgccttactgaagaagcagtgacactcccgtcgctcggtgaggacgttcccggacagtgcctcactcacctgggactggtatcccctcccagggtccaccaagggctcctgcctctccccctaggcctgatttttgttacatattgtggtcccttttcatttctttgcttttctcttgtcttttttgtct

SEQ ID NO: 456504 - DNA, 4913 bp, Homo sapiens
aacccgatctccttggacttgaatgaggaggaggaggcggcggcggcggcggcggcggaggcgctcggctggggaaagctagcggcagaggctcagccccggcggcagcgcgcgccccgctgccagcccattttccggacgccacccgcgggcactgccgacgcccccggggctgccgaggggaggccgggggggcgcagcggagcgcggtcccgcgcactgagccccgcggcgccccgggaacttggcggcgacccgagcccggcgagccggggcgcgcctcccccgccgcgcgcctcctgcatgcggggccccagctccgggcgccggccggagccccccccggccgcccccgagccccccgcgccccgcgccgcgccgccgcgccgtccatgcaccgcttgatgggggtcaacagcaccgccgccgccgccgccgggcagcccaatgtctcctgcacgtgcaactgcaaacgctctttgttccagagcatggagatcacggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccgcccaccatctcgctgtcagacggggaggagcccccaccctaccagggcccctgcaccctccagcttcgggaccccgagcagcagctggaactgaaccgggagtcggtgcgcgcacccccaaacagaaccatcttcgacagtgacctgatggatagtgccaggctgggcggcccctgcccccccagcagtaactcgggcatcagcgccacgtgctacggcagcggcgggcgcatggaggggccgccgcccacctacagcgaggtcatcggccactacccggggtcctccttccagcaccagcagagcagtgggccgccctccttgctggaggggacccggctccaccacacacacatcgcgcccctagagagcgcagccatctggagcaaagagaaggataaacagaaaggacaccctctctagggtccccaggggggccgggctggggctgcgtaggtgaaaaggcagaacactccgcgcttcttagaagaggagtgagaggaaggcggggggcgcagcaacgcatcgtgtggccctcccctcccacctccctgtgtataaatatttacatgtgatgtctggtctgaatgcacaagctaagagagcttgcaaaaaaaaaaagaaaaaagaaaaaaaaaaaccacgtttctttgttgagctgtgtcttgaaggcaaaagaaaaaaaatttctacagtagtctttcttgtttctagttgagctgcgtgcgtgaatgcttattttcttttgtttatgataatttcacttaactttaaagacatatttgcacaaaacctttgtttaaagatctgcaatattatatatataaatatatataagataagagaaactgtatgtgcgagggcaggagtatttttgtattagaagaggcctattaaaaaaaaaagttgttttctgaactagaagaggaaaaaaatggcaatttttgagtgccaagtcagaaagtgtgtattaccttgtaaagaaaaaaattacaaagcaggggtttagagttatttatataaatgttgagattttgcactattttttaatataaatatgtcagtgcttgcttgatggaaacttctcttgtgtctgttgagactttaagggagaaatgtcggaatttcagagtcgcctgacggcagagggtgagcccccgtggagtctgcagagaggccttggccaggagcggcgggctttcccgaggggccactgtccctgcagagtggatgcttctgcctagtgacaggttatcaccacgttatatattccctaccgaaggagacaccttttcccccctgacccagaacagcctttaaatcacaagcaaaataggaaagttaaccacggaggcaccgagttccaggtagtggttttgcctttcccaaaaatgaaaataaactgttaccgaaggaattagtttttcctcttcttttttccaactgtgaaggtccccgtggggtggagcatggtgcccctcacaagccgcagcggctggtgcccgggctaccagggacatgccagagggctcgatgacttgtctctgcagggcgctttggtggttgttcagctggctaaaggttcaccggtgaaggcaggtgcggtaactgccgcactggaccctaggaagccccaggtattcgcaatctgacctcctcctgtctgtttcccttcacggatcaattctcacttaagaggccaataaacaacccaacatgaaaaggtgacaagcctgggtttctcccaggataggtgaaagggttaaaatgagtaaagcagttgagcaaacaccaacccgagcttcgggcgcagaattcttcaccttctcttcccctttccatctcctttccccgcggaaacaacgcttcccttctggtgtgtctgttgatctgtgttttcatttacatctctcttagactccgctcttgttctccaggttttcaccagatagatttggggttggcgggacctgctggtgacgtgcaggtgaaggacaggaaggggcatgtgagcgtaaatagaggtgaccagaggagagcatgaggggtggggctttgggacccaccggggccagtggctggagcttgaagtctttcctccccatgggggtgggagggcccccagctggaagagcagactcccagctgctaccccctcccttcccatgggagtggctttccattttgggcagaatgctgactagtagactaacataaaagatataaaaggcaataactattgtttgtgagcaacttttttataacttccaaaacaaaaacctgagcacagttttgaagttctagccactcgagctcatgcatgtgaaacgtgtgctttacgaaggtggcagctgacagacgtgggctctgcatgccgccagcctagtagaaagttctcgttcattggcaacagcagaacctgcctctccgtgaagtcgtcagcctaaaatttgtttctctcttgaagaggattctttgaaaaggtcctgcagagaaatcagtacaggttatcccgaaaggtacaaggacgcacttgtaaagatgattaaaacgtatctttcctttatgtgacgcgtctctagtgccttactgaagaagcagtgacactcccgtcgctcggtgaggacgttcccggacagtgcctcactcacctgggactggtatcccctcccagggtccaccaagggctcctgcttttcagacaccccatcatcctcgcgcgtcctcaccctgtctctaccagggaggtgcctagcttggtgaggttactcctgctcctccaacctttttttgccaaggtttgtacacgactcccatctaggctgaaaacctagaagtggaccttgtgtgtgtgcatggtgtcagcccaaagccaggctgagacagtcctcatatcctcttgagccaaactgtttgggtctcgttgcttcatggtatggtctggatttgtgggaatggctttgcgtgagaaaggggaggagagtggttgctgccctcagccggcttgaggacagagcctgtccctctcatgacaactcagtgttgaagcccagtgtcctcagcttcatgtccagtggatggcagaagttcatggggtagtggcctctcaaaggctgggcgcatcccaagacagccagcaggttgtctctggaaacgaccagagttaagctctcggcttctctgctgagggtgcaccctttcctctagatggtagttgtcacgttatctttgaaaactcttggactgctcctgaggaggccctcttttccagtaggaagttagatgggggttctcagaagtggctgattggaaggggacaagcttcgtttcaggggtctgccgttccatcctggttcagagaaggccgagcgtggctttctctagccttgtcactgtctccctgcctgtcaatcaccacctttcctccagaggaggaaaattatctcccctgcaaagcccggttctacacagatttcacaaattgtgctaagaaccgtccgtgttctcagaaagcccagtgtttttgcaaagaatgaaaagggaccccatatgtagcaaaaatcagggctgggggagagccgggttcattccctgtcctcattggtcgtccctatgaattgtacgtttcagagaaattttttttcctatgtgcaacacgaagcttccagaaccataaaatatcccgtcgataaggaaagaaaatgtcgttgttgttgtttttctggaaactgcttgaaatcttgctgtactatagagctcagaaggacacagcccgtcctcccctgcctgcctgattccatggctgttgtgctgattccaatgctttcacgttggttcctggcgtgggaactgctctcctttgcagccccatttcccaagctctgttcaagttaaacttatgtaagctttccgtggcatgcggggcgcgcacccacgtccccgctgcgtaagactctgtatttggatgccaatccacaggcctgaagaaactgcttgttgtgtatcagtaatcattagtggcaatgatgacattctgaaaagctgcaatacttatacaataaattttacaattctttggaa

SEQ ID NO: 456505 - DNA, 4190 bp, Homo sapiens
cctggtcgtcctccttgggttcgggtgaaagcgcctgggggttcagtgggccatgatccccgagctgctggagaactgaaggcggacagtctcctgcgaaaccaggcaatggcggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccgcccaccatctcgctgtcagacggggaggagcccccaccctaccagggcccctgcaccctccagcttcgggaccccgagcagcagctggaactgaaccgggagtcggtgcgcgcacccccaaacagaaccatcttcgacagtgacctgatggatagtgccaggctgggcggcccctgcccccccagcagtaactcgggcatcagcgccacgtgctacggcagcggcgggcgcatggaggggccgccgcccacctacagcgaggtcatcggccactacccggggtcctccttccagcaccagcagagcagtgggccgccctccttgctggaggggacccggctccaccacacacacatcgcgcccctagagagcgcagccatctggagcaaagagaaggataaacagaaaggacaccctctctagggtccccaggggggccgggctggggctgcgtaggtgaaaaggcagaacactccgcgcttcttagaagaggagtgagaggaaggcggggggcgcagcaacgcatcgtgtggccctcccctcccacctccctgtgtataaatatttacatgtgatgtctggtctgaatgcacaagctaagagagcttgcaaaaaaaaaaagaaaaaagaaaaaaaaaaaccacgtttctttgttgagctgtgtcttgaaggcaaaagaaaaaaaatttctacagtagtctttcttgtttctagttgagctgcgtgcgtgaatgcttattttcttttgtttatgataatttcacttaactttaaagacatatttgcacaaaacctttgtttaaagatctgcaatattatatatataaatatatataagataagagaaactgtatgtgcgagggcaggagtatttttgtattagaagaggcctattaaaaaaaaaagttgttttctgaactagaagaggaaaaaaatggcaatttttgagtgccaagtcagaaagtgtgtattaccttgtaaagaaaaaaattacaaagcaggggtttagagttatttatataaatgttgagattttgcactattttttaatataaatatgtcagtgcttgcttgatggaaacttctcttgtgtctgttgagactttaagggagaaatgtcggaatttcagagtcgcctgacggcagagggtgagcccccgtggagtctgcagagaggccttggccaggagcggcgggctttcccgaggggccactgtccctgcagagtggatgcttctgcctagtgacaggttatcaccacgttatatattccctaccgaaggagacaccttttcccccctgacccagaacagcctttaaatcacaagcaaaataggaaagttaaccacggaggcaccgagttccaggtagtggttttgcctttcccaaaaatgaaaataaactgttaccgaaggaattagtttttcctcttcttttttccaactgtgaaggtccccgtggggtggagcatggtgcccctcacaagccgcagcggctggtgcccgggctaccagggacatgccagagggctcgatgacttgtctctgcagggcgctttggtggttgttcagctggctaaaggttcaccggtgaaggcaggtgcggtaactgccgcactggaccctaggaagccccaggtattcgcaatctgacctcctcctgtctgtttcccttcacggatcaattctcacttaagaggccaataaacaacccaacatgaaaaggtgacaagcctgggtttctcccaggataggtgaaagggttaaaatgagtaaagcagttgagcaaacaccaacccgagcttcgggcgcagaattcttcaccttctcttcccctttccatctcctttccccgcggaaacaacgcttcccttctggtgtgtctgttgatctgtgttttcatttacatctctcttagactccgctcttgttctccaggttttcaccagatagatttggggttggcgggacctgctggtgacgtgcaggtgaaggacaggaaggggcatgtgagcgtaaatagaggtgaccagaggagagcatgaggggtggggctttgggacccaccggggccagtggctggagcttgaagtctttcctccccatgggggtgggagggcccccagctggaagagcagactcccagctgctaccccctcccttcccatgggagtggctttccattttgggcagaatgctgactagtagactaacataaaagatataaaaggcaataactattgtttgtgagcaacttttttataacttccaaaacaaaaacctgagcacagttttgaagttctagccactcgagctcatgcatgtgaaacgtgtgctttacgaaggtggcagctgacagacgtgggctctgcatgccgccagcctagtagaaagttctcgttcattggcaacagcagaacctgcctctccgtgaagtcgtcagcctaaaatttgtttctctcttgaagaggattctttgaaaaggtcctgcagagaaatcagtacaggttatcccgaaaggtacaaggacgcacttgtaaagatgattaaaacgtatctttcctttatgtgacgcgtctctagtgccttactgaagaagcagtgacactcccgtcgctcggtgaggacgttcccggacagtgcctcactcacctgggactggtatcccctcccagggtccaccaagggctcctgcttttcagacaccccatcatcctcgcgcgtcctcaccctgtctctaccagggaggtgcctagcttggtgaggttactcctgctcctccaacctttttttgccaaggtttgtacacgactcccatctaggctgaaaacctagaagtggaccttgtgtgtgtgcatggtgtcagcccaaagccaggctgagacagtcctcatatcctcttgagccaaactgtttgggtctcgttgcttcatggtatggtctggatttgtgggaatggctttgcgtgagaaaggggaggagagtggttgctgccctcagccggcttgaggacagagcctgtccctctcatgacaactcagtgttgaagcccagtgtcctcagcttcatgtccagtggatggcagaagttcatggggtagtggcctctcaaaggctgggcgcatcccaagacagccagcaggttgtctctggaaacgaccagagttaagctctcggcttctctgctgagggtgcaccctttcctctagatggtagttgtcacgttatctttgaaaactcttggactgctcctgaggaggccctcttttccagtaggaagttagatgggggttctcagaagtggctgattggaaggggacaagcttcgtttcaggggtctgccgttccatcctggttcagagaaggccgagcgtggctttctctagccttgtcactgtctccctgcctgtcaatcaccacctttcctccagaggaggaaaattatctcccctgcctgcctgattccatggctgttgtgctgattccaatgctttcacgttggttcctggcgtgggaactgctctcctttgcagccccatttcccaagctctgttcaagttaaacttatgtaagctttccgtggcatgcggggcgcgcacccacgtccccgctgcgtaagactctgtatttggatgccaatccacaggcctgaagaaactgcttgttgtgtatcagtaatcattagtggcaatgatgacattctgaaaagctgcaatacttatacaataaattttacaattctttggaa

SEQ ID NO: 456506 - DNA, 1860 bp, Homo sapiens
cctggtcgtcctccttgggttcgggtgaaagcgcctgggggttcagtgggccatgatccccgagctgctggagaactgaaggcggacagtctcctgcgaaaccaggcaatggcggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccgcccaccatctcgctgtcagacggggaggagcccccaccctaccagggcccctgcaccctccagcttcgggaccccgagcagcagctggaactgaaccgggagtcggtgcgcgcacccccaaacagaaccatcttcgacagtgacctgatggatagtgccaggctgggcggcccctgcccccccagcagtaactcgggcatcagcgccacgtgctacggcagcggcgggcgcatggaggggccgccgcccacctacagcgaggtcatcggccactacccggggtcctccttccagcaccagcagagcagtgggccgccctccttgctggaggggacccggctccaccacacacacatcgcgcccctagagagcgcagccatctggagcaaagagaaggataaacagaaaggacaccctctctagggtccccaggggggccgggctggggctgcgtaggtgaaaaggcagaacactccgcgcttcttagaagaggagtgagaggaaggcggggggcgcagcaacgcatcgtgtggccctcccctcccacctccctgtgtataaatatttacatgtgatgtctggtctgaatgcacaagctaagagagcttgcaaaaaaaaaaagaaaaaagaaaaaaaaaaaccacgtttctttgttgagctgtgtcttgaaggcaaaagaaaaaaaatttctacagtagtctttcttgtttctagttgagctgcgtgcgtgaatgcttattttcttttgtttatgataatttcacttaactttaaagacatatttgcacaaaacctttgtttaaagatctgcaatattatatatataaatatatataagataagagaaactgtatgtgcgagggcaggagtatttttgtattagaagaggcctattaaaaaaaaaagttgttttctgaactagaagaggaaaaaaatggcaatttttgagtgccaagtcagaaagtgtgtattaccttgtaaagaaaaaaattacaaagcaggggtttagagttatttatataaatgttgagattttgcactattttttaatataaatatgtcagtgcttgcttgatggaaacttctcttgtgtctgttgagactttaagggagaaatgtcggaatttcagagtcgcctgacggcagagggtgagcccccgtggagtctgcagagaggccttggccaggagcggcgggctttcccgaggggccactgtccctgcagagtggatgcttctgcctagtgacaggttatcaccacgttatatattccctaccgaaggagacaccttttcccccctgacccagaacagcctttaaatcacaagcaaaataggaaagttaaccacggaggcaccgagttccaggtagtggttttgcctttcccaaaaatgaaaataaactgttaccgaagga

SEQ ID NO: 456507 - DNA, 1654 bp, Homo sapiens
  misc_feature (1471)..(1472): n is a, c, g, or t
aactttgcagttatccaacacccataaatatattccgggaaattaagccagtcttttcagttcacaattgagtgtacctgggagtctccttgccctttctcagaagacattaaaaagaaaagctgtaaatcagtcataagaaaaagaacatatataatctggagtagaattttgcttccacttggctaattttcatcagtgctatgctcctgtggtcccccggatccaaatatttcctaacctttaccttttcattttgttgagagtagtagtaatccacatgtatttttagctaacaaaacacgtccatgaattagattatttcttgaagcttttcatcaaatactttgtggccttttttttttttaattttagccaatgttaaatcaaagctttaggcttataattgtattctacatagctaaacaaagttcaccagaaaaaaagggaaagattataaaacattataaaaggaaaacattataaagtaattaaattttaaagccagtatgtgaaagaagagatggcccaaagtcttcattaccctcttagagaagaaactccattaatgtgtgctcagtctggttccactccctagtaaccttaagcatagttacattcactttttgtcttttacccccattttcagttctgttgtgatcatcttttacaacataattcaccctcaactatttttggaggagtgtgggaaggaaataaacagtaacgtaaagtatatatgaaatcatgtttaaccttgaagacaatgaccccttgatttttactttcggttaacaggtaccacaacatcagagtatacaagaatactggaagtgtgtgaagaaagaaagcattaaaggagtaaaagaagtctggaaacaagctggaaaaggtcttttttaataaaagatataatagtatggcaattatattgttccaaatgtcaaaatttgtgattttttagaagtacttgctatttatcttcttaagtcttcattgatattctgtgtgaaataagcatgtcttgtacttgctttctgattcataattttatgaaagaacttagtagaaagaaaagtaagtataaaaatagatattggattctgtcagaaggcctagatttgaaataatgttttgtacttcggtaagatggaaaacttagtgattcactgatttcttagacactctaatatgatatgctttctggaaggataaaacaaatacatatgggaaaaagtacttgagaccaaggccagcatcaattccagacatcttcatgttcctaataggctaaatgaagttaaaaacttatttcagatttttctcatctgtaccttatatctcataaatttattgcatattttatgtcagtagcttagctgtttattgtctttaaaataacatgtaaacttcaatgttctatctggaagcagaataaaatatttacatagataccaaaaaaaaaaaagannaaaaaaaaatttttgggcgcgtgggccgcgaaaaatttttagaccattggtgtggggcgggggcccatgtgttagtgaactggttcatggggtctaaggaaatgtgtccatgggtctggtttcccataaagccgggggaccgggttgaacatcatggtggggttggtttagggcaggacata

SEQ ID NO: 456508 - DNA, 1104 bp, Homo sapiens
gacacaaagaaactttgtcaaaattggctgatatttgtacattttaatatatgtattttttcctgaagagctgtaaataataattgggaggggaacagggagcaggtagaggtatagaagagccaggaatagcagaatactggtaattattgaagattaataatgtttacatggtgacttgttgtagaattctgttcattttacttaagtttgaaattttctgtaataaaaatttgtaagaggttccaggggaataagcacagggagaaatgtttggatattgaacttggcattatatcatttgattgtcaactttaaaaataaaaggtaaaataaatataaagctttttaacttttttcccaaaaataattaagtaggggaaaggggggtattgaaaactggctgagagatttagagaactagaaataaaccacttgcctaaaacaaacgtaatagaaatagctaaattcaaaataattaatacggaattaattgcagcagttttcaaactgttaaatagcccagaaaaaaatgggtagaggtttgtctcctaattgatttgaatccatagtttgggattttgtctacatctgattcttttaaaatgctttcttttttaaatttgctttccatatgaggattgatacaattgattctgaaaggcagctgcagaagatcataagtaaacaagatgacttgatgacagtgaaaactaatgaaactggatatcaggaagcaatagtgaaagaacctgaaattaacacaactcttcagatgcgtttctttggaaaaagaggacaaagaaaacttcattataaagaatttcgaagatttatggaaaatttacaaacagagattcaagaaatggaattccttcagttttctaaaggtttgagtttcatgagaaaagaagactttgcagagtggctactttttttcactaacactgaaaataaagatatttattggaaaaatgtgagagagaagttgtcagcaggagaggttggtatacccttttattatgcatgtgataaagatgaaataataagttagacatgtttacataaagtaacttctgaattaaccaagactgtgctaccctc

SEQ ID NO: 456509 - DNA, 700 bp, Homo sapiens
  misc_feature (110)..(110): n is a, c, g, or t
  misc_feature (159)..(159): n is a, c, g, or t
  misc_feature (174)..(174): n is a, c, g, or t
agcgaacagcccagcaacaacaaaagtcgaacaagactttggttgggccttgtggagctttgaaatcaagttctttctttacagcatcatccttaagtgtcaacagatgncggatttctgaggacagcttttgatccacaacggacagcttgttgatcnaatttcggtaggtancaagcctttctatgacaggatgtccatgtgctgggactctcctagctttcaggatcaaataaaaactgatgttcgagcaataattcaagtagaggttgtacttggtcctcaagtattggcttccttttccgggtggaatgatcccttgttccaccaactctaacaatggctccagctcatccttaacctctgtcaacttgactttcaggtcttctatcagctccaagagttctggtgattcctttcgcaacattttcagcttctctttcactgaaactttagccaaatccttcacgacccgtgtctcagcctcatctacctgaggcactgctcgtgccgaattcggcacgagggctaaatgaagttaaaaacttatttcagatttttctcatctgtaccttatatctcataaatttattgcatattttatgtcagtagcttagctgtttattgtctttaaaataacatgtaaacttcaatgttctatctggaagcagaataaaatatttacatagataccaaaaaa

SEQ ID NO: 456510 - DNA, 356 bp, Homo sapiens
gatggaccaaggttcagatcctgattgttccagttagtagactttgggcaaactacataacccctgaagcgttacttacctaagacttagagaggctaaggtcatacacgttataaagggcagaaccggaatttcagcattaaaagtccatctaactccaaaactctgtgctcttactcagtgctatgtccactaataaaacttagcagaagtggaccacttaacagagtatgttagtctcttcaagctgccacctcaaaacaccacaggctgaggcgggagaattggatgaacctgggagacaaaggttgcagtgagccaaggtcacacctgggcaacagtgagactctgtctca

SEQ ID NO: 456511 - DNA, 1824 bp, Homo sapiens
cgcgagagttcccaagcggtaggcggcggcgccgggagagaagcgccgtctagctgcgcttccgcaaagatggcggcggctgcgggtagctgcgcgcgggtggcggcctggggcggaaaactgcgacgggggctcgctgtcagccgacaggctgtgcggagtcccggccccttggcagcggcagtggccggcgcggccctggcaggagcaggagcggcctggcaccacagccgcgtcagtgttgcggcgcgggatggcagttttacagtctccgcacagaaaaatgttgaacatggaataatatatattgggaaaccgtctcttcgtaagcagcgcttcatgcagttttcttcactcgaacatgaaggagaatattatatgacaccacgagacttcctcttctcagtgatgtttgagcaaatggaacgtaaaacttcagtcaagaagctgacaaaaaaggacatcgaggatacactgtcagggatccaaacagctggctgtggatcaacttttttcagagaccttggcgataaagggctaatttcatataccgagtatcttttcttgcttacaatcctcactaaaccccattctggatttcatgttgcttttaaaatgctggatacagatggtaatgagatgattgaaaaaagggaattttttaagctgcagaagatcataagtaaacaagatgacttgatgacagtgaaaactaatgaaactggatatcaggaagcaatagtgaaagaacctgaaattaacacaactcttcagatgcgtttctttggaaaaagaggacaaagaaaacttcattataaagaatttcgaagatttatggaaaatttacaaacagagattcaagaaatggaattccttcagttttctaaaggtttgagtttcatgagaaaagaagactttgcagagtggctactttttttcactaacactgaaaataaagatatttattggaaaaatgtgagagagaagttgtcagcaggagagcggagtttaagagagctgtgaaagtagcaacaggacaagaactctcaaacaatattttggacactgtctttaagatctttgatttggatggtgatgaatgtcttagtcatgaagagtttcttggggtgttaaaaaacagaatgcatcgaggtttatgggtaccacaacatcagagtatacaagaatactggaagtgtgtgaagaaagaaagcattaaaggagtaaaagaagtctggaaacaagctggaaaaggtcttttttaataaaagatataatagtatggcaattatattgttccaaatgtcaaaatttgtgattttttagaagtacttgctatttatcttcttaagtcttcattgatattctgtgtgaaataagcatgtcttgtacttgctttctgattcataattttatgaaagaacttagtagaaagaaaagtaagtataaaaatagatattggattctgtcagaaggcctagatttgaaataatgttttgtacttcggtaagatggaaaacttagtgattcactgatttcttagacactctaatatgatatgctttctggaaggataaaacaaatacatatgggaaaaagtacttgagaccaaggccagcatcaattccagacatcttcatgttcctaataggctaaatgaagttaaaaacttatttcagatttttctcatctgtaccttatatctcataaatttattgcatattttatgtcagtagcttagctgtttattgtctttaaaataacatgtaaacttcaatgttctatctggaagcagaataaaatatttacatagataccaaaaaa

SEQ ID NO: 456512 - DNA, 2008 bp, Homo sapiens
cgcgagagttcccaagcggtaggcggcggcgccgggagagaagcgccgtctagctgcgcttccgcaaagatggcggcggctgcgggtagctgcgcgcgggtggcggcctggggcggaaaactgcgacgggggctcgctgtcagccgacaggctgtgcggagtcccggccccttggcagcggcagtggccggcgcggccctggcaggagcaggagcggcctggcaccacagccgcgtcagtgttgcggcgcgggatggcagttttacagtctccgcacagatttacattatgcctttctagcgaaaaactcaaggaacattcagatacaacaaaaaagagaggaaagaaggccttaaaaatgttgaacatggaataatatatattgggaaaccgtctcttcgtaagcagcgcttcatgcagttttcttcactcgaacatgaaggagaatattatatgacaccacgagacttcctcttctcagtgatgtttgagcaaatggaacgtaaaacttcagtcaagaagctgacaaaaaaggacatcgaggatacactgtcagggatccaaacagctggctgtggatcaacttttttcagagaccttggcgataaagggctaatttcatataccgagtatcttttcttgcttacaatcctcactaaaccccattctggatttcatgttgcttttaaaatgctggatacagatggtaatgagatgattgaaaaaagggaattttttaagctgcagaagatcataagtaaacaagatgacttgatgacagtgaaaactaatgaaactggatatcaggaagcaatagtgaaagaacctgaaattaacacaactcttcagatgcgtttctttggaaaaagaggacaaagaaaacttcattataaagaatttcgaagatttatggaaaatttacaaacagagattcaagaaatggaattccttcagttttctaaaggtttgagtttcatgagaaaagaagactttgcagagtggctactttttttcactaacactgaaaataaagatatttattggaaaaatgtgagagagaagttgtcagcaggagagagcattagtttggatgaattcaagtcattttgccattttacaacccacttggaagactttgctattgccatgcagatgttcagtttagctcatcgtcctgtcagactagcggagtttaagagagctgtgaaagtagcaacaggacaagaactctcaaacaatattttggacactgtctttaagatctttgatttggatggtgatgaatgtcttagtcatgaagagtttcttggggtgttaaaaaacagaatgcatcgaggtttatgggtaccacaacatcagagtatacaagaatactggaagtgtgtgaagaaagaaagcattaaaggagtaaaagaagtctggaaacaagctggaaaaggtcttttttaataaaagatataatagtatggcaattatattgttccaaatgtcaaaatttgtgattttttagaagtacttgctatttatcttcttaagtcttcattgatattctgtgtgaaataagcatgtcttgtacttgctttctgattcataattttatgaaagaacttagtagaaagaaaagtaagtataaaaatagatattggattctgtcagaaggcctagatttgaaataatgttttgtacttcggtaagatggaaaacttagtgattcactgatttcttagacactctaatatgatatgctttctggaaggataaaacaaatacatatgggaaaaagtacttgagaccaaggccagcatcaattccagacatcttcatgttcctaataggctaaatgaagttaaaaacttatttcagatttttctcatctgtaccttatatctcataaatttattgcatattttatgtcagtagcttagctgtttattgtctttaaaataacatgtaaacttcaatgttctatctggaagcagaataaaatatttacatagataccaaaaaa

SEQ ID NO: 456513 - DNA, 1961 bp, Homo sapiens
cgcgagagttcccaagcggtaggcggcggcgccgggagagaagcgccgtctagctgcgcttccgcaaagatggcggcggctgcgggtagctgcgcgcgggtggcggcctggggcggaaaactgcgacgggggctcgctgtcagccgacaggctgtgcggagtcccggccccttggcagcggcagtggccggcgcggccctggcaggagcaggagcggcctggcaccacagccgcgtcagtgttgcggcgcgggatggcagttttacagtctccgcacagaaaaatgttgaacatggaataatatatattgggaaaccgtctcttcgtaagcagcgcttcatgcagttttcttcactcgaacatgaaggagaatattatatgacaccacgagacttcctcttctcagtgatgtttgagcaaatggaacgtaaaacttcagtcaagaagctgacaaaaaaggacatcgaggatacactgtcagggatccaaacagctggctgtggatcaacttttttcagagaccttggcgataaagggctaatttcatataccgagtatcttttcttgcttacaatcctcactaaaccccattctggatttcatgttgcttttaaaatgctggatacagatggtaatgagatgattgaaaaaagggaattttttaaggattgatacaattgattctgaaaggcagctgcagaagatcataagtaaacaagatgacttgatgacagtgaaaactaatgaaactggatatcaggaagcaatagtgaaagaacctgaaattaacacaactcttcagatgcgtttctttggaaaaagaggacaaagaaaacttcattataaagaatttcgaagatttatggaaaatttacaaacagagattcaagaaatggaattccttcagttttctaaaggtttgagtttcatgagaaaagaagactttgcagagtggctactttttttcactaacactgaaaataaagatatttattggaaaaatgtgagagagaagttgtcagcaggagagagcattagtttggatgaattcaagtcattttgccattttacaacccacttggaagactttgctattgccatgcagatgttcagtttagctcatcgtcctgtcagactagcggagtttaagagagctgtgaaagtagcaacaggacaagaactctcaaacaatattttggacactgtctttaagatctttgatttggatggtgatgaatgtcttagtcatgaagagtttcttggggtgttaaaaaacagaatgcatcgaggtttatgggtaccacaacatcagagtatacaagaatactggaagtgtgtgaagaaagaaagcattaaaggagtaaaagaagtctggaaacaagctggaaaaggtcttttttaataaaagatataatagtatggcaattatattgttccaaatgtcaaaatttgtgattttttagaagtacttgctatttatcttcttaagtcttcattgatattctgtgtgaaataagcatgtcttgtacttgctttctgattcataattttatgaaagaacttagtagaaagaaaagtaagtataaaaatagatattggattctgtcagaaggcctagatttgaaataatgttttgtacttcggtaagatggaaaacttagtgattcactgatttcttagacactctaatatgatatgctttctggaaggataaaacaaatacatatgggaaaaagtacttgagaccaaggccagcatcaattccagacatcttcatgttcctaataggctaaatgaagttaaaaacttatttcagatttttctcatctgtaccttatatctcataaatttattgcatattttatgtcagtagcttagctgtttattgtctttaaaataacatgtaaacttcaatgttctatctggaagcagaataaaatatttacatagataccaaaaaa

SEQ ID NO: 456514 - DNA, 1934 bp, Homo sapiens
gacacaaagaaactttgtcaaaattggctgatatttgtacattttaatatatgtattttttcctgaagagctgtaaataataattgggaggggaacagggagcaggtagaggtatagaagagccaggaatagcagaatactggtaattattgaagattaataatgtttacatggtgacttgttgtagaattctgttcattttacttaagtttgaaattttctgtaataaaaatttgtaagaggttccaggggaataagcacagggagaaatgtttggatattgaacttggcattatatcatttgattgtcaactttaaaaataaaaggtaaaataaatataaagctttttaacttttttcccaaaaataattaagtaggggaaaggggggtattgaaaactggctgagagatttagagaactagaaataaaccacttgcctaaaacaaacgtaatagaaatagctaaattcaaaataattaatacggaattaattgcagcagttttcaaactgttaaatagcccagaaaaaaatgggtagaggtttgtctcctaattgatttgaatccatagtttgggattttgtctacatctgattcttttaaaatgctttcttttttaaatttgctttccatatgaggattgatacaattgattctgaaaggcagctgcagaagatcataagtaaacaagatgacttgatgacagtgaaaactaatgaaactggatatcaggaagcaatagtgaaagaacctgaaattaacacaactcttcagatgcgtttctttggaaaaagaggacaaagaaaacttcattataaagaatttcgaagatttatggaaaatttacaaacagagattcaagaaatggaattccttcagttttctaaaggtttgagtttcatgagaaaagaagactttgcagagtggctactttttttcactaacactgaaaataaagatatttattggaaaaatgtgagagagaagttgtcagcaggagagagcattagtttggatgaattcaagtcattttgccattttacaacccacttggaagactttgctattgccatgcagatgttcagtttagctcatcgtcctgtcagactagcggagtttaagagagctgtgaaagtagcaacaggacaagaactctcaaacaatattttggacactgtctttaagatctttgatttggatggtgatgaatgtcttagtcatgaagagtttcttggggtgttaaaaaacagaatgcatcgaggtttatgggtaccacaacatcagagtatacaagaatactggaagtgtgtgaagaaagaaagcattaaaggagtaaaagaagtctggaaacaagctggaaaaggtcttttttaataaaagatataatagtatggcaattatattgttccaaatgtcaaaatttgtgattttttagaagtacttgctatttatcttcttaagtcttcattgatattctgtgtgaaataagcatgtcttgtacttgctttctgattcataattttatgaaagaacttagtagaaagaaaagtaagtataaaaatagatattggattctgtcagaaggcctagatttgaaataatgttttgtacttcggtaagatggaaaacttagtgattcactgatttcttagacactctaatatgatatgctttctggaaggataaaacaaatacatatgggaaaaagtacttgagaccaaggccagcatcaattccagacatcttcatgttcctaataggctaaatgaagttaaaaacttatttcagatttttctcatctgtaccttatatctcataaatttattgcatattttatgtcagtagcttagctgtttattgtctttaaaataacatgtaaacttcaatgttctatctggaagcagaataaaatatttacatagataccaaaaaa

SEQ ID NO: 456515 - DNA, 1344 bp, Homo sapiens
cgcgagagttcccaagcggtaggcggcggcgccgggagagaagcgccgtctagctgcgcttccgcaaagatggcggcggctgcgggtagctgcgcgcgggtggcggcctggggcggaaaactgcgacgggggctcgctgtcagccgacaggctgtgcggagtcccggccccttggcagcggcagtggccggcgcggccctggcaggagcaggagcggcctggcaccacagccgcgtcagtgttgcggcgcgggatggcagttttacagtctccgcacagaaaaatgttgaacatggaataatatatattgggaaaccgtctcttcgtaagcagcgcttcatgcagttttcttcactcgaacatgaaggagaatattatatgacaccacgagacttcctcttctcagtgatgtttgagcaaatggaacgtaaaacttcagtcaagaagctgacaaaaaaggacatcgaggatacactgtcagggatccaaacagctggctgtggatcaacttttttcagagaccttggcgataaagggctaatttcatataccgagtatcttttcttgcttacaatcctcactaaaccccattctggatttcatgttgcttttaaaatgctggatacagatggtaatgagatgattgaaaaaagggaattttttaagctgcagaagatcataagtaaacaagatgacttgatgacagtgaaaactaatgaaactggatatcaggaagcaatagtgaaagaacctgaaattaacacaactcttcagatgcgtttctttggaaaaagaggacaaagaaaacttcattataaagaatttcgaagatttatggaaaatttacaaacagagattcaagaaatggaattccttcagttttctaaaggtttgagtttcatgagaaaagaagactttgcagagtggctactttttttcactaacactgaaaataaagatatttattggaaaaatgtgagagagaagttgtcagcaggagagagcattagtttggatgaattcaagtcattttgccattttacaacccacttggaagactttgctattgccatgcagatgttcagtttagctcatcgtcctgtcagactagcggagtttaagagagctgtgaaagtagcaacaggacaagaactctcaaacaatattttggacactgtctttaagatctttgatttggatggtgatgaatgtcttagtcatgaagagtttcttggggtgttaaaaaacagaatgcatcgaggtttatggtcccccacattccaaggttccgaaaactggaaggggtggagaaaggaacctttaaggcgtgaaggtggaaacctc

SEQ ID NO: 456516 - DNA, 1140 bp, Homo sapiens
aaactgaaggaattccatttcttgaatctctgttttctaaaggtttgagtttcatgagaaaagtagccactctgcaaagtcttcttttctcatgaaactcaaacctttagaaaactgaaggatttgcagagtggctactttttttcactaacactgaaaataaagatatttattggaaaaatgtgagagagaagttgtcagcaggagagagcattagtttggatgaattcaagtcattttgccattttacaacccacttggaagactttgctattgccatgcagatgttcagtttagctcatcgtcctgtcagactagcggagtttaagagagctgtgaaagtagcaacaggacaagaactctcaaacaatattttggacactgtctttaagatctttgatttggatggtgatgaatgtcttagtcatgaagagtttcttggggtgttaaaaaacagaatgcatcgaggtttatgggtaccacaacatcagagtatacaagaatactggaagtgtgtgaagaaagaaagcattaaaggagtaaaagaagtctggaaacaagctggaaaaggtcttttttaataaaagatataatagtatggcaattatattgttccaaatgtcaaaatttgtgattttttagaagtacttgctatttatcttcttaagtcttcattgatattctgtgtgaaataagcatgtcttgtacttgctttctgattcataattttatgaaagaacttagtagaaagaaaagtaagtataaaaatagatattggattctgtcagaaggcctagatttgaaataatgttttgtacttcggtaagatggaaaacttagtgattcactgatttcttagacactctaatatgatatgctttctggaaggataaaacaaatacatatgggaaaaagtacttgagaccaaggccagcatcaattccagacatcttcatgttcctaataggctaaatgaagttaaaaacttatttcagatttttctcatctgtaccttatatctcataaatttattgcatattttatgtcagtagcttagctgtttattgtctttaaaataacatgtaaacttcaatgttctatctggaagcagaataaaatatttacatagataccaaaaaa

SEQ ID NO: 456517 - DNA, 1442 bp, Homo sapiens
gatggaccaaggttcagatcctgattgttccagttagtagactttgggcaaactacataacccctgaagcgttacttacctaagacttagagaggctaaggtcatacacgttataaagggcagaaccggaatttcagcattaaaagtccatctaactccaaaactctgtgctcttactcagtgctatgtccactaataaaacttagcagaagtggaccacttaacagagtatgttagtctcttcaagctgccacctcaaaacaccacaggctgggcagcttaaacaataaatttatttctcttgcccagcctgcacacagcaccttctcactgtgccctttgtgtggccatttctgtgtgcacacagagagaaagggacagagaaagctctgttgtctcttcctcttagaatgatactagtctctacggtagaaaagaaagttcatagttaacatttataagattatttaatgtacttacaaaattgtaataaaaactcttactttattagagcattagtttggatgaattcaagtcattttgccattttacaacccacttggaagactttgctattgccatgcagatgttcagtttagctcatcgtcctgtcagactagcggagtttaagagagctgtgaaagtagcaacaggacaagaactctcaaacaatattttggacactgtctttaagatctttgatttggatggtgatgaatgtcttagtcatgaagagtttcttggggtgttaaaaaacagaatgcatcgaggtttatgggtaccacaacatcagagtatacaagaatactggaagtgtgtgaagaaagaaagcattaaaggagtaaaagaagtctggaaacaagctggaaaaggtcttttttaataaaagatataatagtatggcaattatattgttccaaatgtcaaaatttgtgattttttagaagtacttgctatttatcttcttaagtcttcattgatattctgtgtgaaataagcatgtcttgtacttgctttctgattcataattttatgaaagaacttagtagaaagaaaagtaagtataaaaatagatattggattctgtcagaaggcctagatttgaaataatgttttgtacttcggtaagatggaaaacttagtgattcactgatttcttagacactctaatatgatatgctttctggaaggataaaacaaatacatatgggaaaaagtacttgagaccaaggccagcatcaattccagacatcttcatgttcctaataggctaaatgaagttaaaaacttatttcagatttttctcatctgtaccttatatctcataaatttattgcatattttatgtcagtagcttagctgtttattgtctttaaaataacatgtaaacttcaatgttctatctggaagcagaataaaatatttacatagataccaaaaaa

SEQ ID NO: 456518 - DNA, 1322 bp, Homo sapiens
ctcatgcctgtaatcccagcactttgggagtccaaggtgggcggatcacaaagtcaggagttcaagaccagcctggccaacatggtgaaaccccatctctactaaaaatacaaaaactagctgggcgtggtggcaggcgcctgtaatcccagctattcaggaggccgaggcaagagaatcgcttgaacccgggagacggaggttgtagtgagtcaagatcgtgccattgcactccagcctgggcgacgagcaagattcatctcaaatatatgtttagagcattgattaaattacaatagctcatttgtcttgcagtgactctcatgacattcgtcggcttatggtttgaatattttcttcatgggtatttttgtttttgttttacttcccaaataataaaaatttggatttgcttttacttctcaaataatgaaaatttagattaatttcacttagactatttcacatagttgataagttgttttatgtttgttttttagcggagtttaagagagctgtgaaagtagcaacaggacaagaactctcaaacaatattttggacactgtctttaagatctttgatttggatggtgatgaatgtcttagtcatgaagagtttcttggggtgttaaaaaacagaatgcatcgaggtttatgggtaccacaacatcagagtatacaagaatactggaagtgtgtgaagaaagaaagcattaaaggagtaaaagaagtctggaaacaagctggaaaaggtcttttttaataaaagatataatagtatggcaattatattgttccaaatgtcaaaatttgtgattttttagaagtacttgctatttatcttcttaagtcttcattgatattctgtgtgaaataagcatgtcttgtacttgctttctgattcataattttatgaaagaacttagtagaaagaaaagtaagtataaaaatagatattggattctgtcagaaggcctagatttgaaataatgttttgtacttcggtaagatggaaaacttagtgattcactgatttcttagacactctaatatgatatgctttctggaaggataaaacaaatacatatgggaaaaagtacttgagaccaaggccagcatcaattccagacatcttcatgttcctaataggctaaatgaagttaaaaacttatttcagatttttctcatctgtaccttatatctcataaatttattgcatattttatgtcagtagcttagctgtttattgtctttaaaataacatgtaaacttcaatgttctatctggaagcagaataaaatatttacatagataccaaaaaa

SEQ ID NO: 456519 - DNA, 1462 bp, Homo sapiens
aactttgcagttatccaacacccataaatatattccgggaaattaagccagtcttttcagttcacaattgagtgtacctgggagtctccttgccctttctcagaagacattaaaaagaaaagctgtaaatcagtcataagaaaaagaacatatataatctggagtagaattttgcttccacttggctaattttcatcagtgctatgctcctgtggtcccccggatccaaatatttcctaacctttaccttttcattttgttgagagtagtagtaatccacatgtatttttagctaacaaaacacgtccatgaattagattatttcttgaagcttttcatcaaatactttgtggccttttttttttttaattttagccaatgttaaatcaaagctttaggcttataattgtattctacatagctaaacaaagttcaccagaaaaaaagggaaagattataaaacattataaaaggaaaacattataaagtaattaaattttaaagccagtatgtgaaagaagagatggcccaaagtcttcattaccctcttagagaagaaactccattaatgtgtgctcagtctggttccactccctagtaaccttaagcatagttacattcactttttgtcttttacccccattttcagttctgttgtgatcatcttttacaacataattcaccctcaactatttttggaggagtgtgggaaggaaataaacagtaacgtaaagtatatatgaaatcatgtttaaccttgaagacaatgaccccttgatttttactttcggttaacaggtaccacaacatcagagtatacaagaatactggaagtgtgtgaagaaagaaagcattaaaggagtaaaagaagtctggaaacaagctggaaaaggtcttttttaataaaagatataatagtatggcaattatattgttccaaatgtcaaaatttgtgattttttagaagtacttgctatttatcttcttaagtcttcattgatattctgtgtgaaataagcatgtcttgtacttgctttctgattcataattttatgaaagaacttagtagaaagaaaagtaagtataaaaatagatattggattctgtcagaaggcctagatttgaaataatgttttgtacttcggtaagatggaaaacttagtgattcactgatttcttagacactctaatatgatatgctttctggaaggataaaacaaatacatatgggaaaaagtacttgagaccaaggccagcatcaattccagacatcttcatgttcctaataggctaaatgaagttaaaaacttatttcagatttttctcatctgtaccttatatctcataaatttattgcatattttatgtcagtagcttagctgtttattgtctttaaaataacatgtaaacttcaatgttctatctggaagcagaataaaatatttacatagataccaaaaaa

SEQ ID NO: 456520 - DNA, 431 bp, Homo sapiens
gcagaaccggaatttcagcattaaaagtccatctaactccaaaactctgtgctcttactcagtgctatgtccactaataaaacttagcagaagtggaccacttaacagagtatgttagtctcttcaagctgccacctcaaaacaccacaggctgggcagcttaaacaataaatttatttctcacagttctggaggccaggagtccaagatcaaggcaccagcagggccagtttctggtgaggcctcttgcccagcctgcacacagcaccttctcactgtgccctttgtgtggccatttctgtgtgcacacagagagaaagggacagagaaagctctgttgtctcttcctcttagaatgatactagtctctacggtagaaaagaaagttcatagttaacatttataagattatttaatgtacttacaaaatt

SEQ ID NO: 456521 - DNA, 333 bp, Homo sapiens
aattgcaatttatttttcttttagaaaaatgttgaacatggaataatatatattgggaaaccgtctcttcgtaagcagcgcttcatgcagttttcttcactcgaacatgaaggagaatattatatgacaccacgagacttcctcttctcagtgatgtttgagcaaatggaacgtgagttgggtcttttttttttttaattaaaaaaatcagacttcagggctgaaaaacctgtttttcaggattgataacagcttttcttcattttaattatcatctttgtaccatgcatttgcttatttagacttttcttgtgacactacttatacttttat

SEQ ID NO: 456522 - DNA, 373 bp, Homo sapiens
tataaaaatagatattggattctgtcagaaggcctagatttgaaataatgttttgtacttcggtaagatggaaaacttagtgattcactgatttcttagacactctaatatgatatgctttctggaaggataaaacaaatacatatgggaaaaagtacttgagaccaaggccagcatcaattccagacatcttcatgttcctaataggctaaatgaagttaaaaacttatttcagatttttctcatctgtaccttatatctcataaatttattgcatattttatgtcagtagcttagctgtttattgtctttaaaataacatgtaaacttcaatgttctatctggaagcagaataaaatatttacatagatac

SEQ ID NO: 456523 - DNA, 1933 bp, Homo sapiens
cgcgagagttcccaagcggtaggcggcggcgccgggagagaagcgccgtctagctgcgcttccgcaaagatggcggcggctgcgggtagctgcgcgcgggtggcggcctggggcggaaaactgcgacgggggctcgctgtcagccgacaggctgtgcggagtcccggccccttggcagcggcagtggccggcgcggccctggcaggagcaggagcggcctggcaccacagccgcgtcagtgttgcggcgcgggatggcagttttacagtctccgcacagaaaaatgttgaacatggaataatatatattgggaaaccgtctcttcgtaagcagcgcttcatgcagttttcttcactcgaacatgaaggagaatattatatgacaccacgagacttcctcttctcagtgatgtttgagcaaatggaacgtaaaacttcagtcaagaagctgacaaaaaaggacatcgaggatacactgtcagggatccaaacagctggctgtggatcaacttttttcagagaccttggcgataaagggctaatttcatataccgagtatcttttcttgcttacaatcctcactaaaccccattctggatttcatgttgcttttaaaatgctggatacagatggtaatgagatgattgaaaaaagggaattttttaagctgcagaagatcataagtaaacaagatgacttgatgacagtgaaaactaatgaaactggatatcaggaagcaatagtgaaagaacctgaaattaacacaactcttcagatgcgtttctttggaaaaagaggacaaagaaaacttcattataaagaatttcgaagatttatggaaaatttacaaacagagattcaagaaatggaattccttcagttttctaaaggtttgagtttcatgagaaaagaagactttgcagagtggctactttttttcactaacactgaaaataaagatatttattggaaaaatgtgagagagaagttgtcagcaggagagagcattagtttggatgaattcaagtcattttgccattttacaacccacttggaagactttgctattgccatgcagatgttcagtttagctcatcgtcctgtcagactagcggagtttaagagagctgtgaaagtagcaacaggacaagaactctcaaacaatattttggacactgtctttaagatctttgatttggatggtgatgaatgtcttagtcatgaagagtttcttggggtgttaaaaaacagaatgcatcgaggtttatgggtaccacaacatcagagtatacaagaatactggaagtgtgtgaagaaagaaagcattaaaggagtaaaagaagtctggaaacaagctggaaaaggtcttttttaataaaagatataatagtatggcaattatattgttccaaatgtcaaaatttgtgattttttagaagtacttgctatttatcttcttaagtcttcattgatattctgtgtgaaataagcatgtcttgtacttgctttctgattcataattttatgaaagaacttagtagaaagaaaagtaagtataaaaatagatattggattctgtcagaaggcctagatttgaaataatgttttgtacttcggtaagatggaaaacttagtgattcactgatttcttagacactctaatatgatatgctttctggaaggataaaacaaatacatatgggaaaaagtacttgagaccaaggccagcatcaattccagacatcttcatgttcctaataggctaaatgaagttaaaaacttatttcagatttttctcatctgtaccttatatctcataaatttattgcatattttatgtcagtagcttagctgtttattgtctttaaaataacatgtaaacttcaatgttctatctggaagcagaataaaatatttacatagataccaaaaaa

SEQ ID NO: 456524 - DNA, 2125 bp, Homo sapiens
  misc_feature (1942)..(1943): n is a, c, g, or t
cgcgagagttcccaagcggtaggcggcggcgccgggagagaagcgccgtctagctgcgcttccgcaaagatggcggcggctgcgggtagctgcgcgcgggtggcggcctggggcggaaaactgcgacgggggctcgctgtcagccgacaggctgtgcggagtcccggccccttggcagcggcagtggccggcgcggccctggcaggagcaggagcggcctggcaccacagccgcgtcagtgttgcggcgcgggatggcagttttacagtctccgcacagaaaaatgttgaacatggaataatatatattgggaaaccgtctcttcgtaagcagcgcttcatgcagttttcttcactcgaacatgaaggagaatattatatgacaccacgagacttcctcttctcagtgatgtttgagcaaatggaacgtaaaacttcagtcaagaagctgacaaaaaaggacatcgaggatacactgtcagggatccaaacagctggctgtggatcaacttttttcagagaccttggcgataaagggctaatttcatataccgagtatcttttcttgcttacaatcctcactaaaccccattctggatttcatgttgcttttaaaatgctggatacagatggtaatgagatgattgaaaaaagggaattttttaagctgcagaagatcataagtaaacaagatgacttgatgacagtgaaaactaatgaaactggatatcaggaagcaatagtgaaagaacctgaaattaacacaactcttcagatgcgtttctttggaaaaagaggacaaagaaaacttcattataaagaatttcgaagatttatggaaaatttacaaacagagattcaagaaatggaattccttcagttttctaaaggtttgagtttcatgagaaaagaagactttgcagagtggctactttttttcactaacactgaaaataaagatatttattggaaaaatgtgagagagaagttgtcagcaggagagagcattagtttggatgaattcaagtcattttgccattttacaacccacttggaagactttgctattgccatgcagatgttcagtttagctcatcgtcctgtcagactagcggagtttaagagagctgtgaaagtagcaacaggacaagaactctcaaacaatattttggacactgtctttaagatctttgatttggatggtgatgaatgtcttagtcatgaagagtttcttggggtgttaaaaaacagaatgcatcgaggtttatgggtaccacaacatcagagtatacaagaatactggaagtgtgtgaagaaagaaagcattaaaggagtaaaagaagtctggaaacaagctggaaaaggtcttttttaataaaagatataatagtatggcaattatattgttccaaatgtcaaaatttgtgattttttagaagtacttgctatttatcttcttaagtcttcattgatattctgtgtgaaataagcatgtcttgtacttgctttctgattcataattttatgaaagaacttagtagaaagaaaagtaagtataaaaatagatattggattctgtcagaaggcctagatttgaaataatgttttgtacttcggtaagatggaaaacttagtgattcactgatttcttagacactctaatatgatatgctttctggaaggataaaacaaatacatatgggaaaaagtacttgagaccaaggccagcatcaattccagacatcttcatgttcctaataggctaaatgaagttaaaaacttatttcagatttttctcatctgtaccttatatctcataaatttattgcatattttatgtcagtagcttagctgtttattgtctttaaaataacatgtaaacttcaatgttctatctggaagcagaataaaatatttacatagataccaaaaaaaaaaaagannaaaaaaaaatttttgggcgcgtgggccgcgaaaaatttttagaccattggtgtggggcgggggcccatgtgttagtgaactggttcatggggtctaaggaaatgtgtccatgggtctggtttcccataaagccgggggaccgggttgaacatcatggtggggttggtttagggcaggacata

SEQ ID NO: 456525 - DNA, 1847 bp, Homo sapiens
agcgggggagaaccccgcggacgctgaacaccacggcccacaaaactggccgcactaatttagtggtgatgagtgtgggcgtgtcttaattcgaggctcctaattcagaatctcactgcgcctcgcctcttgctacctctctgcaaggcaatgtacttctacagaagagtgcgcccttacagatggaacaatgaaaaatgttgaacatggaataatatatattgggaaaccgtctcttcgtaagcagcgcttcatgcagttttcttcactcgaacatgaaggagaatattatatgacaccacgagacttcctcttctcagtgatgtttgagcaaatggaacgtaaaacttcagtcaagaagctgacaaaaaaggacatcgaggatacactgtcagggatccaaacagctggctgtggatcaacttttttcagagaccttggcgataaagggctaatttcatataccgagtatcttttcttgcttacaatcctcactaaaccccattctggatttcatgttgcttttaaaatgctggatacagatggtaatgagatgattgaaaaaagggaattttttaagctgcagaagatcataagtaaacaagatgacttgatgacagtgaaaactaatgaaactggatatcaggaagcaatagtgaaagaacctgaaattaacacaactcttcagatgcgtttctttggaaaaagaggacaaagaaaacttcattataaagaatttcgaagatttatggaaaatttacaaacagagattcaagaaatggaattccttcagttttctaaaggtttgagtttcatgagaaaagaagactttgcagagtggctactttttttcactaacactgaaaataaagatatttattggaaaaatgtgagagagaagttgtcagcaggagagagcattagtttggatgaattcaagtcattttgccattttacaacccacttggaagactttgctattgccatgcagatgttcagtttagctcatcgtcctgtcagactagcggagtttaagagagctgtgaaagtagcaacaggacaagaactctcaaacaatattttggacactgtctttaagatctttgatttggatggtgatgaatgtcttagtcatgaagagtttcttggggtgttaaaaaacagaatgcatcgaggtttatgggtaccacaacatcagagtatacaagaatactggaagtgtgtgaagaaagaaagcattaaaggagtaaaagaagtctggaaacaagctggaaaaggtcttttttaataaaagatataatagtatggcaattatattgttccaaatgtcaaaatttgtgattttttagaagtacttgctatttatcttcttaagtcttcattgatattctgtgtgaaataagcatgtcttgtacttgctttctgattcataattttatgaaagaacttagtagaaagaaaagtaagtataaaaatagatattggattctgtcagaaggcctagatttgaaataatgttttgtacttcggtaagatggaaaacttagtgattcactgatttcttagacactctaatatgatatgctttctggaaggataaaacaaatacatatgggaaaaagtacttgagaccaaggccagcatcaattccagacatcttcatgttcctaataggctaaatgaagttaaaaacttatttcagatttttctcatctgtaccttatatctcataaatttattgcatattttatgtcagtagcttagctgtttattgtctttaaaataacatgtaaacttcaatgttctatctggaagcagaataaaatatttacatagataccaaaaaa

SEQ ID NO: 456526 - DNA, 1338 bp, Homo sapiens
cgcgagagttcccaagcggtaggcggcggcgccgggagagaagcgccgtctagctgcgcttccgcaaagatggcggcggctgcgggtagctgcgcgcgggtggcggcctggggcggaaaactgcgacgggggctcgctgtcagccgacaggctgtgcggagtcccggccccttggcagcggcagtggccggcgcggccctggcaggagcaggagcggcctggcaccacagccgcgtcagtgttgcggcgcgggatggcagttttacagtctccgcacagaaaaatgttgaacatggaataatatatattgggaaaccgtctcttcgtaagcagcgcttcatgcagttttcttcactcgaacatgaaggagaatattatatgacaccacgagacttcctcttctcagtgatgtttgagcaaatggaacgtaaaacttcagtcaagaagctgacaaaaaaggacatcgaggatacactgtcagggatccaaacagctggctgtggatcaacttttttcagagaccttggcgataaagggctaatttcatataccgagtatcttttcttgcttacaatcctcactaaaccccattctggatttcatgttgcttttaaaatgctggatacagatggtaatgagatgattgaaaaaagggaattttttaagctgcagaagatcataagtaaacaagatgacttgatgacagtgaaaactaatgaaactggatatcaggaagcaatagtgaaagaacctgaaattaacacaactcttcagatgcgtttctttggaaaaagaggacaaagaaaacttcattataaagaatttcgaagatttatggaaaatttacaaacagagattcaagaaatggaattccttcagttttctaaaggtttgagtttcatgagaaaagaagactttgcagagtggctactttttttcactaacactgaaaataaagatatttattggaaaaatgtgagagagaagttgtcagcaggagagagcattagtttggatgaattcaagtcattttgccattttacaacccacttggaagactttgctattgccattgcgaaggttcaattaacttatatggccggtaggcaacggggggttaaagagaggtggaaggggcacacgggcagagaccttaacaataatttgggcaacggcttaaaaaccttgtttggattggaggaaagtgctaaacaatgagagagttttgtgggggtaaaaaccaaagcgctccgggtttgtggggcccaacacttcagggtttccgaatactttgagtgggtgaaaagaaccttttaggggtggaagttggcacctttg

SEQ ID NO: 456527 - DNA, 990 bp, Homo sapiens
atctcatctcccagacgccacgtctctcggtttcttcttagatcactcctctgccaaagatcccaacaagacaacatggctcccaagaagcctgagcctaagaaggaggcagccaagccagctccagctccagctccagcccctgcaccagcccctgccccagctcctgaggctcccaaggaacctgcctttgaccccaagagtgtaaagatagacttcactgccgaccagattgaagagttcaaagaggccttttcattgtttgaccggaccccgactggagagatgaagatcacctacggccagtgcggggatgtactgcgggccctgggcagaaaccctaccaatgccgaggtgctgcgtgtgctgggcaagcccaagcctgaagagatgaatgtcaagatgctggactttgagacgttcttgcccatcctgcagcacatttcccgcaacaaggagcagggcacctatgaggacttcgtggagggcctgcgtgtctttgacaaggagagcaatggcacggtcatgggtgctgagcttcggcacgtccttgccaccctgggagagaagatgactgaggctgaagtggagcagctgttagctgggcaagaggatgccaatggctgcatcaattatgaagcctttgtcaagcacatcatgtcagggtgaagcagagtcttccaggtgcctggcccttggctttagccataccagggtgagttaaagagaggccccggctgggtgagctgagatggagtcctcgacttatcaccacaccactgccccaaggaccttacaggccctccctgttaataaacagctctaacacggccaggctgggctctgggattctgagaccgcaagaccaacccttcctcctcctcagcctactcaacctgaagacaaggaagatgaaggccttgaagattatccacttccacttactagtaaatatattttcttttccttatgattttcttaatttttttc

SEQ ID NO: 456528 - DNA, 1061 bp, Homo sapiens
caactgctcaagtcagctcatctctctggctgctccggcatatttgagaaggtctgtttccctggtccttctgggtttccaccaattggcaagaagggatcagcctgtcctagagactcctctgccaaagatcccaacaagacaacatggctcccaagaagcctgagcctaagaaggaggcagccaagccagctccagctccagctccagcccctgcaccagcccctgccccagctcctgaggctcccaaggaacctgcctttgaccccaagagtgtaaagatagacttcactgccgaccagattgaagagttcaaagaggccttttcattgtttgaccggaccccgactggagagatgaagatcacctacggccagtgcggggatgtactgcgggccctgggcagaaaccctaccaatgccgaggtgctgcgtgtgctgggcaagcccaagcctgaagagatgaatgtcaagatgctggactttgagacgttcttgcccatcctgcagcacatttcccgcaacaaggagcagggcacctatgaggacttcgtggagggcctgcgtgtctttgacaaggagagcaatggcacggtcatgggtgctgagcttcggcacgtccttgccaccctgggagagaagatgactgaggctgaagtggagcagctgttagctgggcaagaggatgccaatggctgcatcaattatgaagcctttgtcaagcacatcatgtcagggtgaagcagagtcttccaggtgcctggcccttggctttagccataccagggtgagttaaagagaggccccggctgggtgagctgagatggagtcctcgacttatcaccacaccactgccccaaggaccttacaggccctccctgttaataaacagctctaacacggccaggctgggctctgggattctgagaccgcaagaccaacccttcctcctcctcagcctactcaacctgaagacaaggaagatgaaggccttgaagattatccacttccacttactagtaaatatattttcttttccttatgattttcttaatttttttc

SEQ ID NO: 456529 - DNA, 962 bp, Homo sapiens
atctcatctcccagacgccacgtctctcggtttcttcttagatcactcctctgccaaagatcccaacaagacaacatggctcccaagaagcctgagcctaagaaggaggcagccaagccagctccagctccagctccagcccctgcaccagcccctgccccagctcctgaggctcccaaggaacctgcctttgaccccaagagtgtaaagagttcaaagaggccttttcattgtttgaccggaccccgactggagagatgaagatcacctacggccagtgcggggatgtactgcgggccctgggcagaaaccctaccaatgccgaggtgctgcgtgtgctgggcaagcccaagcctgaagagatgaatgtcaagatgctggactttgagacgttcttgcccatcctgcagcacatttcccgcaacaaggagcagggcacctatgaggacttcgtggagggcctgcgtgtctttgacaaggagagcaatggcacggtcatgggtgctgagcttcggcacgtccttgccaccctgggagagaagatgactgaggctgaagtggagcagctgttagctgggcaagaggatgccaatggctgcatcaattatgaagcctttgtcaagcacatcatgtcagggtgaagcagagtcttccaggtgcctggcccttggctttagccataccagggtgagttaaagagaggccccggctgggtgagctgagatggagtcctcgacttatcaccacaccactgccccaaggaccttacaggccctccctgttaataaacagctctaacacggccaggctgggctctgggattctgagaccgcaagaccaacccttcctcctcctcagcctactcaacctgaagacaaggaagatgaaggccttgaagattatccacttccacttactagtaaatatattttcttttccttatgattttcttaatttttttc

SEQ ID NO: 456530 - DNA, 1441 bp, Homo sapiens
atctcatctcccagacgccacgtctctcggtttcttcttagatcactcctctgccaaagatcccaacaagacaacatggctcccaagaagcctgagcctaagaaggaggcagccaagccagctccagctccagctccagcccctgcaccagcccctgccccagctcctgaggctcccaaggaacctgcctttgaccccaagagtgtaaagatagacttcactgccgaccagattgaagagttcaaagaggccttttcattgtttgaccggaccccgactggagagatgaagatcacctacggccagtgcggggatgtactgcgggccctgggcagaaaccctaccaatgccgaggtgctgcgtgtgctgggcaagcccaagcctgaagagatgaatgtcaagatgctggactttgagacgttcttgcccatcctgcagcacatttcccgcaacaaggagcagggcacctatgaggacttcgtggagggcctgcgtgtctttgacaaggagagcaatggcacggtcatgggtgctgagcttcggcacgtccttgccaccctgggagagaagatgactgaggctgaagtggagcagctgttagctgggcaagaggatgccaatggctgcatcaattatgaagcctttgtcaagcacatcatgtcagggtgaagcagagtcttccaggtgagtgcagcctctccctcctggtcccttccggggtcacatagggccttaagaataacaccatgtgccctagaaggcatctgtcccagccctgaccccttaagaggaaacctcttgggatcaggaagtgaggacagccctgctcactcaccatctcctgtctcctgcctgcccttgcctgttcaccctgtcttgaccctatcagtcacatcctcttgcctctcccaggatctctcaaggcaatgcccttccctcaggcctggggcctcctgtacaggctcctgggagtgagaaagccgatcccaagtggaagagaaggtccctggcctgtgctcttgaccccgttcttcctcacttctttccctaggttttccctgggatccccctgggtgtggtaaggggctgggtctaggagggtgaaatgccctttcctcctagcactttctttcaggtgcctggcccttggctttagccataccagggtgagttaaagagaggccccggctgggtgagctgagatggagtcctcgacttatcaccacaccactgccccaaggaccttacaggccctccctgttaataaacagctctaacacggccaggctgggctctgggattctgagaccgcaagaccaacccttcctcctcctcagcctactcaacctgaagacaaggaagatgaaggccttgaagattatccacttccacttactagtaaatatattttcttttccttatgattttcttaatttttttc

SEQ ID NO: 456531 - DNA, 734 bp, Homo sapiens
atctcatctcccagacgccacgtctctcggtttcttcttagatcactcctctgccaaagatcccaacaagacaacatggctcccaagaagcctgagcctaagaaggaggcagccaagccagctccagctccagctccagcccctgcaccagcccctgccccagctcctgaggctcccaaggaacctgcctttgaccccaagagtgtaaagatagacttcactgccgaccagattgaagagttcaaagaggccttttcattgtttgaccggaccccgactggagagatgaagatcacctacggccagtgcggggatgtactgcgggccctgggcagaaaccctaccaatgccgaggtgctgcgtgtgctgggcaagcccaagcctgaagagatgaatgtcaagatgctggactttgagacgttcttgcccatcctgcagcacatttcccgcaacaaggagcagggcacctatgaggacttcgtggagggcctgcgtgtctttgacaaggagagcaatggcacggtcatgggtgctgagcttcggcacgtccttgccaccctgggagagaagatgactgaggctgaagtggagcagctgttagctgggcaagaggatgccaatggctgcatcaattatgaagtttcccaaattgctttccctgctgccttcctgcccccactgacccaatacgggaccctgtactctcaaggtcacgccacttctcttctgtttct

SEQ ID NO: 456532 - DNA, 951 bp, Homo sapiens
atctcatctcccagacgccacgtctctcggtttcttcttagatcactcctctgccaaagatcccaacaagacaacatggctcccaagaagcctgagcctaagaaggaggcagccaagccagctccagctccagctccagcccctgcaccagcccctgccccagctcctgaggctcccaaggaacctgcctttgaccccaagagtgtaaagatagacttcactgccgaccagattgaagagttcaaagaggccttttcattgtttgaccggaccccgactggagagatgaagatcacctacggccagtgcggggatgtactgcgggccctgggcagaaaccctaccaatgccgaggtgctgcgtgtgctgggcaagcccaagcctgaagagatgaatgtcaagatgctggactttgagacgttcttgcccatcctgcagcacatttcccgcaacaaggagcagggcacctatgaggacttcgtggagggcctgcgtgtctttgacaaggagagcaatggcacgggagagaagatgactgaggctgaagtggagcagctgttagctgggcaagaggatgccaatggctgcatcaattatgaagcctttgtcaagcacatcatgtcagggtgaagcagagtcttccaggtgcctggcccttggctttagccataccagggtgagttaaagagaggccccggctgggtgagctgagatggagtcctcgacttatcaccacaccactgccccaaggaccttacaggccctccctgttaataaacagctctaacacggccaggctgggctctgggattctgagaccgcaagaccaacccttcctcctcctcagcctactcaacctgaagacaaggaagatgaaggccttgaagattatccacttccacttactagtaaatatattttcttttccttatgattttcttaatttttttc

SEQ ID NO: 456533 - DNA, 568 bp, Homo sapiens
  misc_feature (366)..(366): n is a, c, g, or t
atctcatctcccagacgccacgtctctcggtttcttcttagatcactcctctgccaaagatcccaacaagacaacatggctcccaagaagcctgagcctaagaaggaggcagccaagccagctccagctccagctccagcccctgcaccagcccctgccccagctcctgaggctcccaaggaacctgcctttgaccccaagagtgtaaagatagacttcaggcagcctatgggacgcagggcccatctgtccctcggtcgccgtgtggcagagtgggtccgtcgtccccaacactcgtgctcgctcagacactttggcaggatgtctggggcctcaccagcaggaagcgcgtgcaagccgggcagnggctccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaactcagaactggtctatttggtgtcgtgg

SEQ ID NO: 456534 - DNA, 364 bp, Homo sapiens
gtcagtgcggctgcatggcagacctctcccagggtcaggcttgcagccccttggcttcctccttgtccagatcttctctgccatctgcactctctcttctcctgctttagcccctcaggaccagcctcacctacccagcttaccctagtcccattttgagaatttatctagacgtccccgtacttaagtgacccttgaggaatgtagcctgggcttgtttccctcacgaggttgggagctcctgtggggcatgagccacattctgttgcctcagtgtctgaggaaggctgagtgggaatctggaaatctgataactgatggttcccactccccagcccaggagctctcaggaggggcatctgtc

SEQ ID NO: 456535 - DNA, 1335 bp, Homo sapiens
tgtgatctcttagcagaatagatttattatttgattgcttgcagaataaagcctatccttgaaagctctgcatcatgggcagtgagctcagtggtatctggaggacagggcactggccactccagtcaccatcttctgccaggaagcctgcacctcaggggtgaattctttgccgaaatggattgccaaaacggtcaccagcacatttcccaggagcttgaagttctcaggatccacatgcagcttgtcacagtgcagttcactcagctgggcaaaggtgcccttgagatcatccaggtgctttatggcatctcccaaggaagtcagcaccttcttgccatgtgccttgactttggggttgcccatgatggcagaggcagaggacaggtactcctctgccaaagatcccaacaagacaacatggctcccaagaagcctgagcctaagaaggaggcagccaagccagctccagctccagctccagcccctgcaccagcccctgccccagctcctgaggctcccaaggaacctgcctttgaccccaagagtgtaaagatagacttcactgccgaccagattgaagagttcaaagaggccttttcattgtttgaccggaccccgactggagagatgaagatcacctacggccagtgcggggatgtactgcgggccctgggcagaaaccctaccaatgccgaggtgctgcgtgtgctgggcaagcccaagcctgaagagatgaatgtcaagatgctggactttgagacgttcttgcccatcctgcagcacatttcccgcaacaaggagcagggcacctatgaggacttcgtggagggcctgcgtgtctttgacaaggagagcaatggcacggtcatgggtgctgagcttcggcacgtccttgccaccctgggagagaagatgactgaggctgaagtggagcagctgttagctgggcaagaggatgccaatggctgcatcaattatgaagcctttgtcaagcacatcatgtcagggtgaagcagagtcttccaggtgcctggcccttggctttagccataccagggtgagttaaagagaggccccggctgggtgagctgagatggagtcctcgacttatcaccacaccactgccccaaggaccttacaggccctccctgttaataaacagctctaacacggccaggctgggctctgggattctgagaccgcaagaccaacccttcctcctcctcagcctactcaacctgaagacaaggaagatgaaggccttgaagattatccacttccacttactagtaaatatattttcttttccttatgattttcttaatttttttc

SEQ ID NO: 456536 - DNA, 997 bp, Homo sapiens
caactgctcaagtcagctcatctctctggctgctccggcatatttgagaagactcctctgccaaagatcccaacaagacaacatggctcccaagaagcctgagcctaagaaggaggcagccaagccagctccagctccagctccagcccctgcaccagcccctgccccagctcctgaggctcccaaggaacctgcctttgaccccaagagtgtaaagatagacttcactgccgaccagattgaagagttcaaagaggccttttcattgtttgaccggaccccgactggagagatgaagatcacctacggccagtgcggggatgtactgcgggccctgggcagaaaccctaccaatgccgaggtgctgcgtgtgctgggcaagcccaagcctgaagagatgaatgtcaagatgctggactttgagacgttcttgcccatcctgcagcacatttcccgcaacaaggagcagggcacctatgaggacttcgtggagggcctgcgtgtctttgacaaggagagcaatggcacggtcatgggtgctgagcttcggcacgtccttgccaccctgggagagaagatgactgaggctgaagtggagcagctgttagctgggcaagaggatgccaatggctgcatcaattatgaagcctttgtcaagcacatcatgtcagggtgaagcagagtcttccaggtgcctggcccttggctttagccataccagggtgagttaaagagaggccccggctgggtgagctgagatggagtcctcgacttatcaccacaccactgccccaaggaccttacaggccctccctgttaataaacagctctaacacggccaggctgggctctgggattctgagaccgcaagaccaacccttcctcctcctcagcctactcaacctgaagacaaggaagatgaaggccttgaagattatccacttccacttactagtaaatatattttcttttccttatgattttcttaatttttttc

SEQ ID NO: 456537 - DNA, 819 bp, Homo sapiens
atctcatctcccagacgccacgtctctcggtttcttcttagatcactcctctgccaaagatcccaacaagacaacatggctcccaagaagcctgagcctaagaaggaggcagccaagccagctccagctccagctccagcccctgcaccagcccctgccccagctcctgaggctcccaaggaacctgcctttgaccccaagagtgtaaagatagacttcactgccgaccagattgaagagttcaaagaggccttttcattgtttgaccggaccccgactggagagatgaagatcacctacggccagtgcggggatgtactgcgggccctgggcagaaaccctaccaatgccgaggtgctgcgtgtgctgggcaagcccaagcctgaagagatgaatgtcaagatgctggactttgagacgttcttgcccatcctgcagcacatttcccgcaacaaggagcagggcacctatgaggacttcgtggagggcctgcgtgtctttgacaaggagagcaatggcacggtcatgggtgctgagcttcggcacgtccttgccaccctgggagagaagatgactgaggctgaagtggagcagctgttagctgggcaagaggatgccaatggctgcatcaattatgaagcctttgtcaagcacatcatgtcagggtgaagcagagtcttccaggaccgcaagaccaacccttcctcctcctcagcctactcaacctgaagacaaggaagatgaaggccttgaagattatccacttccacttactagtaaatatattttcttttccttatgattttcttaatttttttc

SEQ ID NO: 456538 - DNA, 917 bp, Homo sapiens
atctcatctcccagacgccacgtctctcggtttcttcttagatcactcctctgccaaagatcccaacaagacaacatggctcccaagaagcctgagcctaagaaggaggcagccaagccagctccagctccagctccagcccctgcaccagcccctgccccagctcctgaggctcccaaggaacctgcctttgaccccaagagtgtaaagatagacttcactgccgaccagattgaagagttcaaagaggccttttcattgtttgaccggaccccgactggagagatgaagatcacctacggccagtgcggggatgtactgcgggccctgggcagaaaccctaccaatgccgaggtgctgcgtgtgctgggcaagcccaagcctgaagagatgaatgtcaagatgctggactttgagacgttcttgcccatcctgcagcacatttcccgcaacaaggagcagggcacctatgaggacttcgtggagggcctgcgtgtctttgacaaggagagcaatggcacgggttagctgggcaagaggatgccaatggctgcatcaattatgaagcctttgtcaagcacatcatgtcagggtgaagcagagtcttccaggtgcctggcccttggctttagccataccagggtgagttaaagagaggccccggctgggtgagctgagatggagtcctcgacttatcaccacaccactgccccaaggaccttacaggccctccctgttaataaacagctctaacacggccaggctgggctctgggattctgagaccgcaagaccaacccttcctcctcctcagcctactcaacctgaagacaaggaagatgaaggccttgaagattatccacttccacttactagtaaatatattttcttttccttatgattttcttaatttttttc

SEQ ID NO: 456539 - DNA, 1015 bp, Homo sapiens
tgtgatctcttagcagaatagatttattatttgattgcttgcagaataaagcctatccttgaaagctctgcatcatgggcagtgagctcagtggtatctggaggacagggcactggccactccagtcaccatcttctgccaggaagcctgcacctcaggggtgaattctttgccgaaatggattgccaaaacggtcaccagcacatttcccaggagcttgaagttctcaggatccacatgcagcttgtcacagtgcagttcactcagctgggcaaaggtgcccttgagatcatccaggtgctttatggcatctcccaaggaagtcagcaccttcttgccatgtgccttgactttggggttgcccatgatggcagaggcagaggacaggtactcctctgccaaagatcccaacaagacaacatggctcccaagaagcctgagcctaagaaggaggcagccaagccagctccagctccagctccagcccctgcaccagcccgacttcgtggagggcctgcgtgtctttgacaaggagagcaatggcacggtcatgggtgctgagcttcggcacgtccttgccaccctgggagagaagatgactgaggctgaagtggagcagctgttagctgggcaagaggatgccaatggctgcatcaattatgaagcctttgtcaagcacatcatgtcagggtgaagcagagtcttccaggtgcctggcccttggctttagccataccagggtgagttaaagagaggccccggctgggtgagctgagatggagtcctcgacttatcaccacaccactgccccaaggaccttacaggccctccctgttaataaacagctctaacacggccaggctgggctctgggattctgagaccgcaagaccaacccttcctcctcctcagcctactcaacctgaagacaaggaagatgaaggccttgaagattatccacttccacttactagtaaatatattttcttttccttatgattttcttaatttttttc

SEQ ID NO: 456540 - DNA, 1049 bp, Homo sapiens
ctcggctctgcccctcgacagtctgcagtctacggcgaggcacaggccagcccagctccacgaggactgaacaaggtgctgtctcactgccaccatgccggaagtcgagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccaaatgcctccacaacaccagggagattaaggacctgaagctgaaggtgatggacctccgtgggaagttcaagcgcccgcccctgcgtcgagtccgtgtctcggctgacgccatgctccgggccctgctgggctccaagcacaaggtgtccatggatctgcgggccaacctcaagtctgtgaagaaggaagacacagagaaggagcggcctgtggaggtgggtgactggaggaagaacgtggaggccatgtctggcatggaaggccggaagaagatgtttgatgccgccaagtctccgacctcacaatagaggccagcttgctgtgctgcgctctgagctcctgcttcatgcttcttctccaacccagctcactcacctctctgcctgtgtctggagcatcccttcccacctctcccccacttcttccctccagcctgcatgccctcctctggaactgggattaaacagatacccaagaggcaggaaaaacgcgagtgtctgaagacctcaccctggcagggtgggcttctatccacccatgaggcacctggggcttctcagccaccccgtggtgtaacaagtggaggaggaggagggggtgagaacacctttcctccagccctgtgccacactccttctatgtgtgtacagtgtccacaggcatcacaccttcttcattaaaaacccagtttcctggtca

SEQ ID NO: 456541 - DNA, 553 bp, Homo sapiens
cgagaagctgaggttttgtaggagcccttatgaatgaagatccagtccggggtgcgctagggctgagaagccctggggactgcatgtgctgtaggtaagtcagggattcatgcgctgcacacaggtccccgggaactgatggctttgcctctttgtccctacaggccagcttgctgtgctgcgctctgagctcctgcttcatgcttcttctccaacccagctcactcacctctctgcctgtgtctggagcatcccttcccacctctcccccacttcttccctccagcctgcatgccctcctctggaactgggattaaacagatacccaagaggcaggaaaaacgcgagtgtctgaagacctcaccctggcagggtgggcttctatccacccatgaggcacctggggcttctcagccaccccgtggtgtaacaagtggaggaggaggagggggtgagaacacctttcctccagccctgtgccacactccttctatgtgtgtacagtgtccacaggcatcacaccttcttcattaaaaacccagtttcctggtca

SEQ ID NO: 456542 - DNA, 611 bp, Homo sapiens
ctcggctctgcccctcgacagtctgcagtctacggcgaggcacaggccagcccagctccacgaggactgaacaaggtgctgtctcactgccaccatgccggaagtcgagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccaaatgcctccacaacaccagggagattaaggacctgaagctgaaggtgatggacctccgtgggaagttcaagcgcccgcccctgcgtcgagtccgtgtctcggctgacgccatgctccgggccctgctgggctccaagcacaaggtgtccatggatctgcgggccaacctcaagtctgtgaagaaggaagacacagagaagatgtgtgtacagtgtccacaggcatcacaccttcttcattaaaaacccagtttcctggtca

SEQ ID NO: 456543 - DNA, 1075 bp, Homo sapiens
ctcggctctgcccctcgacagtctgcagtctacggcgaggcacaggccagcccagctccacgaggactgaacaaggtgctgtctcactgccaccatgccggaagtcgagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccaaatgcctccacaacaccagggagattaaggacctgaagctgaaggtgatggacctccgtgggaagttcaagcgcccgcccctgcgtcgagtccgtgtctcggctgacgccatgctccgggccctgctgggctccaagcacaaggtgtccatggatctgcgggccaacctcaagtctgtgaagaaggaagacacagagaaggagcggcctgtggaggtgggtgactggaggaagaacgtggaggccatgtctggcatggaaggccggaagaagatgtttgatgccgccaagtctccgacctcacaatagaggccagcttgctgtgctgcgctctgagctcctgcttcatgcttcttctccaacccagctcactcacctctctgcctgtgtctggagcatcccttcccacctctcccccacttcttccctccagcctgcatgccctcctctggaactgggattaaacagatacccaagaggcaggaaaaacgcgagtgtctgaagacctcaccctggcagggtgggcttctatccacccatgaggcacctggggcttctcagccaccccgtggtgtaacaagtggaggaggaggagggggtgagaacacctttcctccagccctgtgccacactccttctatgtgtgtacagtgtccacaggcatcacaccttcttcattaaaaacccagtttcctggtcaaaaaaagacaaataaagcatacaaaa

SEQ ID NO: 456544 - DNA, 460 bp, Homo sapiens
  misc_feature (42)..(42): n is a, c, g, or t
gggggggggggagggggcccatacggcgttgcgtagcgacgncgagctcgctgtctccgacctcacagagagccagcttgctgtgctgcgctctgagctcctgcttcatgcttcttctccaacccagctcactcacctctctgcctgtgtctggagcatcccttcccacctctcccccacttcttccctccagcctgcatgccctcctctggaactgggattaaacagatacccaagaggcaggaaaaacgcgagtgtctgaagacctcaccctggcagggtgggcttctatccacccatgaggcacctggggcttctcagccaccccgtggtgtaacaagtggaggaggaggagggggtgagaacacctttcctccagccctgtgccacactccttctatgtgtgtacagtgtccacaggcatcacaccttcttcattaaaaacccagtttcctggtca

SEQ ID NO: 456545 - DNA, 823 bp, Homo sapiens
ctcggctctgcccctcgacagtctgcagtctacggcgaggcacaggccagcccagctccacgaggactgaacaaggtgctgtctcactgccaccatgccggaagtcgagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccaaatgcctccacaacaccagggagattaaggacctgaagctgaaggtgatggacctccgtgggaagttcaagcgcccgcccctgcgtcgagtccgtgtctcggctgacgccatgctccgggccctgctgggtccaacccagctcactcacctctctgcctgtgtctggagcatcccttcccacctctcccccacttcttccctccagcctgcatgccctcctctggaactgggattaaacagatacccaagaggcaggaaaaacgcgagtgtctgaagacctcaccctggcagggtgggcttctatccacccatgaggcacctggggcttctcagccaccccgtggtgtaacaagtggaggaggaggagggggtgagaacacctttcctccagccctgtgccacactccttctatgtgtgtacagtgtccacaggcatcacaccttcttcattaaaaacccagtttcctggtca

SEQ ID NO: 456546 - DNA, 767 bp, Homo sapiens
ctcggctctgcccctcgacagtctgcagtctacggcgaggcacaggccagcccagctccacgaggactgaacaaggtgctgtctcactgccaccatgccggaagtcgagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccaaatgcctccacaacaccagggagattaaggacctgaagctgaaggtgatggacctccgtgggaagttcaagcgcccgcccctgcgtcgagtccgtgtctcggctgacgccatgctccgggccctgctgggctccaagcacaaggtgtccatggatctgcgggccaacctcaagtctgtgaagaaggaagacacagagaaggaaaaacgcgagtgtctgaagacctcaccctggcagggtgggcttctatccacccatgaggcacctggggcttctcagccaccccgtggtgtaacaagtggaggaggaggagggggtgagaacacctttcctccagccctgtgccacactccttctatgtgtgtacagtgtccacaggcatcacaccttcttcattaaaaacccagtttcctggtca

SEQ ID NO: 456547 - DNA, 1129 bp, Homo sapiens
ctcggctctgcccctcgacagtctgcagtctacggcgaggcacaggccagcccagctccacgaggactgaacaaggtgctgtctcactgccaccatgccggaagtcgagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccaaatgcctccacaacaccagggagattaaggacctgaagctgaaggtgatggacctccgtgggaagttcaagcgcccgcccctgcgtcgagtccgtgtctcggctgacgccatgctccgggccctgctgggctccaagcacaaggtgtccatggatctgcgggccaacctcaagtctgtgaagaaggaagacacagagaaggagcggcctgtggaggtgggtgactggaggaagaacgtggaggccatgtctggcatggaaggccggaagaagatgtttgatgccgccaagtctccgacctcacaatagaggtacctagagaccagctcccttctctggggtccatcagagtctagaggataatgagggagtccacaatgggcaggcgggttgtacttagtgtggtgcacggatgcacggactaaggcaccgatgagactgatttgagtcggctctcctgggctcagtcctggctccagcaccatgatacttgggcatgtcatttctgtttggcggccctttttgttcccattatctatgaaattgggggctgtatcaaatcagtggttctccaagtgtggtcctgggaccagcagcgtctacatcacctgggatgcaaatgatcagcccccaccccagatccactaaattggaaactctggggtgaggccagccttctaggtgattctgatgcacatgagagtttgagaaccactaggttagagggtccctgggatcccttcatctctgactttctgagaatctatgcacttttaaata

SEQ ID NO: 456548 - DNA, 548 bp, Homo sapiens
ctcggctctgcccctcgacagtctgcagtctacggcgaggcacaggccagcccagctccacgaggactgaacaaggtgctgtctcactgccaccatgccggaagtcgagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcagtgcatgccctcctctggaactgggattaaacagatacccaagaggcaggaaaaacgcgagtgtctgaagacctcaccctggcagggtgggcttctatccacccatgaggcacctggggcttctcagccaccccgtggtgtaacaagtggaggaggaggagggggtgagaacacctttcctccagccctgtgccacactccttctatgtgtgtacagtgtccacaggcatcacaccttcttcattaaaaacccagtttcctggtca

SEQ ID NO: 456549 - DNA, 1003 bp, Homo sapiens
ctcggctctgcccctcgacagtctgcagtctacggcgaggcacaggccagcccagctccacgaggactgaacaaggtgctgtctcactgccaccatgccggaagtcgagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccaaatgcctccacaacaccagggagattaaggacctgaagctgaaggtgatggacctccgtgggaagttcaagcgcccgcccctgcgtcgagtccgtgtctcggctgacgccatgctccgggccctgctgggctccaagcacaaggtgtccatggatctgcgggccaacctcaagtctgtgaagaaggaagacacagagaaggagcggcctgtggaggtgggtgactggaggaagaacgtggaggccatgtctggcatggaaggccggaagaagatgtttgatgccgccaagtctccgacctcacaatagaggccagcttgctgtgctgcgctctgagctcctgcttcatgcttcttctccaacccagctcactcacctctctgcctgtgtctggagcatcccttcccacctctcccccacttcttccctccagcctgcatgccctcctctggaactgggattaaacagatacccaagaggcaggaaaaacgcgagtgtctgaagacctcaccctggcagggtgggcttctatccacccatgaggcacctggggcttctcaacctttcctccagccctgtgccacactccttctatgtgtgtacagtgtccacaggcatcacaccttcttcattaaaaacccagtttcctggtca

SEQ ID NO: 456550 - DNA, 906 bp, Homo sapiens
ctcggctctgcccctcgacagtctgcagtctacggcgaggcacaggccagcccagctccacgaggactgaacaaggtgctgtctcactgccaccatgccggaagtcgagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccaaatgcctccacaacaccagggagattaaggacctgaagctgaaggtgatggacctccgtgggaagttcaagcgcccgcccctgcgtcgagtccgtgtctcggctgacgccatgctccgggccctgctgggctccaagcacaaggtgtccatggatctgcgggccaacctcaagtctgtgaagaaggaagacacagagaaggagcggcctgtggaggtgggtgactggaggaagaacgtggaggccatgtctggcatggaaggccggaagaagatgtttgatgccgccaagttgcatgccctcctctggaactgggattaaacagatacccaagaggcaggaaaaacgcgagtgtctgaagacctcaccctggcagggtgggcttctatccacccatgaggcacctggggcttctcagccaccccgtggtgtaacaagtggaggaggaggagggggtgagaacacctttcctccagccctgtgccacactccttctatgtgtgtacagtgtccacaggcatcacaccttcttcattaaaaacccagtttcctggtca

SEQ ID NO: 456551 - DNA, 7474 bp, Homo sapiens
gctctgggcaggagagagagggagagacaagagacacacacagagagacggcgaggaagggaaagacccagagggacgcctagaacgagacttggagccagacagaggaagaggggacgtgtgtttgcagactggctgggcccgtgacccagcttcctgagtcctccgtgcaggtggcagctgtaccaggctggcaggtcactgagagtgggcagctgggccccagaactgtgcctggcccagtgggcagcaggagctcctgacttgggaccatggtgattcttcagcagggggaccatgtgtggatggacctgagattggggcaggagttcgacgtgcccatcggggcggtggtgaagctctgcgactctgggcaggtccaggtggtggatgatgaagacaatgaacactggatctctccgcagaacgcaacgcacatcaagcctatgcaccccacgtcggtccacggcgtggaggacatgatccgcctgggggacctcaacgaggcgggcatcttgcgcaacctgcttatccgctaccgggaccacctcatctacacgtatacgggctccatcctggtggctgtgaacccctaccagctgctctccatctactcgccagagcacatccgccagtataccaacaagaagattggggagatgcccccccacatctttgccattgctgacaactgctacttcaacatgaaacgcaacagccgagaccagtgctgcatcatcagtggggaatctggggccgggaagacggagagcacaaagctgatcctgcagttcctggcagccatcagtgggcagcactcgtggattgagcagcaggtcttggaggccacccccattctggaagcatttgggaatgccaagaccatccgcaatgacaactcaagccgtttcggaaagtacatcgacatccacttcaacaagcggggcgccatcgagggcgcgaagattgagcagtacctgctggaaaagtcacgtgtctgtcgccaggccctggatgaaaggaactaccacgtgttctactgcatgctggagggtatgagtgaggatcagaagaagaagctgggcttgggccaggcctctgactacaactacttggccatgggtaactgcataacctgtgagggccgggtggacagccaggagtacgccaacatccgctccgccatgaaggtgctcatgttcactgacaccgagaactgggagatctcgaagctcctggctgccatcctgcacctgggcaacctgcagtatgaggcacgcacatttgaaaacctggatgcctgtgaggttctcttctccccatcgctggccacagctgcatccctgcttgaggtgaaccccccagacctgatgagctgcctgactagccgcaccctcatcacccgcggggagacggtgtccaccccactgagcagggaacaggcactggacgtgcgcgacgccttcgtaaaggggatctacgggcggctgttcgtgtggattgtggacaagatcaacgcagcaatttacaagcctccctcccaggatgtgaagaactctcgcaggtccatcggcctcctggacatctttgggtttgagaactttgctgtgaacagctttgagcagctctgcatcaacttcgccaatgagcacctgcagcagttctttgtgcggcacgtgttcaagctggagcaggaggaatatgacctggagagcattgactggctgcacatcgagttcactgacaaccaggatgccctggacatgattgccaacaagcccatgaacatcatctccctcatcgatgaggagagcaagttccccaagggcacagacaccaccatgttacacaagctgaactcccagcacaagctcaacgccaactacatcccccccaagaacaaccatgagacccagtttggcatcaaccattttgcaggcatcgtctactatgagacccaaggcttcctggagaagaaccgagacaccctgcatggggacattatccagctggtccactcctccaggaacaagttcatcaagcagatcttccaggccgatgtcgccatgggcgccgagaccaggaagcgctcgcccacacttagcagccagttcaagcggtcactggagctgctgatgcgcacgctgggtgcctgccagcccttctttgtgcgatgcatcaagcccaatgagttcaagaagcccatgctgttcgaccggcacctgtgcgtgcgccagctgcggtactcaggaatgatggagaccatccgaatccgccgagctggctaccccatccgctacagcttcgtagagtttgtggagcggtaccgtgtgctgctgccaggtgtgaagccggcctacaagcagggcgacctccgcgggacttgccagcgcatggctgaggctgtgctgggcacccacgatgactggcagataggcaaaaccaagatctttctgaaggaccaccatgacatgctgctggaagtggagcgggacaaagccatcaccgacagagtcatcctccttcagaaagtcatccggggattcaaagacaggtctaactttctgaagctgaagaacgctgccacactgatccagaggcactggcggggtcacaactgtaggaagaactacgggctgatgcgtctgggcttcctgcggctgcaggccctgcaccgctcccggaagctgcaccagcagtaccgcctggcccgccagcgcatcatccagttccaggcccgctgccgcgcctatctggtgcgcaaggccttccgccaccgcctctgggctgtgctcaccgtgcaggcctatgcccggggcatgatcgcccgcaggctgcaccaacgcctcagggctgagtatctgtggcgcctcgaggctgagaaaatgcggctggcggaggaagagaagcttcggaaggagatgagcgccaagaaggccaaggaggaggccgagcgcaagcatcaggagcgcctggcccagctggctcgtgaggacgctgagcgggagctgaaggagaaggaggccgctcggcggaagaaggagctcctggagcagatggaaagggcccgccatgagcctgtcaatcactcagacatggtggacaagatgtttggcttcctggggacttcaggtggcctgccaggccaggagggccaggcacctagtggctttgaggacctggagcgagggcggagggagatggtggaggaggacctggatgcagccctgcccctgcctgacgaggatgaggaggacctctctgagtataaatttgccaagttcgcggccacctacttccaggggacaaccacgcactcctacacccggcggccactcaaacagccactgctctaccatgacgacgagggtgaccagctggcagccctggcggtctggatcaccatcctccgcttcatgggggacctccctgagcccaagtaccacacagccatgagtgatggcagtgagaagatccctgtgatgaccaagatttatgagaccctgggcaagaagacgtacaagagggagctgcaggccctgcagggcgagggcgaggcccagctccccgagggccagaagaagagcagtgtgaggcacaagctggtgcatttgactctgaaaaagaagtccaagctcacagaggaggtgaccaagaggctgcatgacggggagtccacagtgcagggcaacagcatgctggaggaccggcccacctccaacctggagaagctgcacttcatcatcggcaatggcatcctgcggccagcactccgggacgagatctactgccagatcagcaagcagctgacccacaacccctccaagagcagctatgcccggggctggattctcgtgtctctctgcgtgggctgtttcgccccctccgagaagtttgtcaagtacctgcggaacttcatccacgggggcccgcccggctacgccccgtactgtgaggagcgcctgagaaggacctttgtcaatgggacacggacacagccgcccagctggctggagctgcaggccaccaagtccaagaagccaatcatgttgcccgtgacattcatggatgggaccaccaagaccctgctgacggactcggcaaccacggccaaggagctctgcaacgcgctggccgacaagatctctctcaaggaccggttcgggttctccctctacattgccctgtttgacaaggtgtcctccctgggcagcggcagtgaccacgtcatggacgccatctcccagtgcgagcagtacgccaaggagcagggcgcccaggagcgcaacgccccctggaggctcttcttccgcaaagaggtcttcacgccctggcacagcccctccgaggacaacgtggccaccaacctcatctaccagcaggtggtgcgaggagtcaagtttggggagtacaggtgtgagaaggaggacgacctggctgagctggcctcccagcagtactttgtagactatggctctgagatgatcctggagcgcctcctgaacctcgtgcccacctacatccccgaccgcgagatcacgcccctgaagacgctggagaagtgggcccagctggccatcgccgcccacaagaaggggatttatgcccagaggagaactgatgcccagaaggtcaaagaggatgtggtcagttatgcccgcttcaagtggcccttgctcttctccaggttttatgaagcctacaaattctcaggccccagtctccccaagaacgacgtcatcgtggccgtcaactggacgggtgtgtactttgtggatgagcaggagcaggtacttctggagctgtccttcccagagatcatggccgtgtccagcagcagggagtgccgtgtctggctctcactgggctgctctgatcttggctgtgctgcgcctcactcaggctgggcaggactgaccccggcggggccctgttctccgtgttggtcctgcaggggagcgaaaacgacggcccccagcttcacgctggccaccatcaagggggacgaatacaccttcacctccagtaatgctgaggacattcgtgacctggtggtcaccttcctagaggggctccggaagagatctaagtatgttgtggccctgcaggataaccccaaccccgcaggcgaggagtcaggcttcctcagctttgccaagggagacctcatcatcctggaccatgacacgggcgagcaggtcatgaactcgggctgggccaacggcatcaatgagaggaccaagcagcgtggggacttccccaccgacagtgtgtacgtcatgcccactgtcaccatgccaccgcgggagattgtggccctggtcaccatgactcccgatcagaggcaggacgttgtccggctcttgcagctgcgaacggcggagcccgaggtgcgtgccaagccctacacgctggaggagttttcctatgactacttcaggcccccacccaagcacacgctgagccgtgtcatggtgtccaaggcccgaggcaaggaccggctgtggagccacacgcgggaaccgctcaagcaggcgctgctcaagaagctcctgggcagtgaggagctctcgcaggaggcctgcctggccttcattgctgtgctcaagtacatgggcgactacccgtccaagaggacacgctccgtcaacgagctcaccgaccagatctttgagggtcccctgaaagccgagcccctgaaggacgaggcatatgtgcagatcctgaagcagctgaccgacaaccacatcaggtacagcgaggagcggggttgggagctgctctggctgtgcacgggccttttcccacccagcaacatcctcctgccccacgtgcagcgcttcctgcagtcccgaaagcactgcccactcgccatcgactgcctgcaacggctccagaaagccctgagaaacgggtcccggaagtaccctccgcacctggtggaggtggaggccatccagcacaagaccacccagattttccacaaggtctacttccctgatgacactgacgaggccttcgaagtggagtccagcaccaaggccaaggacttctgccagaacatcgccaccaggctgctcctcaagtcctcagagggattcagcctctttgtcaaaattgcagacaaggtcctcagcgttcctgagaatgacttcttctttgactttgttcgacacttgacagactggataaagaaagctcggcccatcaaggacggaattgtgccctcactcacctaccaggtgttcttcatgaagaagctgtggaccaccacggtgccagggaaggatcccatggccgattccatcttccactattaccaggagttgcccaagtatctccgaggctaccacaagtgcacgcgggaggaggtgctgcagctgggggcgctgatctacagggtcaagttcgaggaggacaagtcctacttccccagcatccccaagctgctgcgggagctggtgccccaggaccttatccggcaggtctcacctgatgactggaagcggtccatcgtcgcctacttcaacaagcacgcagggaagtccaaggaggaggccaagctggccttcctgaagctcatcttcaagtggcccacctttggctcagccttcttcgaggtgaagcaaactacggagccaaacttccctgagatcctcctaattgccatcaacaagtatggggtcagcctcatcgatcccaaaacgaaggatatcctcaccactcatcccttcaccaagatctccaactggagcagcggcaacacctacttccacatcaccattgggaacttggtgcgcgggagcaaactgctctgcgagacgtcactgggctacaagatggatgacctcctgacttcctacattagccagatgctcacagccatgagcaaacagcggggctccaggagcggcaagtgaacagtcacggggaggtgctggttccatgcctgctctcgaggcagcagtgggttcaggcccatcagctacccctgcagctggggaagacttatgccatcccggcagcgaggctgggctggccagccaccactgactataccaactgggcctctgatgttcttccagtgaggcatctctctgggatgcagaacttccctccatccacccctctggcacctgggttggtctaatcctagtttgctgtggccttcccggttgtgagagcctgtgatccttagatgtgtctcctgtttcagaccagccccaccatgcaacttcctttgactttctgtgtaccactgggatagaggaatcaagaggacaatctagctctccatactttgaacaaccaaatgtgcattgaatactctgaaaccgaagggactggatctgcaggtgggatgagggagacagaccacttttctatattgcagtgtgaatgctgggcccctgctcaagtctaccctgatcacctcagggcataaagcatgtttcattctctgaaaaacaaaaat

SEQ ID NO: 456552 - DNA, 4030 bp, Homo sapiens
gctctgggcaggagagagagggagagacaagagacacacacagagagacggcgaggaagggaaagacccagagggacgcctagaacgagacttggagccagacagaggaagaggggacgtgtgtttgcagactggctgggcccgtgacccagcttcctgagtcctccgtgcaggtggcagctgtaccaggctggcaggtcactgagagtgggcagctgggccccagaactgtgcctggcccagtgggcagcaggagctcctgacttgggaccatggtgattcttcagcagggggaccatgtgtggatggacctgagattggggcaggagttcgacgtgcccatcggggcggtggtgaagctctgcgactctgggcaggtccaggtggtggatgatgaagacaatgaacactggatctctccgcagaacgcaacgcacatcaagcctatgcaccccacgtcggtccacggcgtggaggacatgatccgcctgggggacctcaacgaggcgggcatcttgcgcaacctgcttatccgctaccgggaccacctcatctacacgtatacgggctccatcctggtggctgtgaacccctaccagctgctctccatctactcgccagagcacatccgccagtataccaacaagaagattggggagatgcccccccacatctttgccattgctgacaactgctacttcaacatgaaacgcaacagccgagaccagtgctgcatcatcagtggggaatctggggccgggaagacggagagcacaaagctgatcctgcagttcctggcagccatcagtgggcagcactcgtggattgagcagcaggtcttggaggccacccccattctggaagcatttgggaatgccaagaccatccgcaatgacaactcaagccgtttcggaaagtacatcgacatccacttcaacaagcggggcgccatcgagggcgcgaagattgagcagtacctgctggaaaagtcacgtgtctgtcgccaggccctggatgaaaggaactaccacgtgttctactgcatgctggagggtatgagtgaggatcagaagaagaagctgggcttgggccaggcctctgactacaactacttggccatgggtaactgcataacctgtgagggccgggtggacagccaggagtacgccaacatccgctccgccatgaaggtgctcatgttcactgacaccgagaactgggagatctcgaagctcctggctgccatcctgcacctgggcaacctgcagtatgaggcacgcacatttgaaaacctggatgcctgtgaggttctcttctccccatcgctggccacagctgcatccctgcttgaggtgaaccccccagacctgatgagctgcctgactagccgcaccctcatcacccgcggggagacggtgtccaccccactgagcagggaacaggcactggacgtgcgcgacgccttcgtaaaggggatctacgggcggctgttcgtgtggattgtggacaagatcaacgcagcaatttacaagcctccctcccaggatgtgaagaactctcgcaggtccatcggcctcctggacatctttgggtttgagaactttgctgtgaacagctttgagcagctctgcatcaacttcgccaatgagcacctgcagcagttctttgtgcggcacgtgttcaagctggagcaggaggaatatgacctggagagcattgactggctgcacatcgagttcactgacaaccaggatgccctggacatgattgccaacaagcccatgaacatcatctccctcatcgatgaggagagcaagttccccaagggcacagacaccaccatgttacacaagctgaactcccagcacaagctcaacgccaactacatcccccccaagaacaaccatgagacccagtttggcatcaaccattttgcaggcatcgtctactatgagacccaaggcttcctggagaagaaccgagacaccctgcatggggacattatccagctggtccactcctccaggaacaagttcatcaagcagatcttccaggccgatgtcgccatgggcgccgagaccaggaagcgctcgcccacacttagcagccagttcaagcggtcactggagctgctgatgcgcacgctgggtgcctgccagcccttctttgtgcgatgcatcaagcccaatgagttcaagaagcccatgctgttcgaccggcacctgtgcgtgcgccagctgcggtactcaggaatgatggagaccatccgaatccgccgagctggctaccccatccgctacagcttcgtagagtttgtggagcggtaccgtgtgctgctgccaggtgtgaagccggcctacaagcagggcgacctccgcgggacttgccagcgcatggctgaggctgtgctgggcacccacgatgactggcagataggcaaaaccaagatctttctgaaggaccaccatgacatgctgctggaagtggagcgggacaaagccatcaccgacagagtcatcctccttcagaaagtcatccggggattcaaagacaggtctaactttctgaagctgaagaacgctgccacactgatccagaggcactggcggggtcacaactgtaggaagaactacgggctgatgcgtctgggcttcctgcggctgcaggccctgcaccgctcccggaagctgcaccagcagtaccgcctggcccgccagcgcatcatccagttccaggcccgctgccgcgcctatctggtgcgcaaggccttccgccaccgcctctgggctgtgctcaccgtgcaggcctatgcccggggcatgatcgcccgcaggctgcaccaacgcctcagggctgagtatctgtggcgcctcgaggctgagaaaatgcggctggcggaggaagagaagcttcggaaggagatgagcgccaagaaggccaaggaggaggccgagcgcaagcatcaggagcgcctggcccagctggctcgtgaggacgctgagcgggagctgaaggagaaggaggccgctcggcggaagaaggagctcctggagcagatggaaagggcccgccatgagcctgtcaatcactcagacatggtggacaagatgtttggcttcctggggacttcaggtggcctgccaggccaggagggccaggcacctagtggctttgaggacctggagcgagggcggagggagatggtggaggaggacctggatgcagccctgcccctgcctgacgaggatgaggaggacctctctgagtataaatttgccaagttcgcggccacctacttccaggggacaaccacgcactcctacacccggcggccactcaaacagccactgctctaccatgacgacgagggtgaccagctggcagccctggcggtctggatcaccatcctccgcttcatgggggacctccctgagcccaagtaccacacagccatgagtgatggcagtgagaagatccctgtgatgaccaagatttatgagaccctgggcaagaagacgtacaagagggagctgcaggccctgcagggcgagggcgaggcccagctccccgagggccagaagaagagcagtgtgaggcacaagctggtgcatttgactctgaaaaagaagtccaagctcacagaggaggtgaccaagaggctgcatgacggggagtccacagtgcagggcaacagcatgctggaggaccggcccacctccaacctggagaagctgcacttcatcatcggcaatggcatcctgcggccagcactccggtgccggaaagtcttttggtggctgagtggtgcctctgtcaacctagcaagagattaagccaagcaggcctgggtttggcttcgctgctagctagttggtggagttaggaccttggtggagttatttcatctttctaagcctctgattccttgtctgtaaagggggaatcctaaaacaggcatcccttggagatattgcaggttcagttgaaggccacagaaataaatatcacaataaagagagctgcagaaata

SEQ ID NO: 456553 - DNA, 530 bp, Homo sapiens
gctctgggcaggagagagagggagagacaagagacacacacagagagacggcgaggaagggaaagacccagagggacgcctagaacgagacttggagccagacagaggaagaggggacgtgtgtttgcagactggctgggcccgtgacccagcttcctgagtcctccgtgcaggtggcagctgtaccaggctggcaggtcactgagagtgggcagctgggccccagaactgtgcctggcccagtgggcagcaggagctcctgacttgggaccatggtgattcttcagcagggggaccatgtgtggatggacctgagattggggcaggagttcgacgtgcccatcggggcggtggtgaagctctgcgactctgggcaggtccaggtggtggatgatgaagacaatgagcgctggatctctagggcctctccgtgtggccagcacagcaaccctgctaggagcacaaacggaaagcctgagatctggcccagctgccttgccccctggtctgcaaggaaggcacgcggggct

SEQ ID NO: 456554 - DNA, 4639 bp, Homo sapiens
gctctgggcaggagagagagggagagacaagagacacacacagagagacggcgaggaagggaaagacccagagggacgcctagaacgagacttggagccagacagaggaagaggggacgtgtgtttgcagactggctgggcccgtgacccagcttcctgagtcctccgtgcaggtggcagctgtaccaggctggcaggtcactgagagtgggcagctgggccccagaactgtgcctggcccagtgggcagcaggagctcctgacttgggaccatggtgattcttcagcagggggaccatgtgtggatggacctgagattggggcaggagttcgacgtgcccatcggggcggtggtgaagctctgcgactctgggcaggtccaggtggtggatgatgaagacaatgaacactggatctctccgcagaacgcaacgcacatcaagcctatgcaccccacgtcggtccacggcgtggaggacatgatccgcctgggggacctcaacgaggcgggcatcttgcgcaacctgcttatccgctaccgggaccacctcatctacacgtatacgggctccatcctggtggctgtgaacccctaccagctgctctccatctactcgccagagcacatccgccagtataccaacaagaagattggggagatgcccccccacatctttgccattgctgacaactgctacttcaacatgaaacgcaacagccgagaccagtgctgcatcatcagtggggaatctggggccgggaagacggagagcacaaagctgatcctgcagttcctggcagccatcagtgggcagcactcgtggattgagcagcaggtcttggaggccacccccattctggaagcatttgggaatgccaagaccatccgcaatgacaactcaagccgtttcggaaagtacatcgacatccacttcaacaagcggggcgccatcgagggcgcgaagattgagcagtacctgctggaaaagtcacgtgtctgtcgccaggccctggatgaaaggaactaccacgtgttctactgcatgctggagggtatgagtgaggatcagaagaagaagctgggcttgggccaggcctctgactacaactacttggccatgggtaactgcataacctgtgagggccgggtggacagccaggagtacgccaacatccgctccgccatgaaggtgctcatgttcactgacaccgagaactgggagatctcgaagctcctggctgccatcctgcacctgggcaacctgcagtatgaggcacgcacatttgaaaacctggatgcctgtgaggttctcttctccccatcgctggccacagctgcatccctgcttgaggtgaaccccccagacctgatgagctgcctgactagccgcaccctcatcacccgcggggagacggtgtccaccccactgagcagggaacaggcactggacgtgcgcgacgccttcgtaaaggggatctacgggcggctgttcgtgtggattgtggacaagatcaacgcagcaatttacaagcctccctcccaggatgtgaagaactctcgcaggtccatcggcctcctggacatctttgggtttgagaactttgctgtgaacagctttgagcagctctgcatcaacttcgccaatgagcacctgcagcagttctttgtgcggcacgtgttcaagctggagcaggaggaatatgacctggagagcattgactggctgcacatcgagttcactgacaaccaggatgccctggacatgattgccaacaagcccatgaacatcatctccctcatcgatgaggagagcaagttccccaagggcacagacaccaccatgttacacaagctgaactcccagcacaagctcaacgccaactacatcccccccaagaacaaccatgagacccagtttggcatcaaccattttgcaggcatcgtctactatgagacccaaggcttcctggagaagaaccgagacaccctgcatggggacattatccagctggtccactcctccaggaacaagttcatcaagcagatcttccaggccgatgtcgccatgggcgccgagaccaggaagcgctcgcccacacttagcagccagttcaagcggtcactggagctgctgatgcgcacgctgggtgcctgccagcccttctttgtgcgatgcatcaagcccaatgagttcaagaagcccatgctgttcgaccggcacctgtgcgtgcgccagctgcggtactcaggaatgatggagaccatccgaatccgccgagctggctaccccatccgctacagcttcgtagagtttgtggagcggtaccgtgtgctgctgccaggtgtgaagccggcctacaagcagggcgacctccgcgggacttgccagcgcatggctgaggctgtgctgggcacccacgatgactggcagataggcaaaaccaagatctttctgaaggaccaccatgacatgctgctggaagtggagcgggacaaagccatcaccgacagagtcatcctccttcagaaagtcatccggggattcaaagacaggtctaactttctgaagctgaagaacgctgccacactgatccagaggcactggcggggtcacaactgtaggaagaactacgggctgatgcgtctgggcttcctgcggctgcaggccctgcaccgctcccggaagctgcaccagcagtaccgcctggcccgccagcgcatcatccagttccaggcccgctgccgcgcctatctggtgcgcaaggccttccgccaccgcctctgggctgtgctcaccgtgcaggcctatgcccggggcatgatcgcccgcaggctgcaccaacgcctcagggctgagtatctgtggcgcctcgaggctgagaaaatgcggctggcggaggaagagaagcttcggaaggagatgagcgccaagaaggccaaggaggaggccgagcgcaagcatcaggagcgcctggcccagctggctcgtgaggacgctgagcgggagctgaaggagaaggaggccgctcggcggaagaaggagctcctggagcagatggaaagggcccgccatgagcctgtcaatcactcagacatggtggacaagatgtttggcttcctggggacttcaggtggcctgccaggccaggagggccaggcacctagtggctttgaggacctggagcgagggcggagggagatggtggaggaggacctggatgcagccctgcccctgcctgacgaggatgaggaggacctctctgagtataaatttgccaagttcgcggccacctacttccaggggacaaccacgcactcctacacccggcggccactcaaacagccactgctctaccatgacgacgagggtgaccagctggcagccctggcggtctggatcaccatcctccgcttcatgggggacctccctgagcccaagtaccacacagccatgagtgatggcagtgagaagatccctgtgatgaccaagatttatgagaccctgggcaagaagacgtacaagagggagctgcaggccctgcagggcgagggcgaggcccagctccccgagggccagaagaagagcagtgtgaggcacaagctggtgcatttgactctgaaaaagaagtccaagctcacagaggaggtgaccaagaggctgcatgacggggagtccacagtgcagggcaacagcatgctggaggaccggcccacctccaacctggagaagctgcacttcatcatcggcaatggcatcctgcggccagcactccgggacgagatctactgccagatcagcaagcagctgacccacaacccctccaagagcagctatgcccggggctggattctcgtgtctctctgcgtgggctgtttcgccccctccgagaagtttgtcaagtacctgcggaacttcatccacgggggcccgcccggctacgccccgtactgtgaggagcgcctgagaaggacctttgtcaatgggacacggacacagccgcccagctggctggagctgcaggccaccaagtccaagaagccaatcatgttgcccgtgacattcatggatgggaccaccaagaccctgctgacggactcggcaaccacggccaaggagctctgcaacgcgctggccgacaagatctctctcaaggaccggttcgggttctccctctacattgccctgtttgacaaggtgtcctccctgggcagcggcagtgaccacgtcatggacgccatctcccagtgcgagcagtacgccaaggagcagggcgcccaggagcgcaacgccccctggaggctcttcttccgcaaagaggtcttcacgccctggcacagcccctccgaggacaacgtggccaccaacctcatctaccagcaggtggtgcgaggagtcaagtttggggagtacaggtgtgagaaggtgagtgggagggaatcttccgccaggctggcttggctcacagcctcctgctttccacgtttgggctgagtgctcctctgtgagccatcattagctcaggctggggtgagcctgactgcaaccaggcactcttcaggctcctggatggacaccgcctacttcagggggctcgtgaggagaggcgagatggcgggagcaagggcttctgaggatgt

SEQ ID NO: 456555 - DNA, 4873 bp, Homo sapiens
gctctgggcaggagagagagggagagacaagagacacacacagagagacggcgaggaagggaaagacccagagggacgcctagaacgagacttggagccagacagaggaagaggggacgtgtgtttgcagactggctgggcccgtgacccagcttcctgagtcctccgtgcaggtggcagctgtaccaggctggcaggtcactgagagtgggcagctgggccccagaactgtgcctggcccagtgggcagcaggagctcctgacttgggaccatggtgattcttcagcagggggaccatgtgtggatggacctgagattggggcaggagttcgacgtgcccatcggggcggtggtgaagctctgcgactctgggcaggtccaggtggtggatgatgaagacaatgaacactggatctctccgcagaacgcaacgcacatcaagcctatgcaccccacgtcggtccacggcgtggaggacatgatccgcctgggggacctcaacgaggcgggcatcttgcgcaacctgcttatccgctaccgggaccacctcatctacacgtatacgggctccatcctggtggctgtgaacccctaccagctgctctccatctactcgccagagcacatccgccagtataccaacaagaagattggggagatgcccccccacatctttgccattgctgacaactgctacttcaacatgaaacgcaacagccgagaccagtgctgcatcatcagtggggaatctggggccgggaagacggagagcacaaagctgatcctgcagttcctggcagccatcagtgggcagcactcgtggattgagcagcaggtcttggaggccacccccattctggaagcatttgggaatgccaagaccatccgcaatgacaactcaagccgtttcggaaagtacatcgacatccacttcaacaagcggggcgccatcgagggcgcgaagattgagcagtacctgctggaaaagtcacgtgtctgtcgccaggccctggatgaaaggaactaccacgtgttctactgcatgctggagggtatgagtgaggatcagaagaagaagctgggcttgggccaggcctctgactacaactacttggccatgggtaactgcataacctgtgagggccgggtggacagccaggagtacgccaacatccgctccgccatgaaggtgctcatgttcactgacaccgagaactgggagatctcgaagctcctggctgccatcctgcacctgggcaacctgcagtatgaggcacgcacatttgaaaacctggatgcctgtgaggttctcttctccccatcgctggccacagctgcatccctgcttgaggtgaaccccccagacctgatgagctgcctgactagccgcaccctcatcacccgcggggagacggtgtccaccccactgagcagggaacaggcactggacgtgcgcgacgccttcgtaaaggggatctacgggcggctgttcgtgtggattgtggacaagatcaacgcagcaatttacaagcctccctcccaggatgtgaagaactctcgcaggtccatcggcctcctggacatctttgggtttgagaactttgctgtgaacagctttgagcagctctgcatcaacttcgccaatgagcacctgcagcagttctttgtgcggcacgtgttcaagctggagcaggaggaatatgacctggagagcattgactggctgcacatcgagttcactgacaaccaggatgccctggacatgattgccaacaagcccatgaacatcatctccctcatcgatgaggagagcaagttccccaagggcacagacaccaccatgttacacaagctgaactcccagcacaagctcaacgccaactacatcccccccaagaacaaccatgagacccagtttggcatcaaccattttgcaggcatcgtctactatgagacccaaggcttcctggagaagaaccgagacaccctgcatggggacattatccagctggtccactcctccaggaacaagttcatcaagcagatcttccaggccgatgtcgccatgggcgccgagaccaggaagcgctcgcccacacttagcagccagttcaagcggtcactggagctgctgatgcgcacgctgggtgcctgccagcccttctttgtgcgatgcatcaagcccaatgagttcaagaagcccatgctgttcgaccggcacctgtgcgtgcgccagctgcggtactcaggaatgatggagaccatccgaatccgccgagctggctaccccatccgctacagcttcgtagagtttgtggagcggtaccgtgtgctgctgccaggtgtgaagccggcctacaagcagggcgacctccgcgggacttgccagcgcatggctgaggctgtgctgggcacccacgatgactggcagataggcaaaaccaagatctttctgaaggaccaccatgacatgctgctggaagtggagcgggacaaagccatcaccgacagagtcatcctccttcagaaagtcatccggggattcaaagacaggtctaactttctgaagctgaagaacgctgccacactgatccagaggcactggcggggtcacaactgtaggaagaactacgggctgatgcgtctgggcttcctgcggctgcaggccctgcaccgctcccggaagctgcaccagcagtaccgcctggcccgccagcgcatcatccagttccaggcccgctgccgcgcctatctggtgcgcaaggccttccgccaccgcctctgggctgtgctcaccgtgcaggcctatgcccggggcatgatcgcccgcaggctgcaccaacgcctcagggctgagtatctgtggcgcctcgaggctgagaaaatgcggctggcggaggaagagaagcttcggaaggagatgagcgccaagaaggccaaggaggaggccgagcgcaagcatcaggagcgcctggcccagctggctcgtgaggacgctgagcgggagctgaaggagaaggaggccgctcggcggaagaaggagctcctggagcagatggaaagggcccgccatgagcctgtcaatcactcagacatggtggacaagatgtttggcttcctggggacttcaggtggcctgccaggccaggagggccaggcacctagtggctttgaggacctggagcgagggcggagggagatggtggaggaggacctggatgcagccctgcccctgcctgacgaggatgaggaggacctctctgagtataaatttgccaagttcgcggccacctacttccaggggacaaccacgcactcctacacccggcggccactcaaacagccactgctctaccatgacgacgagggtgaccagctggcagccctggcggtctggatcaccatcctccgcttcatgggggacctccctgagcccaagtaccacacagccatgagtgatggcagtgagaagatccctgtgatgaccaagatttatgagaccctgggcaagaagacgtacaagagggagctgcaggccctgcagggcgagggcgaggcccagctccccgagggccagaagaagagcagtgtgaggcacaagctggtgcatttgactctgaaaaagaagtccaagctcacagaggaggtgaccaagaggctgcatgacggggagtccacagtgcagggcaacagcatgctggaggaccggcccacctccaacctggagaagctgcacttcatcatcggcaatggcatcctgcggccagcactccgggacgagatctactgccagatcagcaagcagctgacccacaacccctccaagagcagctatgcccggggctggattctcgtgtctctctgcgtgggctgtttcgccccctccgagaagtttgtcaagtacctgcggaacttcatccacgggggcccgcccggctacgccccgtactgtgaggagcgcctgagaaggacctttgtcaatgggacacggacacagccgcccagctggctggagctgcaggccaccaagtccaagaagccaatcatgttgcccgtgacattcatggatgggaccaccaagaccctgctgacggactcggcaaccacggccaaggagctctgcaacgcgctggccgacaagatctctctcaaggaccggttcgggttctccctctacattgccctgtttgacaaggtgtcctccctgggcagcggcagtgaccacgtcatggacgccatctcccagtgcgagcagtacgccaaggagcagggcgcccaggagcgcaacgccccctggaggctcttcttccgcaaagaggtcttcacgccctggcacagcccctccgaggacaacgtggccaccaacctcatctaccagcaggtggtgcgaggagtcaagtttggggagtacaggtgtgagaaggaggacgacctggctgagctggcctcccagcagtactttgtagactatggctctgagatgatcctggagcgcctcctgaacctcgtgcccacctacatccccgaccgcgagatcacgcccctgaagacgctggagaagtgggcccagctggccatcgccgcccacaagaaggggatttatgcccagaggagaactgatgcccagaaggtcaaagaggatgtggtcagttatgcccgcttcaagtggcccttgctcttctccaggttttatgaagcctacaaattctcaggtaccccgcagcctgcaatgctcccagtcccttgctctgtagctccagcccacagcctacaaattctcaggtaccccgcagcctgcaacgctcccagtcccttgctctgtagctccagcccacagcctacaaattctcaggtaccccacagcctgcaatg

SEQ ID NO: 456556 - DNA, 7444 bp, Homo sapiens
tttaccggagcctgaatttgagaccaagcttgtctacttctaattattaccctttccactccatcctgcaaagggcctgagggaactctgatccccttactgacaacagtcagatggggccaaaatccctgccctgcccacctcttaggtctgcgggaaaatcccctaagagaaggagcggtccttgaggggtagaggtggctggtaccatcctgactgaaccctgttagaactgacagtgtctggctgccagagaggtcgaggcccttacccgggttggcactcatcccgcgctcccgcccgtcccggccccttcccctgaagtgcgcagcctgggccccaggagagcacgctgacgttctggctccccgcaggaacactggatctctccgcagaacgcaacgcacatcaagcctatgcaccccacgtcggtccacggcgtggaggacatgatccgcctgggggacctcaacgaggcgggcatcttgcgcaacctgcttatccgctaccgggaccacctcatctacacgtatacgggctccatcctggtggctgtgaacccctaccagctgctctccatctactcgccagagcacatccgccagtataccaacaagaagattggggagatgcccccccacatctttgccattgctgacaactgctacttcaacatgaaacgcaacagccgagaccagtgctgcatcatcagtggggaatctggggccgggaagacggagagcacaaagctgatcctgcagttcctggcagccatcagtgggcagcactcgtggattgagcagcaggtcttggaggccacccccattctggaagcatttgggaatgccaagaccatccgcaatgacaactcaagccgtttcggaaagtacatcgacatccacttcaacaagcggggcgccatcgagggcgcgaagattgagcagtacctgctggaaaagtcacgtgtctgtcgccaggccctggatgaaaggaactaccacgtgttctactgcatgctggagggtatgagtgaggatcagaagaagaagctgggcttgggccaggcctctgactacaactacttggccatgggtaactgcataacctgtgagggccgggtggacagccaggagtacgccaacatccgctccgccatgaaggtgctcatgttcactgacaccgagaactgggagatctcgaagctcctggctgccatcctgcacctgggcaacctgcagtatgaggcacgcacatttgaaaacctggatgcctgtgaggttctcttctccccatcgctggccacagctgcatccctgcttgaggtgaaccccccagacctgatgagctgcctgactagccgcaccctcatcacccgcggggagacggtgtccaccccactgagcagggaacaggcactggacgtgcgcgacgccttcgtaaaggggatctacgggcggctgttcgtgtggattgtggacaagatcaacgcagcaatttacaagcctccctcccaggatgtgaagaactctcgcaggtccatcggcctcctggacatctttgggtttgagaactttgctgtgaacagctttgagcagctctgcatcaacttcgccaatgagcacctgcagcagttctttgtgcggcacgtgttcaagctggagcaggaggaatatgacctggagagcattgactggctgcacatcgagttcactgacaaccaggatgccctggacatgattgccaacaagcccatgaacatcatctccctcatcgatgaggagagcaagttccccaagggcacagacaccaccatgttacacaagctgaactcccagcacaagctcaacgccaactacatcccccccaagaacaaccatgagacccagtttggcatcaaccattttgcaggcatcgtctactatgagacccaaggcttcctggagaagaaccgagacaccctgcatggggacattatccagctggtccactcctccaggaacaagttcatcaagcagatcttccaggccgatgtcgccatgggcgccgagaccaggaagcgctcgcccacacttagcagccagttcaagcggtcactggagctgctgatgcgcacgctgggtgcctgccagcccttctttgtgcgatgcatcaagcccaatgagttcaagaagcccatgctgttcgaccggcacctgtgcgtgcgccagctgcggtactcaggaatgatggagaccatccgaatccgccgagctggctaccccatccgctacagcttcgtagagtttgtggagcggtaccgtgtgctgctgccaggtgtgaagccggcctacaagcagggcgacctccgcgggacttgccagcgcatggctgaggctgtgctgggcacccacgatgactggcagataggcaaaaccaagatctttctgaaggaccaccatgacatgctgctggaagtggagcgggacaaagccatcaccgacagagtcatcctccttcagaaagtcatccggggattcaaagacaggtctaactttctgaagctgaagaacgctgccacactgatccagaggcactggcggggtcacaactgtaggaagaactacgggctgatgcgtctgggcttcctgcggctgcaggccctgcaccgctcccggaagctgcaccagcagtaccgcctggcccgccagcgcatcatccagttccaggcccgctgccgcgcctatctggtgcgcaaggccttccgccaccgcctctgggctgtgctcaccgtgcaggcctatgcccggggcatgatcgcccgcaggctgcaccaacgcctcagggctgagtatctgtggcgcctcgaggctgagaaaatgcggctggcggaggaagagaagcttcggaaggagatgagcgccaagaaggccaaggaggaggccgagcgcaagcatcaggagcgcctggcccagctggctcgtgaggacgctgagcgggagctgaaggagaaggaggccgctcggcggaagaaggagctcctggagcagatggaaagggcccgccatgagcctgtcaatcactcagacatggtggacaagatgtttggcttcctggggacttcaggtggcctgccaggccaggagggccaggcacctagtggctttgaggacctggagcgagggcggagggagatggtggaggaggacctggatgcagccctgcccctgcctgacgaggatgaggaggacctctctgagtataaatttgccaagttcgcggccacctacttccaggggacaaccacgcactcctacacccggcggccactcaaacagccactgctctaccatgacgacgagggtgaccagctggcagccctggcggtctggatcaccatcctccgcttcatgggggacctccctgagcccaagtaccacacagccatgagtgatggcagtgagaagatccctgtgatgaccaagatttatgagaccctgggcaagaagacgtacaagagggagctgcaggccctgcagggcgagggcgaggcccagctccccgagggccagaagaagagcagtgtgaggcacaagctggtgcatttgactctgaaaaagaagtccaagctcacagaggaggtgaccaagaggctgcatgacggggagtccacagtgcagggcaacagcatgctggaggaccggcccacctccaacctggagaagctgcacttcatcatcggcaatggcatcctgcggccagcactccgggacgagatctactgccagatcagcaagcagctgacccacaacccctccaagagcagctatgcccggggctggattctcgtgtctctctgcgtgggctgtttcgccccctccgagaagtttgtcaagtacctgcggaacttcatccacgggggcccgcccggctacgccccgtactgtgaggagcgcctgagaaggacctttgtcaatgggacacggacacagccgcccagctggctggagctgcaggccaccaagtccaagaagccaatcatgttgcccgtgacattcatggatgggaccaccaagaccctgctgacggactcggcaaccacggccaaggagctctgcaacgcgctggccgacaagatctctctcaaggaccggttcgggttctccctctacattgccctgtttgacaaggtgtcctccctgggcagcggcagtgaccacgtcatggacgccatctcccagtgcgagcagtacgccaaggagcagggcgcccaggagcgcaacgccccctggaggctcttcttccgcaaagaggtcttcacgccctggcacagcccctccgaggacaacgtggccaccaacctcatctaccagcaggtggtgcgaggagtcaagtttggggagtacaggtgtgagaaggaggacgacctggctgagctggcctcccagcagtactttgtagactatggctctgagatgatcctggagcgcctcctgaacctcgtgcccacctacatccccgaccgcgagatcacgcccctgaagacgctggagaagtgggcccagctggccatcgccgcccacaagaaggggatttatgcccagaggagaactgatgcccagaaggtcaaagaggatgtggtcagttatgcccgcttcaagtggcccttgctcttctccaggttttatgaagcctacaaattctcaggccccagtctccccaagaacgacgtcatcgtggccgtcaactggacgggtgtgtactttgtggatgagcaggagcaggtacttctggagctgtccttcccagagatcatggccgtgtccagcagcagggagtgccgtgtctggctctcactgggctgctctgatcttggctgtgctgcgcctcactcaggctgggcaggactgaccccggcggggccctgttctccgtgttggtcctgcaggggagcgaaaacgacggcccccagcttcacgctggccaccatcaagggggacgaatacaccttcacctccagtaatgctgaggacattcgtgacctggtggtcaccttcctagaggggctccggaagagatctaagtatgttgtggccctgcaggataaccccaaccccgcaggcgaggagtcaggcttcctcagctttgccaagggagacctcatcatcctggaccatgacacgggcgagcaggtcatgaactcgggctgggccaacggcatcaatgagaggaccaagcagcgtggggacttccccaccgacagtgtgtacgtcatgcccactgtcaccatgccaccgcgggagattgtggccctggtcaccatgactcccgatcagaggcaggacgttgtccggctcttgcagctgcgaacggcggagcccgaggtgcgtgccaagccctacacgctggaggagttttcctatgactacttcaggcccccacccaagcacacgctgagccgtgtcatggtgtccaaggcccgaggcaaggaccggctgtggagccacacgcgggaaccgctcaagcaggcgctgctcaagaagctcctgggcagtgaggagctctcgcaggaggcctgcctggccttcattgctgtgctcaagtacatgggcgactacccgtccaagaggacacgctccgtcaacgagctcaccgaccagatctttgagggtcccctgaaagccgagcccctgaaggacgaggcatatgtgcagatcctgaagcagctgaccgacaaccacatcaggtacagcgaggagcggggttgggagctgctctggctgtgcacgggccttttcccacccagcaacatcctcctgccccacgtgcagcgcttcctgcagtcccgaaagcactgcccactcgccatcgactgcctgcaacggctccagaaagccctgagaaacgggtcccggaagtaccctccgcacctggtggaggtggaggccatccagcacaagaccacccagattttccacaaggtctacttccctgatgacactgacgaggccttcgaagtggagtccagcaccaaggccaaggacttctgccagaacatcgccaccaggctgctcctcaagtcctcagagggattcagcctctttgtcaaaattgcagacaaggtcctcagcgttcctgagaatgacttcttctttgactttgttcgacacttgacagactggataaagaaagctcggcccatcaaggacggaattgtgccctcactcacctaccaggtgttcttcatgaagaagctgtggaccaccacggtgccagggaaggatcccatggccgattccatcttccactattaccaggagttgcccaagtatctccgaggctaccacaagtgcacgcgggaggaggtgctgcagctgggggcgctgatctacagggtcaagttcgaggaggacaagtcctacttccccagcatccccaagctgctgcgggagctggtgccccaggaccttatccggcaggtctcacctgatgactggaagcggtccatcgtcgcctacttcaacaagcacgcagggaagtccaaggaggaggccaagctggccttcctgaagctcatcttcaagtggcccacctttggctcagccttcttcgaggtgaagcaaactacggagccaaacttccctgagatcctcctaattgccatcaacaagtatggggtcagcctcatcgatcccaaaacgaaggatatcctcaccactcatcccttcaccaagatctccaactggagcagcggcaacacctacttccacatcaccattgggaacttggtgcgcgggagcaaactgctctgcgagacgtcactgggctacaagatggatgacctcctgacttcctacattagccagatgctcacagccatgagcaaacagcggggctccaggagcggcaagtgaacagtcacggggaggtgctggttccatgcctgctctcgaggcagcagtgggttcaggcccatcagctacccctgcagctggggaagacttatgccatcccggcagcgaggctgggctggccagccaccactgactataccaactgggcctctgatgttcttccagtgaggcatctctctgggatgcagaacttccctccatccacccctctggcacctgggttggtctaatcctagtttgctgtggccttcccggttgtgagagcctgtgatccttagatgtgtctcctgtttcagaccagccccaccatgcaacttcctttgactttctgtgtaccactgggatagaggaatcaagaggacaatctagctctccatactttgaacaaccaaatgtgcattgaatactctgaaaccgaagggactggatctgcaggtgggatgagggagacagaccacttttctatattgcagtgtgaatgctgggcccctgctcaagtctaccctgatcacctcagggcataaagcatgtttcattctctgaaaaacaaaaat

SEQ ID NO: 456557 - DNA, 1499 bp, Homo sapiens
ataaggtcctggggcaccagctcccgcagcagcttggggatactggggaagtaggacttgtcctcctcgaacttgaccctgtagaacatcgccaccaggctgctcctcaagtcctcagagggattcagcctctttgtcaaaattgcagacaaggtcctcagcgttcctgagaatgacttcttctttgactttgttcgacacttgacagactggataaagaaagctcggcccatcaaggacggaattgtgccctcactcacctaccaggtgttcttcatgaagaagctgtggaccaccacggtgccagggaaggatcccatggccgattccatcttccactattaccaggagttgcccaagtatctccgaggctaccacaagtgcacgcgggaggaggtgctgcagctgggggcgctgatctacagggtcaagttcgaggaggacaagtcctacttccccagcatccccaagctgctgcgggagctggtgccccaggaccttatccggcaggtctcacctgatgactggaagcggtccatcgtcgcctacttcaacaagcacgcagggaagtccaaggaggaggccaagctggccttcctgaagctcatcttcaagtggcccacctttggctcagccttcttcgaggtgaagcaaactacggagccaaacttccctgagatcctcctaattgccatcaacaagtatggggtcagcctcatcgatcccaaaacgaaggatatcctcaccactcatcccttcaccaagatctccaactggagcagcggcaacacctacttccacatcaccattgggaacttggtgcgcgggagcaaactgctctgcgagacgtcactgggctacaagatggatgacctcctgacttcctacattagccagatgctcacagccatgagcaaacagcggggctccaggagcggcaagtgaacagtcacggggaggtgctggttccatgcctgctctcgaggcagcagtgggttcaggcccatcagctacccctgcagctggggaagacttatgccatcccggcagcgaggctgggctggccagccaccactgactataccaactgggcctctgatgttcttccagtgaggcatctctctgggatgcagaacttccctccatccacccctctggcacctgggttggtctaatcctagtttgctgtggccttcccggttgtgagagcctgtgatccttagatgtgtctcctgtttcagaccagccccaccatgcaacttcctttgactttctgtgtaccactgggatagaggaatcaagaggacaatctagctctccatactttgaacaaccaaatgtgcattgaatactctgaaaccgaagggactggatctgcaggtgggatgagggagacagaccacttttctatattgcagtgtgaatgctgggcccctgctcaagtctaccctgatcacctcagggcataaagcatgtttcattctctgaaaaacaaaaat

SEQ ID NO: 456558 - DNA, 332 bp, Homo sapiens
ctgcgaacggcggagcccgaggtgcgtgccaagccctacacgctggaggagttttcctatgactacttcaggtgatgcctcctggggaaggatgggagccacagggctaggagctgcaggcttccgctactgtctggtcgtgtgctggggctgctttgtgaagcccccacctgtgagcagggcctgggtcagagggagctggagggctgtttctgtctgccaggatgacccgtcctatgtgtctcatcttatcttccttccttcaagagatgtcactgcacccaccccaggctgggcattcgagactgagtcctggtggggatgcgggctgg

SEQ ID NO: 456559 - DNA, 7360 bp, Homo sapiens
gctctgggcaggagagagagggagagacaagagacacacacagagagacggcgaggaagggaaagacccagagggacgcctagaacgagacttggagccagacagaggaagaggggacgtgtgtttgcagactggctgggcccgtgacccagcttcctgagtcctccgtgcaggtggcagctgtaccaggctggcaggtcactgagagtgggcagctgggccccagaactgtgcctggcccagtgggcagcaggagctcctgacttgggaccatggtgattcttcagcagggggaccatgtgtggatggacctgagattggggcaggagttcgacgtgcccatcggggcggtggtgaagctctgcgactctgggcaggtccaggtggtggatgatgaagacaatgaacactggatctctccgcagaacgcaacgcacatcaagcctatgcaccccacgtcggtccacggcgtggaggacatgatccgcctgggggacctcaacgaggcgggcatcttgcgcaacctgcttatccgctaccgggaccacctcatctacacgtatacgggctccatcctggtggctgtgaacccctaccagctgctctccatctactcgccagagcacatccgccagtataccaacaagaagattggggagatgcccccccacatctttgccattgctgacaactgctacttcaacatgaaacgcaacagccgagaccagtgctgcatcatcagtggggaatctggggccgggaagacggagagcacaaagctgatcctgcagttcctggcagccatcagtgggcagcactcgtggattgagcagcaggtcttggaggccacccccattctggaagcatttgggaatgccaagaccatccgcaatgacaactcaagccgtttcggaaagtacatcgacatccacttcaacaagcggggcgccatcgagggcgcgaagattgagcagtacctgctggaaaagtcacgtgtctgtcgccaggccctggatgaaaggaactaccacgtgttctactgcatgctggagggtatgagtgaggatcagaagaagaagctgggcttgggccaggcctctgactacaactacttggccatgggtaactgcataacctgtgagggccgggtggacagccaggagtacgccaacatccgctccgccatgaaggtgctcatgttcactgacaccgagaactgggagatctcgaagctcctggctgccatcctgcacctgggcaacctgcagtatgaggcacgcacatttgaaaacctggatgcctgtgaggttctcttctccccatcgctggccacagctgcatccctgcttgaggtgaaccccccagacctgatgagctgcctgactagccgcaccctcatcacccgcggggagacggtgtccaccccactgagcagggaacaggcactggacgtgcgcgacgccttcgtaaaggggatctacgggcggctgttcgtgtggattgtggacaagatcaacgcagcaatttacaagcctccctcccaggatgtgaagaactctcgcaggtccatcggcctcctggacatctttgggtttgagaactttgctgtgaacagctttgagcagctctgcatcaacttcgccaatgagcacctgcagcagttctttgtgcggcacgtgttcaagctggagcaggaggaatatgacctggagagcattgactggctgcacatcgagttcactgacaaccaggatgccctggacatgattgccaacaagcccatgaacatcatctccctcatcgatgaggagagcaagttccccaagggcacagacaccaccatgttacacaagctgaactcccagcacaagctcaacgccaactacatcccccccaagaacaaccatgagacccagtttggcatcaaccattttgcaggcatcgtctactatgagacccaaggcttcctggagaagaaccgagacaccctgcatggggacattatccagctggtccactcctccaggaacaagttcatcaagcagatcttccaggccgatgtcgccatgggcgccgagaccaggaagcgctcgcccacacttagcagccagttcaagcggtcactggagctgctgatgcgcacgctgggtgcctgccagcccttctttgtgcgatgcatcaagcccaatgagttcaagaagcccatgctgttcgaccggcacctgtgcgtgcgccagctgcggtactcaggaatgatggagaccatccgaatccgccgagctggctaccccatccgctacagcttcgtagagtttgtggagcggtaccgtgtgctgctgccaggtgtgaagccggcctacaagcagggcgacctccgcgggacttgccagcgcatggctgaggctgtgctgggcacccacgatgactggcagataggcaaaaccaagatctttctgaaggaccaccatgacatgctgctggaagtggagcgggacaaagccatcaccgacagagtcatcctccttcagaaagtcatccggggattcaaagacaggtctaactttctgaagctgaagaacgctgccacactgatccagaggcactggcggggtcacaactgtaggaagaactacgggctgatgcgtctgggcttcctgcggctgcaggccctgcaccgctcccggaagctgcaccagcagtaccgcctggcccgccagcgcatcatccagttccaggcccgctgccgcgcctatctggtgcgcaaggccttccgccaccgcctctgggctgtgctcaccgtgcaggcctatgcccggggcatgatcgcccgcaggctgcaccaacgcctcagggctgagtatctgtggcgcctcgaggctgagaaaatgcggctggcggaggaagagaagcttcggaaggagatgagcgccaagaaggccaaggaggaggccgagcgcaagcatcaggagcgcctggcccagctggctcgtgaggacgctgagcgggagctgaaggagaaggaggccgctcggcggaagaaggagctcctggagcagatggaaagggcccgccatgagcctgtcaatcactcagacatggtggacaagatgtttggcttcctggggacttcaggtggcctgccaggccaggagggccaggcacctagtggctttgaggacctggagcgagggcggagggagatggtggaggaggacctggatgcagccctgcccctgcctgacgaggatgaggaggacctctctgagtataaatttgccaagttcgcggccacctacttccaggggacaaccacgcactcctacacccggcggccactcaaacagccactgctctaccatgacgacgagggtgaccagctggcagccctggcggtctggatcaccatcctccgcttcatgggggacctccctgagcccaagtaccacacagccatgagtgatggcagtgagaagatccctgtgatgaccaagatttatgagaccctgggcaagaagacgtacaagagggagctgcaggccctgcagggcgagggcgaggcccagctccccgagggccagaagaagagcagtgtgaggcacaagctggtgcatttgactctgaaaaagaagtccaagctcacagaggaggtgaccaagaggctgcatgacggggagtccacagtgcagggcaacagcatgctggaggaccggcccacctccaacctggagaagctgcacttcatcatcggcaatggcatcctgcggccagcactccgggacgagatctactgccagatcagcaagcagctgacccacaacccctccaagagcagctatgcccggggctggattctcgtgtctctctgcgtgggctgtttcgccccctccgagaagtttgtcaagtacctgcggaacttcatccacgggggcccgcccggctacgccccgtactgtgaggagcgcctgagaaggacctttgtcaatgggacacggacacagccgcccagctggctggagctgcaggccaccaagtccaagaagccaatcatgttgcccgtgacattcatggatgggaccaccaagaccctgctgacggactcggcaaccacggccaaggagctctgcaacgcgctggccgacaagatctctctcaaggaccggttcgggttctccctctacattgccctgtttgacaaggtgtcctccctgggcagcggcagtgaccacgtcatggacgccatctcccagtgcgagcagtacgccaaggagcagggcgcccaggagcgcaacgccccctggaggctcttcttccgcaaagaggtcttcacgccctggcacagcccctccgaggacaacgtggccaccaacctcatctaccagcaggtggtgcgaggagtcaagtttggggagtacaggtgtgagaaggaggacgacctggctgagctggcctcccagcagtactttgtagactatggctctgagatgatcctggagcgcctcctgaacctcgtgcccacctacatccccgaccgcgagatcacgcccctgaagacgctggagaagtgggcccagctggccatcgccgcccacaagaaggggatttatgcccagaggagaactgatgcccagaaggtcaaagaggatgtggtcagttatgcccgcttcaagtggcccttgctcttctccaggttttatgaagcctacaaattctcaggccccagtctccccaagaacgacgtcatcgtggccgtcaactggacgggtgtgtactttgtggatgagcaggagcaggtacttctggagctgtccttcccagagatcatggccgtgtccagcagcaggggagcgaaaacgacggcccccagcttcacgctggccaccatcaagggggacgaatacaccttcacctccagtaatgctgaggacattcgtgacctggtggtcaccttcctagaggggctccggaagagatctaagtatgttgtggccctgcaggataaccccaaccccgcaggcgaggagtcaggcttcctcagctttgccaagggagacctcatcatcctggaccatgacacgggcgagcaggtcatgaactcgggctgggccaacggcatcaatgagaggaccaagcagcgtggggacttccccaccgacagtgtgtacgtcatgcccactgtcaccatgccaccgcgggagattgtggccctggtcaccatgactcccgatcagaggcaggacgttgtccggctcttgcagctgcgaacggcggagcccgaggtgcgtgccaagccctacacgctggaggagttttcctatgactacttcaggcccccacccaagcacacgctgagccgtgtcatggtgtccaaggcccgaggcaaggaccggctgtggagccacacgcgggaaccgctcaagcaggcgctgctcaagaagctcctgggcagtgaggagctctcgcaggaggcctgcctggccttcattgctgtgctcaagtacatgggcgactacccgtccaagaggacacgctccgtcaacgagctcaccgaccagatctttgagggtcccctgaaagccgagcccctgaaggacgaggcatatgtgcagatcctgaagcagctgaccgacaaccacatcaggtacagcgaggagcggggttgggagctgctctggctgtgcacgggccttttcccacccagcaacatcctcctgccccacgtgcagcgcttcctgcagtcccgaaagcactgcccactcgccatcgactgcctgcaacggctccagaaagccctgagaaacgggtcccggaagtaccctccgcacctggtggaggtggaggccatccagcacaagaccacccagattttccacaaggtctacttccctgatgacactgacgaggccttcgaagtggagtccagcaccaaggccaaggacttctgccagaacatcgccaccaggctgctcctcaagtcctcagagggattcagcctctttgtcaaaattgcagacaaggtcctcagcgttcctgagaatgacttcttctttgactttgttcgacacttgacagactggataaagaaagctcggcccatcaaggacggaattgtgccctcactcacctaccaggtgttcttcatgaagaagctgtggaccaccacggtgccagggaaggatcccatggccgattccatcttccactattaccaggagttgcccaagtatctccgaggctaccacaagtgcacgcgggaggaggtgctgcagctgggggcgctgatctacagggtcaagttcgaggaggacaagtcctacttccccagcatccccaagctgctgcgggagctggtgccccaggaccttatccggcaggtctcacctgatgactggaagcggtccatcgtcgcctacttcaacaagcacgcagggaagtccaaggaggaggccaagctggccttcctgaagctcatcttcaagtggcccacctttggctcagccttcttcgaggtgaagcaaactacggagccaaacttccctgagatcctcctaattgccatcaacaagtatggggtcagcctcatcgatcccaaaacgaaggatatcctcaccactcatcccttcaccaagatctccaactggagcagcggcaacacctacttccacatcaccattgggaacttggtgcgcgggagcaaactgctctgcgagacgtcactgggctacaagatggatgacctcctgacttcctacattagccagatgctcacagccatgagcaaacagcggggctccaggagcggcaagtgaacagtcacggggaggtgctggttccatgcctgctctcgaggcagcagtgggttcaggcccatcagctacccctgcagctggggaagacttatgccatcccggcagcgaggctgggctggccagccaccactgactataccaactgggcctctgatgttcttccagtgaggcatctctctgggatgcagaacttccctccatccacccctctggcacctgggttggtctaatcctagtttgctgtggccttcccggttgtgagagcctgtgatccttagatgtgtctcctgtttcagaccagccccaccatgcaacttcctttgactttctgtgtaccactgggatagaggaatcaagaggacaatctagctctccatactttgaacaaccaaatgtgcattgaatactctgaaaccgaagggactggatctgcaggtgggatgagggagacagaccacttttctatattgcagtgtgaatgctgggcccctgctcaagtctaccctgatcacctcagggcataaagcatgtttcattctctgaaaaacaaaaat

SEQ ID NO: 456560 - DNA, 6707 bp, Homo sapiens
gctctgggcaggagagagagggagagacaagagacacacacagagagacggcgaggaagggaaagacccagagggacgcctagaacgagacttggagccagacagaggaagaggggacgtgtgtttgcagactggctgggcccgtgacccagcttcctgagtcctccgtgcaggtggcagctgtaccaggctggcaggtcactgagagtgggcagctgggccccagaactgtgcctggcccagtgggcagcaggagctcctgacttgggaccatggtgattcttcagcagggggaccatgtgtggatggacctgagattggggcaggagttcgacgtgcccatcggggcggtggtgaagctctgcgactctgggcaggtccaggtggtggatgatgaagacaatgaacactggatctctccgcagaacgcaacgcacatcaagcctatgcaccccacgtcggtccacggcgtggaggacatgatccgcctgggggacctcaacgaggcgggcatcttgcgcaacctgcttatccgctaccgggaccacctcatctacacgtatacgggctccatcctggtggctgtgaacccctaccagctgctctccatctactcgccagagcacatccgccagtataccaacaagaagattggggagatgcccccccacatctttgccattgctgacaactgctacttcaacatgaaacgcaacagccgagaccagtgctgcatcatcagtggggaatctggggccgggaagacggagagcacaaagctgatcctgcagttcctggcagccatcagtgggcagcactcgtggattgagcagcaggtcttggaggccacccccattctggaagcatttgggaatgccaagaccatccgcaatgacaactcaagccgtttcggaaagtacatcgacatccacttcaacaagcggggcgccatcgagggcgcgaagattgagcagtacctgctggaaaagtcacgtgtctgtcgccaggccctggatgaaaggaactaccacgtgttctactgcatgctggagggtatgagtgaggatcagaagaagaagctgggcttgggccaggcctctgactacaactacttggccatgggtaactgcataacctgtgagggccgggtggacagccaggagtacgccaacatccgctccgccatgaaggtgctcatgttcactgacaccgagaactgggagatctcgaagctcctggctgccatcctgcacctgggcaacctgcagtatgaggcacgcacatttgaaaacctggatgcctgtgaggttctcttctccccatcgctggccacagctgcatccctgcttgaggtgaaccccccagacctgatgagctgcctgactagccgcaccctcatcacccgcggggagacggtgtccaccccactgagcagggaacaggcactggacgtgcgcgacgccttcgtaaaggggatctacgggcggctgttcgtgtggattgtggacaagatcaacgcagcaatttacaagcctccctcccaggatgtgaagaactctcgcaggtccatcggcctcctggacatctttgggtttgagaactttgctgtgaacagctttgagcagctctgcatcaacttcgccaatgagcacctgcagcagttctttgtgcggcacgtgttcaagctggagcaggaggaatatgacctggagagcattgactggctgcacatcgagttcactgacaaccaggatgccctggacatgattgccaacaagcccatgaacatcatctccctcatcgatgaggagagcaagttccccaagggcacagacaccaccatgttacacaagctgaactcccagcacaagctcaacgccaactacatcccccccaagaacaaccatgagacccagtttggcatcaaccattttgcaggcatcgtctactatgagacccaaggcttcctggagaagaaccgagacaccctgcatggggacattatccagctggtccactcctccaggaacaagttcatcaagcagatcttccaggccgatgtcgccatgggcgccgagaccaggaagcgctcgcccacacttagcagccagttcaagcggtcactggagctgctgatgcgcacgctgggtgcctgccagcccttctttgtgcgatgcatcaagcccaatgagttcaagaagcccatgctgttcgaccggcacctgtgcgtgcgccagctgcggtactcaggaatgatggagaccatccgaatccgccgagctggctaccccatccgctacagcttcgtagagtttgtggagcggtaccgtgtgctgctgccaggtgtgaagccggcctacaagcagggcgacctccgcgggacttgccagcgcatggctgaggctgtgctgggcacccacgatgactggcagataggcaaaaccaagatctttctgaaggaccaccatgacatgctgctggaagtggagcgggacaaagccatcaccgacagagtcatcctccttcagaaagtcatccggggattcaaagacaggtctaactttctgaagctgaagaacgctgccacactgatccagaggcactggcggggtcacaactgtaggaagaactacgggctgatgcgtctgggcttcctgcggctgcaggccctgcaccgctcccggaagctgcaccagcagtaccgcctggcccgccagcgcatcatccagttccaggcccgctgccgcgcctatctggtgcgcaaggccttccgccaccgcctctgggctgtgctcaccgtgcaggcctatgcccggggcatgatcgcccgcaggctgcaccaacgcctcagggctgagtatctgtggcgcctcgaggctgagaaaatgcggctggcggaggaagagaagcttcggaaggagatgagcgccaagaaggccaaggaggaggccgagcgcaagcatcaggagcgcctggcccagctggctcgtgaggacgctgagcgggagctgaaggagaaggaggccgctcggcggaagaaggagctcctggagcagatggaaagggcccgccatgagcctgtcaatcactcagacatggtggacaagatgtttggcttcctggggacttcaggtggcctgccaggccaggagggccaggcacctagtggctttgaggacctggagcgagggcggagggagatggtggaggaggacctggatgcagccctgcccctgcctgacgaggatgaggaggacctctctgagtataaatttgccaagttcgcggccacctacttccaggggacaaccacgcactcctacacccggcggccactcaaacagccactgctctaccatgacgacgagggtgaccagctggcagccctggcggtctggatcaccatcctccgcttcatgggggacctccctgagcccaagtaccacacagccatgagtgatggcagtgagaagatccctgtgatgaccaagatttatgagaccctgggcaagaagacgtacaagagggagctgcaggccctgcagggcgagggcgaggcccagctccccgagggccagaagaagagcagtgtgaggcacaagctggtgcatttgactctgaaaaagaagtccaagctcacagaggaggtgaccaagaggctgcatgacggggagtccacagtgcagggcaacagcatgctggaggaccggcccacctccaacctggagaagctgcacttcatcatcggcaatggcatcctgcggccagcactccgggacgagatctactgccagatcagcaagcagctgacccacaacccctccaagagcagctatgcccggggctggattctcgtgtctctctgcgtgggctgtttcgccccctccgagaagtttgtcaagtacctgcggaacttcatccacgggggcccgcccggctacgccccgtactgtgaggagcgcctgagaaggacctttgtcaatgggacacggacacagccgcccagctggctggagctgcaggccaccaagtccaagaagccaatcatgttgcccgtgacattcatggatgggaccaccaagaccctgctgacggactcggcaaccacggccaaggagctctgcaacgcgctggccgacaagatctctctcaaggaccggttcgggttctccctctacattgccctgtttgacaaggtgtcctccctgggcagcggcagtgaccacgtcatggacgccatctcccagtgcgagcagtacgccaaggagcagggcgcccaggagcgcaacgccccctggaggctcttcttccgcaaagaggtcttcacgccctggcacagcccctccgaggacaacgtggccaccaacctcatctaccagcaggtggtgcgaggagtcaagtttggggagtacaggtgtgagaaggaggacgacctggctgagctggcctcccagcagtactttgtagactatggctctgagatgatcctggagcgcctcctgaacctcgtgcccacctacatccccgaccgcgagatcacgcccctgaagacgctggagaagtgggcccagctggccatcgccgcccacaagaaggggatttatgcccagaggagaactgatgcccagaaggtcaaagaggatgtggtcagttatgcccgcttcaagtggcccttgctcttctccaggttttatgaagcctacaaattctcaggccccagtctccccaagaacgacgtcatcgtggccgtcaactggacgggtgtgtactttgtggatgagcaggagcaggtacttctggagctgtccttcccagagatcatggccgtgtccagcagcagggagtgccgtgtctggctctcactgggctgctctgatcttggctgtgctgcgcctcactcaggctgggcaggactgaccccggcggggccctgttctccgtgttggtcctgcaggggagcgaaaacgacggcccccagcttcacgctggccaccatcaagggggacgaatacaccttcacctccagtaatgctgaggacattcgtgacctggtggtcaccttcctagaggggctccggaagagatctaagtatgttgtggccctgcaggataaccccaaccccgcaggcgaggagtcaggcttcctcagctttgccaagggagacctcatcatcctggaccatgacacgggcgagcaggtcatgaactcgggctgggccaacggcatcaatgagaggaccaagcagcgtggggacttccccaccgacagtgtgtacgtcatgcccactgtcaccatgccaccgcgggagattgtggccctggtcaccatgactcccgatcagaggcaggacgttgtccggctcttgcagctgcgaacggcggagcccgaggtgcgtgccaagccctacacgctggaggagttttcctatgactacttcaggcccccacccaagcacacgctgagccgtgtcatggtgtccaaggcccgaggcaaggaccggctgtggagccacacgcgggaaccgctcaagcaggcgctgctcaagaagctcctgggcagtgaggagctctcgcaggaggcctgcctggccttcattgctgtgctcaagtacatgggcgactacccgtccaagaggacacgctccgtcaacgagctcaccgaccagatctttgagggtcccctgaaagccgagcccctgaaggacgaggcatatgtgcagatcctgaagcagctgaccgacaaccacatcaggtacagcgaggagcggggttgggagctgctctggctgtgcacgggccttttcccacccagcaacatcctcctgccccacgtgcagcgcttcctgcagtcccgaaagcactgcccactcgccatcgactgcctgcaacggctccagaaagccctgagaaacgggtcccggaagtaccctccgcacctggtggaggtggaggccatccagcacaagaccacccagattttccacaaggtctacttccctgatgacactgacgaggtgagggtcaccggcttctaggtctgcagtgcccaggacagggccgggcttcctgggtggacaccaaaggtggccttaagcctctcccccatcacctgacatttgccgcctcgtcctcctgccccgtagtggagtcggggctcaggacgaaggccatcgactccccaggtcaggggcccttggttcctgatccaacccctgcttcctggagcagcttccttcagaagggcgcccctccctccctgtctctgaggaggacttgccttggagaaaagcgcttctccctctgagctggctttgcactggctttgcacctccctgatgtagggccccactggcccccaggtccagacctcccctgtcgactgagcccactttcctgcaggcagaacctcaacaccccttcctccctctccacctgaggtggttgaggttccctccatccaggtcctgtctgccaaaggtcctgtctgtcatgcctgtagtcacgctgcccctcatggtccccagcccctgcctgtctcaacacagtgtctcattcagataagcttttcatttgaagagtcatttatgaaacttgtctgaggctggagactcagaaatgccataacaggatttcatttgcaaggaccaaagacttcctcaaatcctttcctgtccctccagacatctctcctgccattaaacttcccc

SEQ ID NO: 456561 - DNA, 4513 bp, Homo sapiens
gctctgggcaggagagagagggagagacaagagacacacacagagagacggcgaggaagggaaagacccagagggacgcctagaacgagacttggagccagacagaggaagaggggacgtgtgtttgcagactggctgggcccgtgacccagcttcctgagtcctccgtgcaggtggcagctgtaccaggctggcaggtcactgagagtgggcagctgggccccagaactgtgcctggcccagtgggcagcaggagctcctgacttgggaccatggtgattcttcagcagggggaccatgtgtggatggacctgagattggggcaggagttcgacgtgcccatcggggcggtggtgaagctctgcgactctgggcaggtccaggtggtggatgatgaagacaatgaacactggatctctccgcagaacgcaacgcacatcaagcctatgcaccccacgtcggtccacggcgtggaggacatgatccgcctgggggacctcaacgaggcgggcatcttgcgcaacctgcttatccgctaccgggaccacctcatctacacgtatacgggctccatcctggtggctgtgaacccctaccagctgctctccatctactcgccagagcacatccgccagtataccaacaagaagattggggagatgcccccccacatctttgccattgctgacaactgctacttcaacatgaaacgcaacagccgagaccagtgctgcatcatcagtggggaatctggggccgggaagacggagagcacaaagctgatcctgcagttcctggcagccatcagtgggcagcactcgtggattgagcagcaggtcttggaggccacccccattctggaagcatttgggaatgccaagaccatccgcaatgacaactcaagccgtttcggaaagtacatcgacatccacttcaacaagcggggcgccatcgagggcgcgaagattgagcagtacctgctggaaaagtcacgtgtctgtcgccaggccctggatgaaaggaactaccacgtgttctactgcatgctggagggtatgagtgaggatcagaagaagaagctgggcttgggccaggcctctgactacaactacttggccatgggtaactgcataacctgtgagggccgggtggacagccaggagtacgccaacatccgctccgccatgaaggtgctcatgttcactgacaccgagaactgggagatctcgaagctcctggctgccatcctgcacctgggcaacctgcagtatgaggcacgcacatttgaaaacctggatgcctgtgaggttctcttctccccatcgctggccacagctgcatccctgcttgaggtgaaccccccagacctgatgagctgcctgactagccgcaccctcatcacccgcggggagacggtgtccaccccactgagcagggaacaggcactggacgtgcgcgacgccttcgtaaaggggatctacgggcggctgttcgtgtggattgtggacaagatcaacgcagcaatttacaagcctccctcccaggatgtgaagaactctcgcaggtccatcggcctcctggacatctttgggtttgagaactttgctgtgaacagctttgagcagctctgcatcaacttcgccaatgagcacctgcagcagttctttgtgcggcacgtgttcaagctggagcaggaggaatatgacctggagagcattgactggctgcacatcgagttcactgacaaccaggatgccctggacatgattgccaacaagcccatgaacatcatctccctcatcgatgaggagagcaagttccccaagggcacagacaccaccatgttacacaagctgaactcccagcacaagctcaacgccaactacatcccccccaagaacaaccatgagacccagtttggcatcaaccattttgcaggcatcgtctactatgagacccaaggcttcctggagaagaaccgagacaccctgcatggggacattatccagctggtccactcctccaggaacaagttcatcaagcagatcttccaggccgatgtcgccatgggcgccgagaccaggaagcgctcgcccacacttagcagccagttcaagcggtcactggagctgctgatgcgcacgctgggtgcctgccagcccttctttgtgcgatgcatcaagcccaatgagttcaagaagcccatgctgttcgaccggcacctgtgcgtgcgccagctgcggtactcaggaatgatggagaccatccgaatccgccgagctggctaccccatccgctacagcttcgtagagtttgtggagcggtaccgtgtgctgctgccaggtgtgaagccggcctacaagcagggcgacctccgcgggacttgccagcgcatggctgaggctgtgctgggcacccacgatgactggcagataggcaaaaccaagatctttctgaaggaccaccatgacatgctgctggaagtggagcgggacaaagccatcaccgacagagtcatcctccttcagaaagtcatccggggattcaaagacaggtctaactttctgaagctgaagaacgctgccacactgatccagaggcactggcggggtcacaactgtaggaagaactacgggctgatgcgtctgggcttcctgcggctgcaggccctgcaccgctcccggaagctgcaccagcagtaccgcctggcccgccagcgcatcatccagttccaggcccgctgccgcgcctatctggtgcgcaaggccttccgccaccgcctctgggctgtgctcaccgtgcaggcctatgcccggggcatgatcgcccgcaggctgcaccaacgcctcagggctgagtatctgtggcgcctcgaggctgagaaaatgcggctggcggaggaagagaagcttcggaaggagatgagcgccaagaaggccaaggaggaggccgagcgcaagcatcaggagcgcctggcccagctggctcgtgaggacgctgagcgggagctgaaggagaaggaggccgctcggcggaagaaggagctcctggagcagatggaaagggcccgccatgagcctgtcaatcactcagacatggtggacaagatgtttggcttcctggggacttcaggtggcctgccaggccaggagggccaggcacctagtggctttgaggacctggagcgagggcggagggagatggtggaggaggacctggatgcagccctgcccctgcctgacgaggatgaggaggacctctctgagtataaatttgccaagttcgcggccacctacttccaggggacaaccacgcactcctacacccggcggccactcaaacagccactgctctaccatgacgacgagggtgaccagctggcagccctggcggtctggatcaccatcctccgcttcatgggggacctccctgagcccaagtaccacacagccatgagtgatggcagtgagaagatccctgtgatgaccaagatttatgagaccctgggcaagaagacgtacaagagggagctgcaggccctgcagggcgagggcgaggcccagctccccgagggccagaagaagagcagtgtgaggcacaagctggtgcatttgactctgaaaaagaagtccaagctcacagaggaggtgaccaagaggctgcatgacggggagtccacagtgcagggcaacagcatgctggaggaccggcccacctccaacctggagaagctgcacttcatcatcggcaatggcatcctgcggccagcactccgggacgagatctactgccagatcagcaagcagctgacccacaacccctccaagagcagctatgcccggggctggattctcgtgtctctctgcgtgggctgtttcgccccctccgagaagtttgtcaagtacctgcggaacttcatccacgggggcccgcccggctacgccccgtactgtgaggagcgcctgagaaggacctttgtcaatgggacacggacacagccgcccagctggctggagctgcaggccaccaagtccaagaagccaatcatgttgcccgtgacattcatggatgggaccaccaagaccctgctgacggactcggcaaccacggccaaggagctctgcaacgcgctggccgacaagatctctctcaaggaccggttcgggttctccctctacattgccctgtttgacaaggtatggccgcccggaagcacctcctcccggaagcacctcctcccggccccactccgggctgccagtgctgccacctacttgccggggctattcacccttgagcacctcggtttccccctgagcctgtgctaattggctctgcctgactcctcaggactgccgagaactcggccaggtgcggtggttcacacctgtaatcccagcactttgggaggctgaggcgggcagatcacaaagtcaggagttcgagaccagcctggctaatgtagtgaaacctcgtctctactaaaaatacaaaaattagtggagcacggtgg

SEQ ID NO: 456562 - DNA, 954 bp, Homo sapiens
caggagaggctgactttatcccagctggggccaggcttcattcctgtccccaaatgcttttcttgctctgggcccccatctgatgccttctcatctttttttctagcaaactacggagccaaacttccctgagatcctcctaattgccatcaacaagtatggggtcagcctcatcgatcccaaaacgaaggatatcctcaccactcatcccttcaccaagatctccaactggagcagcggcaacacctacttccacatcaccattgggaacttggtgcgcgggagcaaactgctctgcgagacgtcactgggctacaagatggatgacctcctgacttcctacattagccagatgctcacagccatgagcaaacagcggggctccaggagcggcaagtgaacagtcacggggaggtgctggttccatgcctgctctcgaggcagcagtgggttcaggcccatcagctacccctgcagctggggaagacttatgccatcccggcagcgaggctgggctggccagccaccactgactataccaactgggcctctgatgttcttccagtgaggcatctctctgggatgcagaacttccctccatccacccctctggcacctgggttggtctaatcctagtttgctgtggccttcccggttgtgagagcctgtgatccttagatgtgtctcctgtttcagaccagccccaccatgcaacttcctttgactttctgtgtaccactgggatagaggaatcaagaggacaatctagctctccatactttgaacaaccaaatgtgcattgaatactctgaaaccgaagggactggatctgcaggtgggatgagggagacagaccacttttctatattgcagtgtgaatgctgggcccctgctcaagtctaccctgatcacctcagggcataaagcatgtttcattctctgaaaaacaaaaat

SEQ ID NO: 456563 - DNA, 168 bp, Homo sapiens
ccggaaagtggagggatccgggtgtgggtggagggaggggcaggctggcaggtgagcacctggggtgttgcctgtaccaggtgaaccccccagacctgatgagctgcctgactagccgcaccctcatcacccgcggggagacggtgtccaccccactgagcagggaac

SEQ ID NO: 456564 - DNA, 1096 bp, Homo sapiens
gttccggtgggctctgaaccctgaaaggctcgcgatgcctctacacaagtatcccgtgtggctctggaagcggctgcagctgcgggagggcatctgttcccgcctgcccggccactacctgcgctccctggaggaggagcggacgcccactcccgtgcactataggcctcatggggccaagttcaagatcaaccccaagaacgggcagcgggagcgtgtggaggacgtgcccattcccatctactttccccccgaatcccagcgggggttgtggggcggcgagggctggatcctgggccaaatatatgccaacaacgacaagctctccaagaggctgaagaaagtgtggaagccacagctgtttgagcgagagttctacagtgagatcctggacaagaagttcacagtgactgtgaccatgcggaccctggacctcatcgatgaggcttatgggctcgacttttacatcctcaagaccccgaaggaggacctgtgctccaagtttgggatggacctgaagcgagggatgctgctgcggcttgcccggcaggacccccagctgcaccccgaggaccccgagcggcgggcagccatctacgacaagtacaaggaatttgccatcccagaggaggaggcagagtgggtgggcctcacgctggaggaggccattgagaagcagagacttttggaggagaaggaccctgtacccctgttcaagatctatgtggcggagctgatccagcagctgcagcagcaggcactgtcagagccggcggtggtgcagaagagagccagtggccagtgaccacacagctcctccatgcctgaccaacaggcccagctttccctgccaggccctttgcactgaggacacagatcccggggagctgtgagggccaccggtgggcagtgggtggatcctggtttcgtgtgctgcccatgcaccttccagcccggggccagcttggcagggatccccaggaggcctgggccgcccagaggctcctctcaggctgggccccgacgtttgcggcagtgttccttgtgcccgtggggccgggagcgagtaaagtctgggccaggctgtgtgtgtgta

SEQ ID NO: 456565 - DNA, 889 bp, Homo sapiens
gttccggtgggctctgaaccctgaaaggctcgcgatgcctctacacaagtatcccgtgtggctctggaagcggctgcagctgcgggagggcatctgttcccgcctgcccggccactacctgcgctccctggaggaggagcggacgcccactcccgtgcactataggcctcatggggccaagttcaagatcaaccccaagaacgggcagcgggagcgtgtggaggacgtgcccattcccatctactttccccccgaatcccagcgggggttgtggggcggcgagggctggatcctgggccaaatatatgccaacaacgacaagctctccaagaggctgaagaaagtgtggaagccacagctgtttgagcgagagttctacagtgagatcctggacaagaagttcacagtgactgtgaccatgcggaccctggacctcatcgatgaggcttatgggctcgacttttacatcctcaaggcaagcggggtggggcgagtcagtgcacacagggtctgggatgggccagtcagactcacgggagccccaggtcagcatcacaccggggcacgctgacatctgcacaggagggtcactgggaaagcgtgagtggggccatgcccctttctggccagcaccagtggggtttcctgccttcaggagaggctgtcgctctgtgggtggctgacttgcccgtggggcctgagcgagcacagccgcccctttccctgcacttggacttgcttctgtgctgatcccacccccaggctggggtgctgaggcggacccacccgggccttctctgtcctgtcctgggaccaccagcggctagagaggagccaggtgggttggctggaagggtaggtggggccctgccaccagcacctggcccca

SEQ ID NO: 456566 - DNA, 330 bp, Homo sapiens
tctccggcaaaggagcacgctgagtgaagaaccgcagttctggcaaacaggactgataaagtaggggtgaggtggggtgactcaggccgggggagcaaccagaggccgtggggagtcggggtaaagttaggatggggaggaggcctgtgtgatgagcagagcaggtgggagaggcgagcagagcaggtgggggaggcgagcagagcttcgagcaggaggcctgggccgcccagaggctcctctcaggctgggccccgacgtttgcggcagtgttccttgtgcccgtggggccgggagcgagtaaagtctgggccaggctgtgtgtgtgta

SEQ ID NO: 456567 - DNA, 1108 bp, Homo sapiens
  misc_feature (18)..(18): n is a, c, g, or t
  misc_feature (27)..(27): n is a, c, g, or t
aaaggctaggtacgaggnctgggtgtnggaacctgaaaggctcgcgatgcctctacacaagtatcccgtgtggctctggaagcggctgcagctgcgggagggcatctgttcccgcctgcccggccactacctgcgctccctggaggaggagcggacgcccactcccgtgcactataggcctcatggggccaagttcaagatcaaccccaagaacgggcagcgggagcgtgtggaggacgtgcccattcccatctactttccccccgaatcccagcgggggttgtggggcggcgagggctggatcctgggccaaatatatgccaacaacgacaagctctccaagaggctgaagaaagtgtggaagccacagctgtttgagcgagagttctacagtgagatcctggacaagaagttcacagtgactgtgaccatgcggaccctggacctcatcgatgaggcttatgggctcgacttttacatcctcaagaccccgaaggaggacctgtgctccaagtttgggatggacctgaagcgagggatgctgctgcggcttgcccggcaggacccccagctgcaccccgaggaccccgagcggcgggcagccatctacgacaagtacaaggaatttgccatcccagaggaggaggcagagtgggtgggcctcacgctggaggaggccattgagaagcagagacttttggaggagaaggaccctgtacccctgttcaagatctatgtggcggagctgatccagcagctgcagcagcaggcactgtcagagccggcggtggtgcagaagagagccagtggccagtgaccacacagctcctccatgcctgaccaacaggcccagctttccctgccaggccctttgcactgaggacacagatcccggggagctgtgagggccaccggtgggcagtgggtggatcctggtttcgtgtgctgcccatgcaccttccagcccggggccagcttggcagggatccccaggaggcctgggccgcccagaggctcctctcaggctgggccccgacgtttgcggcagtgttccttgtgcccgtggggccgggagcgagtaaagtctgggccaggctgtgtgtgtgta

SEQ ID NO: 456568 - DNA, 1116 bp, Homo sapiens
cggctaaggtacgaggcctgggtggttgtgggtctgaaccctgaaaggctcgcgatgcctctacacaagtatcccgtgtggctctggaagcggctgcagctgcgggagggcatctgttcccgcctgcccggccactacctgcgctccctggaggaggagcggacgcccactcccgtgcactataggcctcatggggccaagttcaagatcaaccccaagaacgggcagcgggagcgtgtggaggacgtgcccattcccatctactttccccccgaatcccagcgggggttgtggggcggcgagggctggatcctgggccaaatatatgccaacaacgacaagctctccaagaggctgaagaaagtgtggaagccacagctgtttgagcgagagttctacagtgagatcctggacaagaagttcacagtgactgtgaccatgcggaccctggacctcatcgatgaggcttatgggctcgacttttacatcctcaagaccccgaaggaggacctgtgctccaagtttgggatggacctgaagcgagggatgctgctgcggcttgcccggcaggacccccagctgcaccccgaggaccccgagcggcgggcagccatctacgacaagtacaaggaatttgccatcccagaggaggaggcagagtgggtgggcctcacgctggaggaggccattgagaagcagagacttttggaggagaaggaccctgtacccctgttcaagatctatgtggcggagctgatccagcagctgcagcagcaggcactgtcagagccggcggtggtgcagaagagagccagtggccagtgaccacacagctcctccatgcctgaccaacaggcccagctttccctgccaggccctttgcactgaggacacagatcccggggagctgtgagggccaccggtgggcagtgggtggatcctggtttcgtgtgctgcccatgcaccttccagcccggggccagcttggcagggatccccaggaggcctgggccgcccagaggctcctctcaggctgggccccgacgtttgcggcagtgttccttgtgcccgtggggccgggagcgagtaaagtctgggccaggctgtgtgtgtgta

SEQ ID NO: 456569 - DNA, 1115 bp, Homo sapiens
ggcaggtggggtgtgggggggcgccggggcagaaggggaggggcaggctcgcgatgcctctacacaagtatcccgtgtggctctggaagcggctgcagctgcgggagggcatctgttcccgcctgcccggccactacctgcgctccctggaggaggagcggacgcccactcccgtgcactataggcctcatggggccaagttcaagatcaaccccaagaacgggcagcgggagcgtgtggaggacgtgcccattcccatctactttccccccgaatcccagcgggggttgtggggcggcgagggctggatcctgggccaaatatatgccaacaacgacaagctctccaagaggctgaagaaagtgtggaagccacagctgtttgagcgagagttctacagtgagatcctggacaagaagttcacagtgactgtgaccatgcggaccctggacctcatcgatgaggcttatgggctcgacttttacatcctcaagaccccgaaggaggacctgtgctccaagtttgggatggacctgaagcgagggatgctgctgcggcttgcccggcaggacccccagctgcaccccgaggaccccgagcggcgggcagccatctacgacaagtacaaggaatttgccatcccagaggaggaggcagagtgggtgggcctcacgctggaggaggccattgagaagcagagacttttggaggagaaggaccctgtacccctgttcaagatctatgtggcggagctgatccagcagctgcagcagcaggcactgtcagagccggcggtggtgcagaagagagccagtggccagtgaccacacagctcctccatgcctgaccaacaggcccagctttccctgccaggccctttgcactgaggacacagatcccggggagctgtgagggccaccggtgggcagtgggtggatcctggtttcgtgtgctgcccatgcaccttccagcccggggccagcttggcagggatccccaggaggcctgggccgcccagaggctcctctcaggctgggccccgacgtttgcggcagtgttccttgtgcccgtggggccgggagcgagtaaagtctgggccaggctgtgtgtgtgta

SEQ ID NO: 456570 - DNA, 876 bp, Homo sapiens
tgacacgggggcccagcacgagtagtcctcatgggcactcacagactgcgtgctctcatgtacttccagtgctggagcatggtatgaccagattttatcacagtgccatttgaagggaaaggagttcagacagacagacgtattccccaaaaagggataccccagagccgatggtgttcagccatttagcagctgaaaaaggaaacagtgcacaccaatgggaggcagcctgcgtagccctcatcaggcaagacagactgaatgcaggagtgggtgattagctgctccttgaacttgaggctgccttggcagcaggggcacagcaggcctcaagagcccctaattgtctcagggttcaaaggaagacactgacctttcccatcccggtgggaagtcgacttcccacgggaggaggcagagtgggtgggcctcacgctggaggaggccattgagaagcagagacttttggaggagaaggaccctgtacccctgttcaagatctatgtggcggagctgatccagcagctgcagcagcaggcactgtcagagccggcggtggtgcagaagagagccagtggccagtgaccacacagctcctccatgcctgaccaacaggcccagctttccctgccaggccctttgcactgaggacacagatcccggggagctgtgagggccaccggtgggcagtgggtggatcctggtttcgtgtgctgcccatgcaccttccagcccggggccagcttggcagggatccccaggaggcctgggccgcccagaggctcctctcaggctgggccccgacgtttgcggcagtgttccttgtgcccgtggggccgggagcgagtaaagtctgggccaggctgtgtgtgtgta

SEQ ID NO: 456571 - DNA, 668 bp, Homo sapiens
gttccggtgggctctgaaccctgaaaggctcgcgatgcctctacacaagtatcccgtgtggctctggaagcggctgcagctgcgggagggcatctgttcccgcctgcccggccactacctgcgctccctggaggaggagcggacgcccactcccgtgcactataggcctcatggggccaagttcaagatcaaccccaagaacgggcagcgggagcgtgtggaggacgtgcccattcccatctactttccccccgaatcccagcgggggttgtggggcggcgagggctggatcctgggccaaatatatgccaacaacgacaaggcagcaggcactgtcagagccggcggtggtgcagaagagagccagtggccagtgaccacacagctcctccatgcctgaccaacaggcccagctttccctgccaggccctttgcactgaggacacagatcccggggagctgtgagggccaccggtgggcagtgggtggatcctggtttcgtgtgctgcccatgcaccttccagcccggggccagcttggcagggatccccaggaggcctgggccgcccagaggctcctctcaggctgggccccgacgtttgcggcagtgttccttgtgcccgtggggccgggagcgagtaaagtctgggccaggctgtgtgtgtgta

SEQ ID NO: 456572 - DNA, 440 bp, Homo sapiens
gttccggtgggctctgaaccctgaaaggctcgcgatgcctctacacaagtatcccgtgtggctctggaagcggctgcagctgcgggagggcatctgttcccgcctgcccggccactacctgcgctccctggaggaggagcggacgcccactcccgtgcactataggcctcatggggccaagttcaagatcaaccccaagaacgggcagcgggagcgtgtggaggacgtgcccattcccatctactttccccccgaatcccagcgggggttgtggggcggcgagggctggatcctgggccaaatatatgccaacaacgacaagcaggaggcctgggccgcccagaggctcctctcaggctgggccccgacgtttgcggcagtgttccttgtgcccgtggggccgggagcgagtaaagtctgggccaggctgtgtgtgtgta

SEQ ID NO: 456573 - DNA, 1001 bp, Homo sapiens
cggctaaggtacgaggcctgggtggttgtgggtctgaaccctgaaaggctcgcgatgcctctacacaagtatcccgtgtggctctggaagcggctgcagctgcgggagggcatctgttcccgcctgcccggccactacctgcgctccctggaggaggagcggacgcccactcccgtgcactataggcctcatggggccaagttcaagatcaaccccaagaacgggcagcgggagcgtgtggaggacgtgcccattcccatctactttccccccgaatcccagcgggggttgtggggcggcgagggctggatcctgggccaaatatatgccaacaacgacaagctctccaagaggctgaagaaagtgtggaagccacagctgtttgagcgagagttctacagtgagatcctggacaagaagttcacagtgactgtgaccatgcggaccctggacctcatcgatgaggcttatgggctcgacttttacatcctcaagaccccgaaggaggacctgtgctccaagtttgggatggacctgaagcgagggatgctgctgcggcttgcccggcaggacccccagctgcaccccgaggaccccgagcggcgggcagccatctacgacaagtacaaggaatttgccatcccagaggaggaggcagagtgggtgggcctcacgctggaggaggccattgagaagcagagacttttggaggagaaggaccctgtacccctgttcaagatctatgtggcggagctgatccagcagctgcagcagcaggcactgtcagagccggcggtggtgcagaagagagccagtggccagtgagagccagaagtccatgctggacaaaggccaagatcgccgggccttggtgggcccatccggaggagagcacgggagggggacgggcgggcagcccacggagggagcccagatggcaagcttcgggccgagaagtcagcgaacagggaacaaacatggggaggatacactgcgcgcaa

SEQ ID NO: 456574 - DNA, 1148 bp, Homo sapiens
agccagtcagcggtgggaggagggccaggcgcggcagatcggcttccggttccggtgggctctgaaccctgaaaggtgggctcgcgatgcctctacacaagtatcccgtgtggctctggaagcggctgcagctgcgggagggcatctgttcccgcctgcccggccactacctgcgctccctggaggaggagcggacgcccactcccgtgcactataggcctcatggggccaagttcaagatcaaccccaagaacgggcagcgggagcgtgtggaggacgtgcccattcccatctactttccccccgaatcccagcgggggttgtggggcggcgagggctggatcctgggccaaatatatgccaacaacgacaagctctccaagaggctgaagaaagtgtggaagccacagctgtttgagcgagagttctacagtgagatcctggacaagaagttcacagtgactgtgaccatgcggaccctggacctcatcgatgaggcttatgggctcgacttttacatcctcaagaccccgaaggaggacctgtgctccaagtttgggatggacctgaagcgagggatgctgctgcggcttgcccggcaggacccccagctgcaccccgaggaccccgagcggcgggcagccatctacgacaagtacaaggaatttgccatcccagaggaggaggcagagtgggtgggcctcacgctggaggaggccattgagaagcagagacttttggaggagaaggaccctgtacccctgttcaagatctatgtggcggagctgatccagcagctgcagcagcaggcactgtcagagccggcggtggtgcagaagagagccagtggccagtgaccacacagctcctccatgcctgaccaacaggcccagctttccctgccaggccctttgcactgaggacacagatcccggggagctgtgagggccaccggtgggcagtgggtggatcctggtttcgtgtgctgcccatgcaccttccagcccggggccagcttggcagggatccccaggaggcctgggccgcccagaggctcctctcaggctgggccccgacgtttgcggcagtgttccttgtgcccgtggggccgggagcgagtaaagtctgggccaggctgtgtgtgtgta

SEQ ID NO: 456575 - DNA, 1128 bp, Homo sapiens
  misc_feature (27)..(27): n is a, c, g, or t
  misc_feature (51)..(51): n is a, c, g, or t
cattagtgctagtagaggctggtgttnaatcggacgagggtgggctctgancctgaaaggctcgcgatgcctctacacaagtatcccgtgtggctctggaagcggctgcagctgcgggagggcatctgttcccgcctgcccggccactacctgcgctccctggaggaggagcggacgcccactcccgtgcactataggcctcatggggccaagttcaagatcaaccccaagaacgggcagcgggagcgtgtggaggacgtgcccattcccatctactttccccccgaatcccagcgggggttgtggggcggcgagggctggatcctgggccaaatatatgccaacaacgacaagctctccaagaggctgaagaaagtgtggaagccacagctgtttgagcgagagttctacagtgagatcctggacaagaagttcacagtgactgtgaccatgcggaccctggacctcatcgatgaggcttatgggctcgacttttacatcctcaagaccccgaaggaggacctgtgctccaagtttgggatggacctgaagcgagggatgctgctgcggcttgcccggcaggacccccagctgcaccccgaggaccccgagcggcgggcagccatctacgacaagtacaaggaatttgccatcccagaggaggaggcagagtgggtgggcctcacgctggaggaggccattgagaagcagagacttttggaggagaaggaccctgtacccctgttcaagatctatgtggcggagctgatccagcagctgcagcagcaggcactgtcagagccggcggtggtgcagaagagagccagtggccagtgaccacacagctcctccatgcctgaccaacaggcccagctttccctgccaggccctttgcactgaggacacagatcccggggagctgtgagggccaccggtgggcagtgggtggatcctggtttcgtgtgctgcccatgcaccttccagcccggggccagcttggcagggatccccaggaggcctgggccgcccagaggctcctctcaggctgggccccgacgtttgcggcagtgttccttgtgcccgtggggccgggagcgagtaaagtctgggccaggctgtgtgtgtgta

SEQ ID NO: 456576 - DNA, 911 bp, Homo sapiens
aatttttaaaaatcataccatgtgggggacaggcacggtggctcacgcctgtagtcccagcactttggaagactgaggtgggcggatcacttgaggtcaggagttcgagaccccccttgaaggagaaatctcacaagctctccaagaggctgaagaaagtgtggaagccacagctgtttgagcgagagttctacagtgagatcctggacaagaagttcacagtgactgtgaccatgcggaccctggacctcatcgatgaggcttatgggctcgacttttacatcctcaagaccccgaaggaggacctgtgctccaagtttgggatggacctgaagcgagggatgctgctgcggcttgcccggcaggacccccagctgcaccccgaggaccccgagcggcgggcagccatctacgacaagtacaaggaatttgccatcccagaggaggaggcagagtgggtgggcctcacgctggaggaggccattgagaagcagagacttttggaggagaaggaccctgtacccctgttcaagatctatgtggcggagctgatccagcagctgcagcagcaggcactgtcagagccggcggtggtgcagaagagagccagtggccagtgaccacacagctcctccatgcctgaccaacaggcccagctttccctgccaggccctttgcactgaggacacagatcccggggagctgtgagggccaccggtgggcagtgggtggatcctggtttcgtgtgctgcccatgcaccttccagcccggggccagcttggcagggatccccaggaggcctgggccgcccagaggctcctctcaggctgggccccgacgtttgcggcagtgttccttgtgcccgtggggccgggagcgagtaaagtctgggccaggctgtgtgtgtgta

SEQ ID NO: 456577 - DNA, 500 bp, Homo sapiens
ggcaggtggggtgtgggggggcgccggggcagaaggggaggggcaggctcgcgatgcctctacacaagtatcccgtgtggctctggaagcggctgcagctgcgggagggcatctgttcccgcctgcccggccactacctgcgctccctggaggagcagcaggcactgtcagagccggcggtggtgcagaagagagccagtggccagtgaccacacagctcctccatgcctgaccaacaggcccagctttccctgccaggccctttgcactgaggacacagatcccggggagctgtgagggccaccggtgggcagtgggtggatcctggtttcgtgtgctgcccatgcaccttccagcccggggccagcttggcagggatccccaggaggcctgggccgcccagaggctcctctcaggctgggccccgacgtttgcggcagtgttccttgtgcccgtggggccgggagcgagtaaagtctgggccaggctgtgtgtgtgta

SEQ ID NO: 456578 - DNA, 542 bp, Homo sapiens
aagctagtgaccactgattacagaattgcgagctcaggtacccatttcgtgcaggtgctaaagggaattcagtgcatggtgctataggggatatcggtgcatggtgctcaagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacata

SEQ ID NO: 456579 - DNA, 3328 bp, Homo sapiens
  misc_feature (2805)..(2805): n is a, c, g, or t
cgctccctcccgctcgcagcttacttaacctggcccgggcggcggaggcgctctcacttccctggagccgcccgcttgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagctgaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggattgtaactgtgaactgtgcccggctgctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtggagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtcttcgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacataaaaaaaaaaaaaaaaaaaaaaaaaaaaaaaaaaaaaaaaanaaaaaaaaaagggggcggcgcgcgcgcgacaaaaaaagatatccccccggagggggcgcacacgaaatatagccgcgcggaccccaggttcttctgttgagcacaaggggggggcccaataatagggaggcggcgaactaattataacgcacgagacgcgaggcgggcggcggggtataaacaaccgcgggcgcgcgaggcggcgggggaacacacgcgtgccgctcaccggaagagaacactcgtggggaaaaaagagacacccctataacccgggcgggggggagcgcaacacaaactgcgggggcacaactcctccccatgcacgaggagatatttaaagacgctccccggaggggagcaaaatctattcacaaacttttcccaacacgggctaacaacacgggtggcgtcccacaccagcagcagcgacctaatggcgtggtgcgagtgctcagcaaaacatttttggcgcgccaaccgggagacatgttgatttcgggcaacaattttttcgcgcggg

SEQ ID NO: 456580 - DNA, 2940 bp, Homo sapiens
  misc_feature (2805)..(2805): n is a, c, g, or t
cgctccctcccgctcgcagcttacttaacctggcccgggcggcggaggcgctctcacttccctggagccgcccgcttgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagctgaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggattgtaactgtgaactgtgcccggctgctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtggagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtcttcgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacataaaaaaaaaaaaaaaaaaaaaaaaaaaaaaaaaaaaaaaaanaggggggttttatttggggggggggaaaaagaggttataaagggggtgtggtaaagggttcgggacacctttttgtagaaagggggaaaaggggggggcccaaagggggggggataaaatgagagacggggtcta

SEQ ID NO: 456581 - DNA, 3117 bp, Homo sapiens
  misc_feature (2805)..(2805): n is a, c, g, or t
cgctccctcccgctcgcagcttacttaacctggcccgggcggcggaggcgctctcacttccctggagccgcccgcttgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagctgaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggattgtaactgtgaactgtgcccggctgctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtggagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtcttcgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacataaaaaaaaaaaaaaaaaaaaaaaaaaaaaaaaaaaaaaaaanaagacaacaacaaacaaaaaaaaaacaaaaaaagacgaggggggcggcggcgccccgccgacccccccgcgcgaggcccccaacgctcacgcagcccaccggcatgctgcttgccgacctcacgaacgggtgcgccccgcccaactcaggcggcgcgcgccgcatctatattacacgcacgccgtacgtgcgcggtcctcgcgtcctctccctcacgcccctgcgtcgtggtgggctcacctccgccgtccttcttcgcgccgcgcttccgttgcgccccccccccccctccctcccgcgggcgcacgctcg

SEQ ID NO: 456582 - DNA, 3528 bp, Homo sapiens
cgctccctcccgctcgcagcttacttaacctggcccgggcggcggaggcgctctcacttccctggagccgcccgcttgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagctgaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggattgtaactgtgaactgtgcccggctgctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtggagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtcttcgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacataaagaacacaatagagagaaaaaatgcgagggactctatagagttccgagggtgcgcgaacaacagccaggtaggtgcaacacggggcacacgtggcttcactcatgcgagttttccgtcgaaccacagattaccctaggtcttcaccaacagccgggacacaactctgagcgcggtttctccccctatcctatgcgtccgcaagtccgcacctagcagacttgtcagcaatataacacagcgcgcatgggcacaccccgtgttgccaatctcaatgtgagaaacttcggcgcgacacagtagccctccctccagaccatacaccccccaactgagagagcgccgcaccgagcagacctccctcccacatcgcagacgaacgccgagaagaaccaaatcagacaactagaaacccgcataaaccgctacaaacataggtagcacacaacaaactaacacaaatacacaatcctaacaaaaaccaacacccccaactaaaactccgctcaaccctagggcgaaaaagaggccaaaaccaatagcatgcaaagccacgcatgacacccacgacatcccactgcaacaaacgacagaaccctataactaaagtacaaaagcaccaaccacaagaagacctcagaacgaaaaccatacaaactcatgaccaacacagcgccccaaacctaaccgacagacaacagaaacagcaaagcaaacacaaaaccaatcaccaaacaagccaaatacaaacgcacgcgaaacgca

SEQ ID NO: 456583 - DNA, 2543 bp, Homo sapiens
gaagtaactgacgggtgattaatagatgcttggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagctgaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggattgtaactgtgaactgtgcccggctgctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtggagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtcttcgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacata

SEQ ID NO: 456584 - DNA, 2710 bp, Homo sapiens
cgctccctcccgctcgcagcttacttaacctggcccgggcggcggaggcgctctcacttccctggagccgcccgcttgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagctgaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggattgtaactgtgaactgtgcccggctgctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtggagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaacgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtcttcgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacata

SEQ ID NO: 456585 - DNA, 2744 bp, Homo sapiens
cgctccctcccgctcgcagcttacttaacctggcccgggcggcggaggcgctctcacttccctggagccgcccgcttgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagctgaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggattgtaactgtgaactgtgcccggctgctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtggagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtcttcgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctaccttgtgttttctttcaggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacata

SEQ ID NO: 456586 - DNA, 2484 bp, Homo sapiens
cgctccctcccgctcgcagcttacttaacctggcccgggcggcggaggcgctctcacttccctggagccgcccgcttgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggattgtaactgtgaactgtgcccggctgctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtggagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtcttcgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacata

SEQ ID NO: 456587 - DNA, 2277 bp, Homo sapiens
cgctccctcccgctcgcagcttacttaacctggcccgggcggcggaggcgctctcacttccctggagccgcccgcttgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagctgaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggattgtaactgtgaactgtgcccggctgctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtggagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtcttcgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccagggcttcccagaggtctgtgcgactagcccctgtctatcaaaagttattagagaggatgaagcattagcttgaagcactacaggaggaatgcaccacggcagctctccgccaatttctctcagatttccacagagacatggtgtgtttgtaataataaaaccaaagaaacata

SEQ ID NO: 456588 - DNA, 2034 bp, Homo sapiens
  misc_feature (161)..(161): n is a, c, g, or t
ggtccaccatcaacaagcaacatccaggcagatcattgacgatcgagagacacacttgtgaggacgccttcggagcatgctggtgagactgcatacagggggcctcgaatcgacagatagcgtattgcaaggataaacgcgtcgcaggtatcgagcagctntggttgggcaccccagacgcacatagaagcgccgttgcgaagcaatgatacccatagatgcagcacttatgataccggtcatccctgcgtggcgaccgccagacaagccactcgagatgatgctgcatgaatcgaaccagcgacctgctgaacaaccacatcttgaagtcagctatgtgtgctgaagccatcgttgcggggctgtctgtggagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtcttcgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacata

SEQ ID NO: 456589 - DNA, 2030 bp, Homo sapiens
gctgatacagtgagtattgattctttgggctgtagtcagatattggattatgatcaatattatcaccatttattttgttgctccagttcttccagctgtggccaatccttcagttggattcttgtgccccatcaacattctccatcctggctttttgttttgagcacttccttccttcctagcaccaccaggctcctgtattatccctgtccctgccctggaatcgactcctcctccagagagccctggtttcttttgttagaggatggtatatagaatccaacatgcagacacttggtggacttattgttactggggttttgttatactagggtttcagtggtcagtgctagtatttatgtatgttaacccacgctgtgcgttgagatcaggcatgtccggacatgcctgaatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtcttcgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacata

SEQ ID NO: 456590 - DNA, 1699 bp, Homo sapiens
cgctccctcccgctcgcagcttacttaacctggcccgggcggcggaggcgctctcacttccctggagccgcccgcttgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagctgaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggattgtaactgtgaactgtgcccggctgctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtggagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatgtaagttctgggtcctaaatcatgctcctgggaagctccttactgtgggacttgtattagtgtaaaaaaaaatgtcctcaataagcaggagtttgcatgagaactggttgctgacaaggaaggaaataatttctggaaaatatagataacaaaatgagatcctgcagaa

SEQ ID NO: 456591 - DNA, 1451 bp, Homo sapiens
  misc_feature (135)..(135): n is a, c, g, or t
gggctttacctttattacaaaaattaagagcaaaggctggtgagttacacttcttcctccccaccaggtgctctctgcagctctggaaaaatggtgtcctctttgttgtcccaccagggggcgccacctccagcnccgccccagcctcatacccagttcttcagctcggccagcggtaactgaagcctcccagaatcctggatccgggcccctagtaccctctttcccagggacccaggagtcctgcctccagtcgcctgcacttgtaactgagagctggagggtgcccagcttcatgagaccccggaatgggttggacagtcccatctgtctccgggtccttcagattggctgaaggaagagactgaagaatgaggcttaagttctcattggtgagatgggaatatgaaacagcatgtatttactaccagtgttgtggggagaaaaagaaaagaaaagaaaagaatggaaagtgcccagaaatgtgcctggtgcttaatagatctatttgcagcctggagacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacata

SEQ ID NO: 456592 - DNA, 1260 bp, Homo sapiens
cgctccctcccgctcgcagcttacttaacctggcccgggcggcggaggcgctctcacttccctggagccgcccgcttgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagctgaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggattgtaactgtgaactgtgcccggctgctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagaggtgagcatcctttggctcctgctgctgcctcatttgtgcagctagattgagcccaagacctgctctggtccaagatgaacataccacctgccatgaggtgaccctcaggatatccactgcagccatgggctggggtcatcctgtcctgttgcttcagctaaccgtgtctctagcagccacactactctgagggctgactacagaatccagcagcttttgtctgggag

SEQ ID NO: 456593 - DNA, 781 bp, Homo sapiens
aagctagtgaccactgattacagaattgcgagctcaggtacccatttcgtgcaggtgctaaagggaattcagtgcatggtgctataggggatatcggtgcatggtgctcaagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacata

SEQ ID NO: 456594 - DNA, 405 bp, Homo sapiens
caacaacatccagcagatcattgagatcgaggacacctttgagacccttcgggtaagggactgccctgggtggaggcccaggcttgggacacattgcctcccaagaggggcctagcaggaactcttctgcaggagaggtagaggatggctcctgtaggggaacatagagcaggttcccctgaatgcccttgaacatggagaattcattgaccagacattcagcttgacctaacctgtgaaattctccatcttctttataaagtgttcccttccttgcctcccctggaaaggtcagtggtgtgtggctgcagcagcacagtgtcctctgagccctggacctgcactgtggcttccagaggtggcagttcccacatggggtactagaataaatggcctatcaggctg

SEQ ID NO: 456595 - DNA, 2764 bp, Homo sapiens
cgctccctcccgctcgcagcttacttaacctggcccgggcggcggaggcgctctcacttccctggagccgcccgcttgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagctgaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggattgtaactgtgaactgtgcccggctgctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtggagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtcttcgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacata

SEQ ID NO: 456596 - DNA, 3082 bp, Homo sapiens
  misc_feature (2805)..(2805): n is a, c, g, or t
cgctccctcccgctcgcagcttacttaacctggcccgggcggcggaggcgctctcacttccctggagccgcccgcttgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagctgaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggattgtaactgtgaactgtgcccggctgctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtggagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtcttcgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacataaaaaaaaaaaaaaaaaaaaaaaaaaaaaaaaaaaaaaaaanaaaaaaaaaagggggggggggaaaaaattctccccgggggggcccattgggcgcgtgaaccacgagattttctgcgaacaaaaggggggcgccccaaagaaggaggcgcggcacaataataacgccgacggagccaggagggcgcacggacgttataaccaaggacggcgacgacggggggaacaatgtcgacccaggggagcaccctcgcgaggagaagaaccccatcaccaagggggggggcgcaaacatggtgggcgacacactcaccctgaga

SEQ ID NO: 456597 - DNA, 2963 bp, Homo sapiens
cgctccctcccgctcgcagcttacttaacctggcccgggcggcggaggcgctctcacttccctggagccgcccgcttgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagctgaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggattgtaactgtgaactgtgcccggctgctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtggagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtcttcgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacataaaaaacaacaatacaacacacatataaaacaaacataaaaacaacaaaatacattgaaacaaacaaacacaaagaaaacaccaaaacaaaagaaaacaaacaagaacatagcacaataataaaaaataaacaaactcagctaataaagaccactcactcacctgctttgtacacaactaaggcgcacatactactcctt

SEQ ID NO: 456598 - DNA, 2805 bp, Homo sapiens
cgctccctcccgctcgcagcttacttaacctggcccgggcggcggaggcgctctcacttccctggagccgcccgcttgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagctgaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggattgtaactgtgaactgtgcccggctgctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtggagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaaggagcacatctctctggacctaaccatcaccctttcttgtagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtcttcgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacata

SEQ ID NO: 456599 - DNA, 2762 bp, Homo sapiens
cgctccctcccgctcgcagcttacttaacctggcccgggcggcggaggcgctctcacttccctggagccgcccgcttgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagctgaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggattgtaactgtgaactgtgcccggctgctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtggagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtcttcgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccagggttaccaacttctctttttcagccccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacata

SEQ ID NO: 456600 - DNA, 3119 bp, Homo sapiens
cgctccctcccgctcgcagcttacttaacctggcccgggcggcggaggcgctctcacttccctggagccgcccgcttgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagctgtgagatgacctccgtctgcccgggggactcttatggggaactgccttacttccccgaggggtgggcatgatgaatgggagtctgcagtcatttcctactgtttcaggaagctttctccttaaccccttagaaaaggctgtggaacttgagctaaaatatgtcttaccaggttgcgtctaatgccccccgttccctactgggcagaaagacttgggtgcttcctgaggagggatccttggcagaagagaggcctgggctcacgagggctgagaacatgtttcccagagttgcaaggacccatctcttaaacacagagtctgcagcccctaactgacaccctgtccttcctcctaggaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggattgtaactgtgaactgtgcccggctgctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtggagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtcttcgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacata

SEQ ID NO: 456601 - DNA, 2067 bp, Homo sapiens
ggcaggtacgaggctgggtggtaatcggccgaggctatcctaatgggattgtaactgtgaactgtgcccggctgctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtggagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtcttcgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacata

SEQ ID NO: 456602 - DNA, 2581 bp, Homo sapiens
cgctccctcccgctcgcagcttacttaacctggcccgggcggcggaggcgctctcacttccctggagccgcccgcttgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagctgaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggattgtaactgtgaactgtgcccggctgctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtggagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtcttcgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccaggtaagtgtcgcatccccactgactctgcagccagtccttttcttcatgtggcagttggtggagagaagaaaaactgttctaaacaatgatgagaataacatgtaattgtgatagttaaactgtgcctatgtgactgattgcagagtgaattgggagctgttggttttgaatgcaccacactaaggaatgtgaggacacattgctctttgcggagttgcccagctatattagctcccctcggacacagcccagttttctgtattcgcgtggatgctgtccgcgcgattcccagcactcctcttacagcatctcacctcagtgtatgttccttgcctccagtgcagttgaacctcagtcctgcctctcctcatgtgtgcattcacctttcttggtgctctctccccatgggccaagttctaccatgagttatgaaacattatggagaaaacatgtctttggaaatgtgagccagaaagcccaccagtgcccctcagtcacggttgttatgaatgacatgctaatggtttcactctggtcaaacctgccttttctttc

SEQ ID NO: 456603 - DNA, 2625 bp, Homo sapiens
cgctccctcccgctcgcagcttacttaacctggcccgggcggcggaggcgctctcacttccctggagccgcccgcttgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagctgaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggattgtaactgtgaactgtgcccggctgctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtggagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggattcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacataaagaacacaatagagagaaaaaatgcgagggactctatagagttccgagggtgcgcgaacaacagccaggtaggtgcaacacggggcacacgtggcttcactcatgcgagttttccgtcgaaccacagattaccctaggtcttcaccaacagccgggacacaactctgagcgcggtttctccccctatcctatgcgtccgcaagtccgcacctagcagacttgtcagcaatataacacagcgcgcatgggcacaccccgtgttgccaatctcaatgtgagaaacttcggcgcgacacagtagccctccctccagaccatacaccccccaactgagagagcgccgcaccgagcagacctccctcccacatcgcagacgaacgccgagaagaaccaaatcagacaactagaaacccgcataaaccgctacaaacataggtagcacacaacaaactaacacaaatacacaatcctaacaaaaaccaacacccccaactaaaactccgctcaaccctagggcgaaaaagaggccaaaaccaatagcatgcaaagccacgcatgacacccacgacatcccactgcaacaaacgacagaaccctataactaaagtacaaaagcaccaaccacaagaagacctcagaacgaaaaccatacaaactcatgaccaacacagcgccccaaacctaaccgacagacaacagaaacagcaaagcaaacacaaaaccaatcaccaaacaagccaaatacaaacgcacgcgaaacgca

SEQ ID NO: 456604 - DNA, 1477 bp, Homo sapiens
cgctccctcccgctcgcagcttacttaacctggcccgggcggcggaggcgctctcacttccctggagccgcccgcttgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagctgaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggattgtaactgtgaactgtgcccggctgctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtggagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagcgatccgaagatggacccacgctacagatggactttcaggaatccgcgatgggatcacaatctacagacagacagcgctcggtgagtaattgt

SEQ ID NO: 456605 - DNA, 813 bp, Homo sapiens
  misc_feature (29)..(29): n is a, c, g, or t
  misc_feature (32)..(33): n is a, c, g, or t
  misc_feature (795)..(795): n is a, c, g, or t
cagaggataagtgtaaaagggtgtaattngtnnatataggctaggtacgaggcgggtgtgaatcggccgagggcgctgatgggaggatggacatactggtgtctgagtgctccgcgcggctgctgcagcaggaagaagagattaaatctctgactgctgaaattgaccggttgaaaaactgtggctgtttaggagcttctccaaatttggagcagttacaagaagaaaatttaaaattaaagtatcgactgaatattcttcgaaagagtcttcaggcagaaaggaacaaaccaactaaaaatatgattaacattattagccgcctacaagaggtctttggtcatgcaattaaggctgcatatccagatttggaaaatcctcctctgctagtgacaccaagtcagcaggccaagtttggggactatcagtgtaatagtgctatgggtatttctcagatgctcaaaaccaaggaacagaaagttaatccaagagaaattgctgaaaacattaccaaacacctcccagacaatgaatgtattgaaaaagttgaaattgctggtcctggttttattaatgtccacttaagaaaggattttgtatcagaacaattgaccagtcttctagtgaatggagttcaactacctgctctgggagagaataaaaaggttatagttgacttttcctcccctaatatagctaaagagatgcatgtaggccacctgaggtcaactatcataggagagagtataagccgcctctttgaatttgcagggtatgacgtgctcaggttttttnaaaaaaaaaaattttctc

SEQ ID NO: 456606 - DNA, 837 bp, Homo sapiens
tgaccgtttccgcttccgtccacttggcgagtgagacgctgatgggaggatggacatactggtgtctgagtgctccgcgcggctgctgcagcaggaagaagagattaaatctctgactgctgaaattgaccggttgaaaaactgtggctgtttaggagcttctccaaatttggagcagttacaagaagaaaatttaaaattaaagtatcgactgaatattcttcgaaagagtcttcaggcagaaaggaacaaaccaactaaaaatatgattaacattattagccgcctacaagaggtctttggtcatgcaattaaggctgcatatccagatttggaaaatcctcctctgctagtgacaccaagtcagcaggccaagtttggggactatcagtgtaatagtgctatgggtatttctcagatgctcaaaaccaaggaacagaaagttaatccaagagaaattgctgaaaacattaccaaacacctcccagacaatgaatgtattgaaaaagttgaaattgctggtcctggttttattaatgtccacttaagaaaggattttgtatcagaacaattgaccagtcttctagtgaatggagttcaactacctgctctgggagagaataaaaaggtatatgtacactcttctattaatatattagtatcttagaactgcgtggaaccaagcatggtggtatgtgcctatagtctcagctacttgggaggctgaagcaggaggattgcttgagcctagaagttcaaggctgaggtgtgctgtgatcgcacctgtgaatagctactgcacttcaacctgggcagtatcatgagacttcatctcta

SEQ ID NO: 456607 - DNA, 452 bp, Homo sapiens
cagcttaagtcaaggccacaactggtattggaatccggaagaattttgccagagccaggtcagtgtctggagcaaatccttaggagcgagtgattattcaagataagacagtatctgatattttttctcttctatccattaggttttattaatgtccacttaagaaaggattttgtatcagaacaattgaccagtcttctagtgaatggagttcaactacctgctctgggagagaataaaaaggtatatgtacactcttctattaatatattagtatcttagaactgcgtggaaccaagcatggtggtatgtgcctatagtctcagctacttgggaggctgaagcaggaggattgcttgagcctagaagttcaaggctgaggtgtgctgtgatcgcacctgtgaatagctactgcacttcaacctgggcagtatcatgagacttcatctcta

SEQ ID NO: 456608 - DNA, 2185 bp, Homo sapiens
  misc_feature (29)..(29): n is a, c, g, or t
  misc_feature (32)..(33): n is a, c, g, or t
cagaggataagtgtaaaagggtgtaattngtnnatataggctaggtacgaggcgggtgtgaatcggccgagggcgctgatgggaggatggacatactggtgtctgagtgctccgcgcggctgctgcagcaggaagaagagattaaatctctgactgctgaaattgaccggttgaaaaactgtggctgtttaggagcttctccaaatttggagcagttacaagaagaaaatttaaaattaaagtatcgactgaatattcttcgaaagagtcttcaggcagaaaggaacaaaccaactaaaaatatgattaacattattagccgcctacaagaggtctttggtcatgcaattaaggctgcatatccagatttggaaaatcctcctctgctagtgacaccaagtcagcaggccaagtttggggactatcagtgtaatagtgctatgggtatttctcagatgctcaaaaccaaggaacagaaagttaatccaagagaaattgctgaaaacattaccaaacacctcccagacaatgaatgtattgaaaaagttgaaattgctggtcctggttttattaatgtccacttaagaaaggattttgtatcagaacaattgaccagtcttctagtgaatggagttcaactacctgctctgggagagaataaaaaggttatagttgacttttcctcccctaatatagctaaagagatgcatgtaggccacctgaggtcaactatcataggagagagtataagccgcctctttgaatttgcagggtatgacgtgctcaggttaaatcatgtaggagactgggggacccagtttggcatgctcatcgctcacctgcaagacaaatttccagattatctaacagtttcacctcctattggggatcttcaggtcttttataaggaatctaagaagaggtttgatactgaggaggaatttaagaagcgagcatatcagtgtgtagttctgctccagggtaaaaacccagatattacaaaagcttggaagcttatctgtgatgtctcccgccaagagttaaataaaatctatgatgcattggacgtctctttaatagagagaggggaatccttctatcaagataggatgaatgatattgtaaaggaatttgaagatagaggatttgtgcaggtggatgatggcagaaagattgtatttgtcccagggtgttccataccattaaccatagtaaaatcagatggaggttatacctatgatacatctgacctggctgctattaaacaaagactatttgaggaaaaagcagatatgattatctatgttgtggacaatggacaatctgtgcacttccagacaatatttgctgctgctcaaatgattggttggtatgaccctaaagtaactcgagtcttccatgctggatttggtgtggtgctaggggaagacaagaaaaagtttaaaacacgttcgggtgaaacagtgcgcctcatggatcttctgggagaaggactaaaacgatccatggacaagttgaaggaaaaagaaagagacaaggtcttaactgcagaggaattgaatgctgctcagacatccgttgcatatggctgcatcaaatatgctgacctttcccataaccggttgaatgactacatcttctcctttgacaaaatgctagatgacagaggaaatacagctgcttacttgttgtatgccttcactagaatcaggtctattgcacgtctggccaatattgatgaagaaatgctccaaaaagctgctcgagaaaccaagattcttttggatcatgagaaggaatggaaactaggccggtgcattttacggttccctgagattctgcaaaagattttagatgacttatttctccacactctctgtgattatatatatgagctggcaactgctttcacagagttctatgatagctgctactgtgtggagaaagatagacagactggaaaaatattgaaggtgaacatgtggcgtatgctgctatgtgaagcagtagctgctgtcatggccaaggggtttgatatcctgggaataaaacctgtccaaaggatgtaatccttcataggtttgaacactgtgtgtttttaccaaagtggccattggcactgtttgcttttttacaatcatgtggacacaagcataagtaaagaaaatttgtcaaccaggaaaaa

SEQ ID NO: 456609 - DNA, 2143 bp, Homo sapiens
agttacggctaggtacgaggctgggtggtggcgctgatgggaggatggacatactggtgtctgagtgctccgcgcggctgctgcagcaggaagaagagattaaatctctgactgctgaaattgaccggttgaaaaactgtggctgtttaggagcttctccaaatttggagcagttacaagaagaaaatttaaaattaaagtatcgactgaatattcttcgaaagagtcttcaggcagaaaggaacaaaccaactaaaaatatgattaacattattagccgcctacaagaggtctttggtcatgcaattaaggctgcatatccagatttggaaaatcctcctctgctagtgacaccaagtcagcaggccaagtttggggactatcagtgtaatagtgctatgggtatttctcagatgctcaaaaccaaggaacagaaagttaatccaagagaaattgctgaaaacattaccaaacacctcccagacaatgaatgtattgaaaaagttgaaattgctggtcctggttttattaatgtccacttaagaaaggattttgtatcagaacaattgaccagtcttctagtgaatggagttcaactacctgctctgggagagaataaaaaggttatagttgacttttcctcccctaatatagctaaagagatgcatgtaggccacctgaggtcaactatcataggagagagtataagccgcctctttgaatttgcagggtatgacgtgctcaggttaaatcatgtaggagactgggggacccagtttggcatgctcatcgctcacctgcaagacaaatttccagattatctaacagtttcacctcctattggggatcttcaggtcttttataaggaatctaagaagaggtttgatactgaggaggaatttaagaagcgagcatatcagtgtgtagttctgctccagggtaaaaacccagatattacaaaagcttggaagcttatctgtgatgtctcccgccaagagttaaataaaatctatgatgcattggacgtctctttaatagagagaggggaatccttctatcaagataggatgaatgatattgtaaaggaatttgaagatagaggatttgtgcaggtggatgatggcagaaagattgtatttgtcccagggtgttccataccattaaccatagtaaaatcagatggaggttatacctatgatacatctgacctggctgctattaaacaaagactatttgaggaaaaagcagatatgattatctatgttgtggacaatggacaatctgtgcacttccagacaatatttgctgctgctcaaatgattggttggtatgaccctaaagtaactcgagtcttccatgctggatttggtgtggtgctaggggaagacaagaaaaagtttaaaacacgttcgggtgaaacagtgcgcctcatggatcttctgggagaaggactaaaacgatccatggacaagttgaaggaaaaagaaagagacaaggtcttaactgcagaggaattgaatgctgctcagacatccgttgcatatggctgcatcaaatatgctgacctttcccataaccggttgaatgactacatcttctcctttgacaaaatgctagatgacagaggaaatacagctgcttacttgttgtatgccttcactagaatcaggtctattgcacgtctggccaatattgatgaagaaatgctccaaaaagctgctcgagaaaccaagattcttttggatcatgagaaggaatggaaactaggccggtgcattttacggttccctgagattctgcaaaagattttagatgacttatttctccacactctctgtgattatatatatgagctggcaactgctttcacagagttctatgatagctgctactgtgtggagaaagatagacagactggaaaaatattgaaggtgaacatgtggcgtatgctgctatgtgaagcagtagctgctgtcatggccaaggggtttgatatcctgggaataaaacctgtccaaaggatgtaatccttcataggtttgaacactgtgtgtttttaccaaagtggccattggcactgtttgcttttttacaatcatgtggacacaagcataagtaaagaaaatttgtcaaccaggaaaaa

SEQ ID NO: 456610 - DNA, 3220 bp, Homo sapiens
tgaccgtttccgcttccgtccacttggcgagtgagacgctgatgggaggatggacatactggtgtctgagtgctccgcgcggctgctgcagcaggaagaagagattaaatctctgactgctgaaattgaccggttgaaaaactgtggctgtttaggagcttctccaaatttggagcagttacaagaagaaaatttaaaattaaagtatcgactgaatattcttcgaaagagtcttcaggcagaaaggaacaaaccaactaaaaatatgattaacattattagccgcctacaagaggtctttggtcatgcaattaaggctgcatatccagatttggaaaatcctcctctgctagtgacaccaagtcagcaggccaagtttggggactatcagtgtaatagtgctatgggtatttctcagatgctcaaaaccaaggaacagaaagttaatccaagagaaattgctgaaaacattaccaaacacctcccagacaatgaatgtattgaaaaagttgaaattgctggtcctggttttattaatgtccacttaagaaaggattttgtatcagaacaattgaccagtcttctagtgaatggagttcaactacctgctctgggagagaataaaaaggttatagttgacttttcctcccctaatatagctaaagagatgcatgtaggccacctgaggtcaactatcataggagagagtataagccgcctctttgaatttgcagggtatgacgtgctcaggtatgtgctcttgccttgcgtactattctctttccttattttcttgtttggaaaattctatagaacatggaatatctcactcaagaaagaacattcgactaaatcagtggttcatcagcttagttcttctttacaaccacccagtaagcttttaaaatatgtcctgagcctttcctctgaaccttttttactattttatttttttagactcttagtggaaccaaggacaaaactccttcattctacacatgtttcttgaggacctcttgtatgcaatgggtttatatcctagcagggagagaagtagtaaagaaacaggttgttttgggccttgtaagctgtgagaggcaattgagattttattctaagtgtactgggaagctattagagagttttagtttgtgaagcagggtgatcaaattaaagattagcctgggtaccatggctcacacctataattccagcactttggtaggccaaggtgggaggatcactagaggccaggagttctaggccagcttgggcaacatagcaagaacctgtctctattttttatatttttaaagaaataaaaatttttaaataatacaaattaaagattactaggcgtgagccattgcacccggcctcaacatatattttcaagaattttgttcattgatatttgggaaccattggtctaaattatattaagataatggttaaaatgttaaattttcataaaattgtgggaataaccaacattggcccagctgtcattgtctcaattagctacaaaataaacagattatagtccactgacagaaaacacattcattcagcaaattctggatgcctgccttgtgcagcctctagtacttgagtatgcagagctgaatgtaacagacatagttttcatctcttgtggagtttgcagaccagttgaagaaacaaccaagtaaacagatattactaaatggtgatgtactggcatgtaaatattagtggttcctaatggaatatagttcctctaatttaacttaaccatctttattatttaaaaaatgattatatattctctgattggtgttaggttaaatcatgtaggagactgggggacccagtttggcatgctcatcgctcacctgcaagacaaatttccagattatctaacagtttcacctcctattggggatcttcaggtcttttataaggaatctaagaagaggtttgatactgaggaggaatttaagaagcgagcatatcagtgtgtagttctgctccagggtaaaaacccagatattacaaaagcttggaagcttatctgtgatgtctcccgccaagagttaaataaaatctatgatgcattggacgtctctttaatagagagaggggaatccttctatcaagataggatgaatgatattgtaaaggaatttgaagatagaggatttgtgcaggtggatgatggcagaaagattgtatttgtcccagggtgttccataccattaaccatagtaaaatcagatggaggttatacctatgatacatctgacctggctgctattaaacaaagactatttgaggaaaaagcagatatgattatctatgttgtggacaatggacaatctgtgcacttccagacaatatttgctgctgctcaaatgattggttggtatgaccctaaagtaactcgagtcttccatgctggatttggtgtggtgctaggggaagacaagaaaaagtttaaaacacgttcgggtgaaacagtgcgcctcatggatcttctgggagaaggactaaaacgatccatggacaagttgaaggaaaaagaaagagacaaggtcttaactgcagaggaattgaatgctgctcagacatccgttgcatatggctgcatcaaatatgctgacctttcccataaccggttgaatgactacatcttctcctttgacaaaatgctagatgacagaggaaatacagctgcttacttgttgtatgccttcactagaatcaggtctattgcacgtctggccaatattgatgaagaaatgctccaaaaagctgctcgagaaaccaagattcttttggatcatgagaaggaatggaaactaggccggtgcattttacggttccctgagattctgcaaaagattttagatgacttatttctccacactctctgtgattatatatatgagctggcaactgctttcacagagttctatgatagctgctactgtgtggagaaagatagacagactggaaaaatattgaaggtgaacatgtggcgtatgctgctatgtgaagcagtagctgctgtcatggccaaggggtttgatatcctgggaataaaacctgtccaaaggatgtaatccttcataggtttgaacactgtgtgtttttaccaaagtggccattggcactgtttgcttttttacaatcatgtggacacaagcataagtaaagaaaatttgtcaaccaggaaaaa

SEQ ID NO: 456611 - DNA, 2327 bp, Homo sapiens
tgaccgtttccgcttccgtccacttggcgagtgagacgctgatgggaggatggacatactggtgtctgagtgctccgcgcggctgctgcagcaggaagaagagattaaatctctgactgctgaaattgaccggttgaaaaactgtggctgtttaggagcttctccaaatttggagcagttacaagaagaaaatttaaaattaaagtatcgactgaatattcttcgaaagagtcttcaggcagaaaggaacaaaccaactaaaaatatgattaacattattagccgcctacaagaggtctttggtcatgcaattaaggctgcatatccagatttggaaaatcctcctctgctagtgacaccaagtcagcaggccaagtttggggactatcagtgtaatagtgctatgggtatttctcagatgctcaaaaccaaggaacagaaagttaatccaagagaaattgctgaaaacattaccaaacacctcccagacaatgaatgtattgaaaaagttgaaattgctggtcctggttttattaatgtccacttaagaaaggattttgtatcagaacaattgaccagtcttctagtgaatggagttcaactacctgctctgggagagaataaaaaggttatagttgacttttcctcccctaatatagctaaagagatgcatgtaggccacctgaggtcaactatcataggagagagtataagccgcctctttgaatttgcagggtatgacgtgctcaggttaaatcatgtaggagactgggggacccagtttggcatgctcatcgctcacctgcaagacaaatttccagattatctaacagtttcacctcctattggggatcttcaggtcttttataaggaatctaagaagaggtttgatactgaggaggaatttaagaagcgagcatatcagtgtgtagttctgctccagggtaaaaacccagatattacaaaagcttggaagcttatctgtgatgtctcccgccaagagttaaataaaatctatgatgcattggacgtctctttaatagagagaggggaatccttctatcaagataggatgaatgatattgtaaaggaatttgaagatagaggatttgtgcaggtggatgatggcagaaagattgtatttgtcccagggtgttccataccattaaccatagtaaaatcagatggaggttatacctatgatacatctgacctggctgctattaaacaaagactatttgaggaaaaagcagatatgattatctatgttgtggacaatggacaatctgtgcacttccagacaatatttgctgctgctcaaatgattggttggtatgaccctaaagtaactcgagtcttccatgctggatttggtgtggtgctaggggaagacaagaaaaagtttaaaacacgttcgggtgaaacagtgcgcctcatggatcttctgggagaaggactaaaacgatccatggacaagttgaaggaaaaagaaagagacaaggtcttaactgcagaggaattgaatgctgctcagacatccgttgcatatggctgcatcaaatatgctgacctttcccataaccggttgaatgactacatcttctcctttgacaaaatgctagatgacagaggaaatacagctgcttacttgttgtatgccttcactagaatcaggtctattgcacgtctggccaatattgatgaagaaatgctccaaaaagctgctcgagaaaccaagattcttttggatcatgagaaggaatggaaactaggccggtgcattttacggttccctgagattctgcaaaagattttagatgacttatttctccacactctctgtgattatatatatgagctggcaactgctttcacagagttctatgatagctgctactgtgtggagaaagatagacagactggaaaaatattgaaggtgaacatgtggcgtatgctgctatgtgaagcagtagctgctgtcatggccaaggggtttgatatcctgggaataaaacctgtccaaaggatgtaatccttcataggtttgaacactgtgtgtttttaccaaagtggccattggcactgtttgcttttttacaatcatgtggacacaagcataagtaaagaaaatttgtcaaccaggaaaaaaaaaaaaaaataaaaagctcggagaaatagtgcttctcctctctccggaaccggcccctgggcggttggcaagaaacaagggcccttagaagggcgcgcaaaggggcgccggagacaagggtggcccctttttctcaaagcgtggcttttttgaaacccggtttttccattagaactgg

SEQ ID NO: 456612 - DNA, 2031 bp, Homo sapiens
tgaccgtttccgcttccgtccacttggcgagtgagacgctgatgggaggatggacatactggtgtctgagtgctccgcgcggctgctgcagcaggaagaagagattaaatctctgactgctgaaattgaccggttgaaaaactgtggctgtttaggagcttctccaaatttggagcagttacaagaagaaaatttaaaattaaagtatcgactgaatattcttcgaaagagtcttcaggcagaaaggaacaaaccaactaaaaatatgattaacattattagccgcctacaagaggtctttggtcatgcaattaaggctgcatatccagatttggaaaatcctcctctgctagtgacaccaagtcagcaggccaagtttggggactatcagtgtaatagtgctatgggtatttctcagatgctcaaaaccaaggaacagaaagttaatccaagagaaattgctgaaaacattaccaaacacctcccagacaatgaatgtattgaaaaagttgaaattgctggtcctggttttattaatgtccacttaagaaaggattttgtatcagaacaattgaccagtcttctagtgaatggagttcaactacctgctctgggagagaataaaaaggttatagttgacttttcctcccctaatatagctaaagagatgcatgtaggccacctgaggtcaactatcataggagagagtataagccgcctctttgaatttgcagggtatgacgtgctcaggttaaatcatgtaggagactgggggacccagtttggcatgctcatcgctcacctgcaagacaaatttccagattatctaacagtttcacctcctattggggatcttcaggtcttttataaggaatctaagaagaggtttgatactgaggaggaatttaagaagcgagcatatcagtgtgtagttctgctccagggtaaaaacccagatattacaaaagcttggaagcttatctgtgatgtctcccgccaagagttaaataaaatctatgatgcattggacgtctctttaatagagagaggggaatccttctatcaagataggatgaatgatattgtaaaggaatttgaagatagaggatttgtgcaggtggatgatggcagaaagattgtatttgtcccagggtgttccataccattaaccatagtaaaatcagatggaggttatacctatgatacatctgacctggctgctattaaacaaagactatttgaggaaaaagcagatatgattatctatgttgtggacaatggacaatctgtgcacttccagacaatatttgctgctgctcaaatgattggttggtatgaccctaaagtaactcgagtcttccatgctggatttggtgtggtgctaggggaagacaagaaaaagtttaaaacacgttcgggtgaaacagtgcgcctcatggatcttctgggagaaggactaaaacgatccatggacaagttgaaggaaaaagaaagagacaaggtcttaactgcagaggaattgaatgctgctcagacatccgttgcatatggctgcatcaaatatgctgacctttcccataaccggttgaatgactacatcttctcctttgacaaaatgctagatgacagaggaaatacagctgcttacttgttgtatgccttcactagaatcaggtctattgcacgtctggccaatattgatgaagaaatgctccaaaaagctgctcgagaaaccaagattcttttggatcatgagaaggaatggaaactaggccggtgcattttacggttccctgagattctgcaaaagattttagatgacttatttctccacactctctgtgattatatatatgagctggcaactgctttcacagagttctatgatagctgctactgtgtggagaaagatagacagactggaaaaatattgaaggtgaacatgtggcgtatgctgctatgtgaagcagtagctgctgtcatggccaaggggtttgatatcctgggaataaaacctgtccaaaggatgta

SEQ ID NO: 456613 - DNA, 1173 bp, Homo sapiens
aattgaggattccaagctccaacaagagttaaataaaatctatgatgcattggacgtctctttaatagagagaggggaatccttctatcaagataggatgaatgatattgtaaaggaatttgaagatagaggatttgtgcaggtggatgatggcagaaagattgtatttgtcccagggtgttccataccattaaccatagtaaaatcagatggaggttatacctatgatacatctgacctggctgctattaaacaaagactatttgaggaaaaagcagatatgattatctatgttgtggacaatggacaatctgtgcacttccagacaatatttgctgctgctcaaatgattggttggtatgaccctaaagtaactcgagtcttccatgctggatttggtgtggtgctaggggaagacaagaaaaagtttaaaacacgttcgggtgaaacagtgcgcctcatggatcttctgggagaaggactaaaacgatccatggacaagttgaaggaaaaagaaagagacaaggtcttaactgcagaggaattgaatgctgctcagacatccgttgcatatggctgcatcaaatatgctgacctttcccataaccggttgaatgactacatcttctcctttgacaaaatgctagatgacagaggaaatacagctgcttacttgttgtatgccttcactagaatcaggtctattgcacgtctggccaatattgatgaagaaatgctccaaaaagctgctcgagaaaccaagattcttttggatcatgagaaggaatggaaactaggccggtgcattttacggttccctgagattctgcaaaagattttagatgacttatttctccacactctctgtgattatatatatgagctggcaactgctttcacagagttctatgatagctgctactgtgtggagaaagatagacagactggaaaaatattgaaggtgaacatgtggcgtatgctgctatgtgaagcagtagctgctgtcatggccaaggggtttgatatcctgggaataaaacctgtccaaaggatgtaatccttcataggtttgaacactgtgtgtttttaccaaagtggccattggcactgtttgcttttttacaatcatgtggacacaagcataagtaaagaaaatttgtcaaccaggaaaaa

SEQ ID NO: 456614 - DNA, 918 bp, Homo sapiens
gacctcaagtgattcacccgcctcggcctcccaaagtgctcggattacaggcatgagccatcacgctcagcctaaagtgttcttttcagacttatttttctgcctacaagcatctttggaaatacgtcctcttttagtattgcaagttatcccagaatccctaaacctggccttaactgcacttgccgatactcttctagatgctctatgtttaaatacctagaaagtgtcacctgatcccctaaaagaattatatttccatttttagtattatgaaatgctttagatctggctattagttttgcctaatagtatatcgtataataaaatacttcattttataggaacttctttttaatcggtgataatttcgagtggagaatgagtgtgcctaaaaaaagggaacagtggtgattgcctgatgatttttttgttttttttaaggtctattgcacgtctggccaatattgatgaagaaatgctccaaaaagctgctcgagaaaccaagattcttttggatcatgagaaggaatggaaactaggccggtgcattttacggttccctgagattctgcaaaagattttagatgacttatttctccacactctctgtgattatatatatgagctggcaactgctttcacagagttctatgatagctgctactgtgtggagaaagatagacagactggaaaaatattgaaggtgaacatgtggcgtatgctgctatgtgaagcagtagctgctgtcatggccaaggggtttgatatcctgggaataaaacctgtccaaaggatgtaatccttcataggtttgaacactgtgtgtttttaccaaagtggccattggcactgtttgcttttttacaatcatgtggacacaagcataagtaaagaaaatttgtcaaccaggaaaaa

SEQ ID NO: 456615 - DNA, 783 bp, Homo sapiens
tgaccgtttccgcttccgtccacttggcgagtgagacgctgatgggaggatggacatactggtgtctgagtgctccgcgcggctgctgcagcaggaagaagagattaaatctctgactgctgaaattgaccggttgaaaaactgtggctgtttaggagcttctccaaatttggagcagttacaagaagaaaatttaaaattaaagtatcgactgaatattcttcgaaagagtcttcaggcagaaaggaacaaaccaactaaaaatatgattaacattattagccgcctacaagaggtctttggtcatgcaattaaggctgcatatccagatttggaaaatcctcctctgctagtgacaccaagtcagcaggccaagtttggggactatcagtgtaatagtgctatgggtatttctcagatgctcaaaaccaaggaacagaaagttaatccaagagaaattgctgaaaacattaccaaacacctcccagacaatgaatgtattgatgtatcagaacaattgaccagtcttctagtgaatggagttcaactacctgctctgggagagaataaaaaggtatatgtacactcttctattaatatattagtatcttagaactgcgtggaaccaagcatggtggtatgtgcctatagtctcagctacttgggaggctgaagcaggaggattgcttgagcctagaagttcaaggctgaggtgtgctgtgatcgcacctgtgaatagctactgcacttcaacctgggcagtatcatgagacttcatctcta

SEQ ID NO: 456616 - DNA, 434 bp, Homo sapiens
  misc_feature (400)..(400): n is a, c, g, or t
  misc_feature (421)..(421): n is a, c, g, or t
tgaccgtttccgcttccgtccacttggcgagtgagacgctgatgggaggatggacatactggtgtctgagtgctccgcgcggctgctgcagcaggaagaagagattaaatctctgactgctgaaattgaccggttgaaaaactgtggctgtttaggagcttctccaaatttggagcagttacaagaagaaaatttaaaattaaagtatcgactgaatattcttcgaaagagtcttcaggcagaaaggaacaattttccaaaccttttctggctgtactttaaaagtgccaaaaaggcaatgggtgtttatgacactaaagtcacatacaagctagtatgatacatacatcataggaaagcttatagtttgctcagtgacaaggcaaagggaagttttatnttttttcccgtttttgttccnttacccgaggacg

SEQ ID NO: 456617 - DNA, 372 bp, Homo sapiens
tttttaaataatacaaattaaagattactctggttacttactgtgaagaagctagacaaagaagggagactataacagtaagtgttaggccaggcacggtggctcacgtctgtaaacccagcactttgggaggccaaggaaggatggatcacgaggtcaggagtttgagaccagcctggcaacatggtgaaaccctgtctctactaaaaatacaaaaattagctgggtgtggtggtgcacacctgtaatcccacctacttgggaagctgaggcaggagaattgcttgaacctgggaggcagagatagcagtgagctgagatcgtgccactgcactccagcctgggcaacagagcaagactctctgtcaaaaa

SEQ ID NO: 456618 - DNA, 671 bp, Homo sapiens
ccttttttggtctattttctctctccattctaaaatgtgtctgccgtgagaggggagatcgtgtctgttttgttttctttgtgcccccagagcctagaatactgtctggcattttaaagtacacaataaatgtttgttgaataaatgaatggatttgttagttttgtgcccatttcacaaaggggcaaagtgaggcctttgagagccagaagctctaggtcagtgactgtcctagtctatccaagcacagagcagctctggttagtgtctgctcaattcctctcccctcgcccaaacgtccctgagttgcggcctcgctcctgaccgaaatccccgcgggttctcctcgcagtgtctactggatcccgccaggaggcagcagaggcgccagcacccagtccgacgggacagcggaccggagggggtttccgcttccgggagaggctgaccgtttccgcttccgtccacttggcgagtgagacgctgatgggaggatggacatactggtgtctgagtgctccgcgcggctgctgcagcaggtttggacgcaggagaccggcgggaaggcctgaaagagatggagcaggctctgactcctgcccaagcggcttcgggggcgggacagctaggcgaggaccatcctggtcctctcagagtggagcggcacggtc

SEQ ID NO: 456619 - DNA, 359 bp, Homo sapiens
actggcatgtaaatattagtggttcctaatggaatatagttcctctaatttaacttaaccatctttattatttaaaaaatgattatatattctctgattggtgttaggttaaatcatgtaggagactgggggacccagtttggcatgctcatcgctcacctgcaagacaaatttccagattatctaacagtttcacctcctattggggatcttcaggtcttttataaggtttgataccatttcttttatattatgtgtgtgtttaccattaatcataattatccattttccttaggaaacttaaaatggtttttaaagctactatggagttaagtgaaagttgctaacagccttagtaa

SEQ ID NO: 456620 - DNA, 174 bp, Homo sapiens
ttctagaaatacaggattagatctttttacacaccttactttttaaaatatatatatatacaggaatctaagaagaggtttgatactgaggaggaatttaagaagcgagcatatcagtgtgtagttctgctccagggtaaaaacccagatattacaaaagcttggaagcttatc

SEQ ID NO: 456621 - DNA, 401 bp, Homo sapiens
tacaaattcagtttctcatagacacattcttcattgtgcataacgcattttatattttcattattttgtttgtacattggcccatgtccttctgcctcagtgtcagtgtttattaaagtttattggtaaaagaataccattagatgttccctaccccagtcttatgcctatgagacaccagggcagaagcagcagtcagtaagctatgaaatactgttttgtttttcccaaaggtcttaactgcagaggaattgaatgctgctcagacatccgttgcatatggctgcatcaaatatgctgacctttcccataaccggttgaatgactacatcttctcctttgacaaaatgctagatgacagaggaaatacagctgcttacttgttgtatgccttcactaga

SEQ ID NO: 456622 - DNA, 2148 bp, Homo sapiens
tgaccgtttccgcttccgtccacttggcgagtgagacgctgatgggaggatggacatactggtgtctgagtgctccgcgcggctgctgcagcaggaagaagagattaaatctctgactgctgaaattgaccggttgaaaaactgtggctgtttaggagcttctccaaatttggagcagttacaagaagaaaatttaaaattaaagtatcgactgaatattcttcgaaagagtcttcaggcagaaaggaacaaaccaactaaaaatatgattaacattattagccgcctacaagaggtctttggtcatgcaattaaggctgcatatccagatttggaaaatcctcctctgctagtgacaccaagtcagcaggccaagtttggggactatcagtgtaatagtgctatgggtatttctcagatgctcaaaaccaaggaacagaaagttaatccaagagaaattgctgaaaacattaccaaacacctcccagacaatgaatgtattgaaaaagttgaaattgctggtcctggttttattaatgtccacttaagaaaggattttgtatcagaacaattgaccagtcttctagtgaatggagttcaactacctgctctgggagagaataaaaaggttatagttgacttttcctcccctaatatagctaaagagatgcatgtaggccacctgaggtcaactatcataggagagagtataagccgcctctttgaatttgcagggtatgacgtgctcaggttaaatcatgtaggagactgggggacccagtttggcatgctcatcgctcacctgcaagacaaatttccagattatctaacagtttcacctcctattggggatcttcaggtcttttataaggaatctaagaagaggtttgatactgaggaggaatttaagaagcgagcatatcagtgtgtagttctgctccagggtaaaaacccagatattacaaaagcttggaagcttatctgtgatgtctcccgccaagagttaaataaaatctatgatgcattggacgtctctttaatagagagaggggaatccttctatcaagataggatgaatgatattgtaaaggaatttgaagatagaggatttgtgcaggtggatgatggcagaaagattgtatttgtcccagggtgttccataccattaaccatagtaaaatcagatggaggttatacctatgatacatctgacctggctgctattaaacaaagactatttgaggaaaaagcagatatgattatctatgttgtggacaatggacaatctgtgcacttccagacaatatttgctgctgctcaaatgattggttggtatgaccctaaagtaactcgagtcttccatgctggatttggtgtggtgctaggggaagacaagaaaaagtttaaaacacgttcgggtgaaacagtgcgcctcatggatcttctgggagaaggactaaaacgatccatggacaagttgaaggaaaaagaaagagacaaggtcttaactgcagaggaattgaatgctgctcagacatccgttgcatatggctgcatcaaatatgctgacctttcccataaccggttgaatgactacatcttctcctttgacaaaatgctagatgacagaggaaatacagctgcttacttgttgtatgccttcactagaatcaggtctattgcacgtctggccaatattgatgaagaaatgctccaaaaagctgctcgagaaaccaagattcttttggatcatgagaaggaatggaaactaggccggtgcattttacggttccctgagattctgcaaaagattttagatgacttatttctccacactctctgtgattatatatatgagctggcaactgctttcacagagttctatgatagctgctactgtgtggagaaagatagacagactggaaaaatattgaaggtgaacatgtggcgtatgctgctatgtgaagcagtagctgctgtcatggccaaggggtttgatatcctgggaataaaacctgtccaaaggatgtaatccttcataggtttgaacactgtgtgtttttaccaaagtggccattggcactgtttgcttttttacaatcatgtggacacaagcataagtaaagaaaatttgtcaaccaggaaaaa

SEQ ID NO: 456623 - DNA, 899 bp, Homo sapiens
  misc_feature (29)..(29): n is a, c, g, or t
  misc_feature (32)..(33): n is a, c, g, or t
cagaggataagtgtaaaagggtgtaattngtnnatataggctaggtacgaggcgggtgtgaatcggccgaggggtcttaactgcagaggaattgaatgctgctcagacatccgttgcatatggctgcatcaaatatgctgacctttcccataaccggttgaatgactacatcttctcctttgacaaaatgctagatgacagaggaaatacagctgcttacttgttgtatgccttcactagaatcaggtctattgcacgtctggccaatattgatgaagaaatgctccaaaaagctgctcgagaaaccaagattcttttggatcatgagaaggaatggaaactaggccggtgcattttacggttccctgagattctgcaaaagattttagatgacttatttctccacactctctgtgattatatatatgagctggcaactgctttcacagagttctatgatagctgctactgtgtggagaaagatagacagactggaaaaatattgaaggtgaacatgtggcgtatgctgctatgtgaagcagtagctgctgtcatggccaaggggtttgatatcctgggaataaaacctgtccaaaggatgtaatccttcataggtttgaacactgtgtgtttttaccaaagtggccattggcactgtttgcttttttacaatcatgtggacacaagcataagtaaagaaaatttgtcaaccaggaaaaaaaaaaaaaaataaaaagctcggagaaatagtgcttctcctctctccggaaccggcccctgggcggttggcaagaaacaagggcccttagaagggcgcgcaaaggggcgccggagacaagggtggcccctttttctcaaagcgtggcttttttgaaacccggtttttccattagaactgg

SEQ ID NO: 456624 - DNA, 1212 bp, Homo sapiens
tgaccgtttccgcttccgtccacttggcgagtgagacgctgatgggaggatggacatactggtgtctgagtgctccgcgcggctgctgcagcaggaagaagagattaaatctctgactgctgaaattgaccggttgaaaaactgtggctgtttaggagcttctccaaatttggagcagttacaagaagaaaatttaaaattaaagtatcgactgaatattcttcgaaagagtcttcaggcagaaaggaacaaaccaactaaaaatatgattaacattattagccgcctacaagaggtctttggtcatgcaattaaggctgcatatccagatttggaaaatcctcctctgctagtgacaccaagtcagcaggccaagtttggggactatcagtgtaatagtgctatgggtatttctcaggtgatgtattgtcatgactcttggctgtttgatttttttaagtattattatcatcattgccatttacagaaataatactattacaagttgtatccttagtgaaaaggacatttgccacagtttgaaaaacttgagaaaggagttgggggggtatatgttttaacttttttaggcacaatttttaaggtttggttaaattttatatgtattctcaatatttaagggcaatcattggtactcttttgtttaggtatttccctcctgctgtgtccaggattgctgtgtggtggtgatgagtgctgggaggtgaaaaattaaaataagccatttaccagtcagcatcccaattaaatatttgatgtaactgtgatctttgagccaggcttatatattccattttcaagcagaggagttcccccattttaaaatagaggcattggtctgatgtgtttatgggttaactgcatctggcttgggtctttctgttttcctttctttgctgaattggaaggggttactctgaagagtccaggtcttacagtgtggtttatttctcaagtgtgaatattgcacaccttcatggcttgaaaattagaaatgtaaatatgctggaaccagacttcataactgtagactttgttatgtcatcattaaaaagttcgaggtgttgtaatcccagctactagggaggctgaggcaggagaattgcttgaacccaggggcggaggttacagtgagccgagatcacaccactgcactccagcctgggcaacagagcgagactccatctcaaa

SEQ ID NO: 456625 - DNA, 2248 bp, Homo sapiens
tgaccgtttccgcttccgtccacttggcgagtgagacgctgatgggaggatggacatactggtgtctgagtgctccgcgcggctgctgcagcaggaagaagagattaaatctctgactgctgaaattgaccggttgaaaaactgtggctgtttaggagcttctccaaatttggagcagttacaagaagaaaatttaaaattaaagtatcgactgaatattcttcgaaagagtcttcaggcagaaaggaacaaaccaactaaaaatatgattaacattattagccgcctacaagaggtctttggtcatgcaattaaggctgcatatccagatttggaaaatcctcctctgctagtgacaccaagtcagcaggccaagtttggggactatcagtgtaatagtgctatgggtatttctcagatgctcaaaaccaaggaacagaaagttaatccaagagaaattgctgaaaacattaccaaacacctcccagacaatgaatgtattgaaaaagttgaaattgctggtcctggttttattaatgtccacttaagaaaggattttgtatcagaacaattgaccagtcttctagtgaatggagttcaactacctgctctgggagagaataaaaaggttatagttgacttttcctcccctaatatagctaaagagatgcatgtaggccacctgaggtcaactatcataggagagagtataagccgcctctttgaatttgcagggtatgacgtgctcaggttaaatcatgtaggagactgggggacccagtttggcatgctcatcgctcacctgcaagacaaatttccagattatctaacagtttcacctcctattggggatcttcaggtcttttataaggtcaggtgcggtggctcgtgtccgtaatcccagcacttggagaggctgaggcaagccgattgcttgagttcaggagtttgagaccagcctgagcaacaaagaatctaagaagaggtttgatactgaggaggaatttaagaagcgagcatatcagtgtgtagttctgctccagggtaaaaacccagatattacaaaagcttggaagcttatctgtgatgtctcccgccaagagttaaataaaatctatgatgcattggacgtctctttaatagagagaggggaatccttctatcaagataggatgaatgatattgtaaaggaatttgaagatagaggatttgtgcaggtggatgatggcagaaagattgtatttgtcccagggtgttccataccattaaccatagtaaaatcagatggaggttatacctatgatacatctgacctggctgctattaaacaaagactatttgaggaaaaagcagatatgattatctatgttgtggacaatggacaatctgtgcacttccagacaatatttgctgctgctcaaatgattggttggtatgaccctaaagtaactcgagtcttccatgctggatttggtgtggtgctaggggaagacaagaaaaagtttaaaacacgttcgggtgaaacagtgcgcctcatggatcttctgggagaaggactaaaacgatccatggacaagttgaaggaaaaagaaagagacaaggtcttaactgcagaggaattgaatgctgctcagacatccgttgcatatggctgcatcaaatatgctgacctttcccataaccggttgaatgactacatcttctcctttgacaaaatgctagatgacagaggaaatacagctgcttacttgttgtatgccttcactagaatcaggtctattgcacgtctggccaatattgatgaagaaatgctccaaaaagctgctcgagaaaccaagattcttttggatcatgagaaggaatggaaactaggccggtgcattttacggttccctgagattctgcaaaagattttagatgacttatttctccacactctctgtgattatatatatgagctggcaactgctttcacagagttctatgatagctgctactgtgtggagaaagatagacagactggaaaaatattgaaggtgaacatgtggcgtatgctgctatgtgaagcagtagctgctgtcatggccaaggggtttgatatcctgggaataaaacctgtccaaaggatgtaatccttcataggtttgaacactgtgtgtttttaccaaagtggccattggcactgtttgcttttttacaatcatgtggacacaagcataagtaaagaaaatttgtcaaccaggaaaaa

SEQ ID NO: 456626 - DNA, 2477 bp, Homo sapiens
tgaccgtttccgcttccgtccacttggcgagtgagacgctgatgggaggatggacatactggtgtctgagtgctccgcgcggctgctgcagcaggaagaagagattaaatctctgactgctgaaattgaccggttgaaaaactgtggctgtttaggagcttctccaaatttggagcagttacaagaagaaaatttaaaattaaagtatcgactgaatattcttcgaaagagtcttcaggcagaaaggaacaaaccaactaaaaatatgattaacattattagccgcctacaagaggtctttggtcatgcaattaaggctgcatatccagatttggaaaatcctcctctgctagtgacaccaagtcagcaggccaagtttggggactatcagtgtaatagtgctatgggtatttctcagatgctcaaaaccaaggaacagaaagttaatccaagagaaattgctgaaaacattaccaaacacctcccagacaatgaatgtattgaaaaagttgaaattgctggtcctggttttattaatgtccacttaagaaaggattttgtatcagaacaattgaccagtcttctagtgaatggagttcaactacctgctctgggagagaataaaaaggttatagttgacttttcctcccctaatatagctaaagagatgcatgtaggccacctgaggtcaactatcataggagagagtataagccgcctctttgaatttgcagggtatgacgtgctcaggttaaatcatgtaggagactgggggacccagtttggcatgctcatcgctcacctgcaagacaaatttccagattatctaacagtttcacctcctattggggatcttcaggtcttttataaggaatctaagaagaggtttgatactgaggaggaatttaagaagcgagcatatcagtgtgtagttctgctccagggtaaaaacccagatattacaaaagcttggaagcttatctgtgatgtctcccgccaagagttaaataaaatctatgatgcattggacgtctctttaatagagagaggggaatccttctatcaagataggatgaatgatattgtaaaggaatttgaagatagaggatttgtgcaggtggatgatggcagaaagattgtatttgtcccagggtgttccataccattaaccatagtaaaatcagatggaggttatacctatgatacatctgacctggctgctattaaacaaagactatttgaggaaaaagcagatatgattatctatgttgtggacaatggacaatctgtgcacttccagacaatatttgctgctgctcaaatgattggttggtatgaccctaaagtaactcgagtcttccatgctggatttggtgtggtgctaggggaagacaagaaaaagtttaaaacacgttcgggtgaaacagtgcgcctcatggatcttctgggagaaggactaaaacgatccatggacaagttgaaggaaaaagaaagagacaaggtcttaactgcagaggaattgaatgctgctcagacatccgttgcatatggctgcatcaaatatgctgacctttcccataaccggttgaatgactacatcttctcctttgacaaaatgctagatgacagaggaaatacagctgcttacttgttgtatgccttcactagaatcaggtctattgcacgtctggccaatattgatgaagaaatgctccaaaaagctgctcgagaaaccaagattcttttggatcatgagaaggaatggaaactaggccggtgcattttacggttccctgagattctgcaaaagattttagatgacttatttctccacactctctgtgattatatatatgagctggcaactgctttcacagagttctatgatagctgctactgtgtggagaaagatagacagactggaaaaatattgaaggtgaacatgtggcgtatgctgctatgtgaagcagtagctgctgtcatggccaaggggtttgatatcctgggaataaaacctgtccaaaggatgtaatccttcataggtttgaacactgtgtgtttttaccaaagtggccattggcactgtttgcttttttacaatcatgtggacacaagcataagtaaagaaaatttgtcaaccaggaaaaaaaaaaaaaaacaaaaaaaaaatcttttgggcgccggccttggcgctggagaaaaaaggttttcagaaccactctcgtgttggggcgcgcggggcacccacgttagagtctaagcgccaccaccgttgcccccaagcgcgtggtccccgaaggaaacccgccggtcctggacctcagcggcgcgggttctctccccccaaataaaaaaagaccgcgggggaacaccggggcgtctccggaacacacctccaaagggcgttcgggagccccctaccgggcctcatccacacggggtcccaagcgaccccaatataaattgccccacccggc

SEQ ID NO: 456627 - DNA, 3257 bp, Homo sapiens
  misc_feature (29)..(29): n is a, c, g, or t
  misc_feature (32)..(33): n is a, c, g, or t
cagaggataagtgtaaaagggtgtaattngtnnatataggctaggtacgaggcgggtgtgaatcggccgagggcgctgatgggaggatggacatactggtgtctgagtgctccgcgcggctgctgcagcaggaagaagagattaaatctctgactgctgaaattgaccggttgaaaaactgtggctgtttaggagcttctccaaatttggagcagttacaagaagaaaatttaaaattaaagtatcgactgaatattcttcgaaagagtcttcaggcagaaaggaacaaaccaactaaaaatatgattaacattattagccgcctacaagaggtctttggtcatgcaattaaggctgcatatccagatttggaaaatcctcctctgctagtgacaccaagtcagcaggccaagtttggggactatcagtgtaatagtgctatgggtatttctcagatgctcaaaaccaaggaacagaaagttaatccaagagaaattgctgaaaacattaccaaacacctcccagacaatgaatgtattgaaaaagttgaaattgctggtcctggttttattaatgtccacttaagaaaggattttgtatcagaacaattgaccagtcttctagtgaatggagttcaactacctgctctgggagagaataaaaaggttatagttgacttttcctcccctaatatagctaaagagatgcatgtaggccacctgaggtcaactatcataggagagagtataagccgcctctttgaatttgcagggtatgacgtgctcaggtatgtgctcttgccttgcgtactattctctttccttattttcttgtttggaaaattctatagaacatggaatatctcactcaagaaagaacattcgactaaatcagtggttcatcagcttagttcttctttacaaccacccagtaagcttttaaaatatgtcctgagcctttcctctgaaccttttttactattttatttttttagactcttagtggaaccaaggacaaaactccttcattctacacatgtttcttgaggacctcttgtatgcaatgggtttatatcctagcagggagagaagtagtaaagaaacaggttgttttgggccttgtaagctgtgagaggcaattgagattttattctaagtgtactgggaagctattagagagttttagtttgtgaagcagggtgatcaaattaaagattagcctgggtaccatggctcacacctataattccagcactttggtaggccaaggtgggaggatcactagaggccaggagttctaggccagcttgggcaacatagcaagaacctgtctctattttttatatttttaaagaaataaaaatttttaaataatacaaattaaagattactaggcgtgagccattgcacccggcctcaacatatattttcaagaattttgttcattgatatttgggaaccattggtctaaattatattaagataatggttaaaatgttaaattttcataaaattgtgggaataaccaacattggcccagctgtcattgtctcaattagctacaaaataaacagattatagtccactgacagaaaacacattcattcagcaaattctggatgcctgccttgtgcagcctctagtacttgagtatgcagagctgaatgtaacagacatagttttcatctcttgtggagtttgcagaccagttgaagaaacaaccaagtaaacagatattactaaatggtgatgtactggcatgtaaatattagtggttcctaatggaatatagttcctctaatttaacttaaccatctttattatttaaaaaatgattatatattctctgattggtgttaggttaaatcatgtaggagactgggggacccagtttggcatgctcatcgctcacctgcaagacaaatttccagattatctaacagtttcacctcctattggggatcttcaggtcttttataaggaatctaagaagaggtttgatactgaggaggaatttaagaagcgagcatatcagtgtgtagttctgctccagggtaaaaacccagatattacaaaagcttggaagcttatctgtgatgtctcccgccaagagttaaataaaatctatgatgcattggacgtctctttaatagagagaggggaatccttctatcaagataggatgaatgatattgtaaaggaatttgaagatagaggatttgtgcaggtggatgatggcagaaagattgtatttgtcccagggtgttccataccattaaccatagtaaaatcagatggaggttatacctatgatacatctgacctggctgctattaaacaaagactatttgaggaaaaagcagatatgattatctatgttgtggacaatggacaatctgtgcacttccagacaatatttgctgctgctcaaatgattggttggtatgaccctaaagtaactcgagtcttccatgctggatttggtgtggtgctaggggaagacaagaaaaagtttaaaacacgttcgggtgaaacagtgcgcctcatggatcttctgggagaaggactaaaacgatccatggacaagttgaaggaaaaagaaagagacaaggtcttaactgcagaggaattgaatgctgctcagacatccgttgcatatggctgcatcaaatatgctgacctttcccataaccggttgaatgactacatcttctcctttgacaaaatgctagatgacagaggaaatacagctgcttacttgttgtatgccttcactagaatcaggtctattgcacgtctggccaatattgatgaagaaatgctccaaaaagctgctcgagaaaccaagattcttttggatcatgagaaggaatggaaactaggccggtgcattttacggttccctgagattctgcaaaagattttagatgacttatttctccacactctctgtgattatatatatgagctggcaactgctttcacagagttctatgatagctgctactgtgtggagaaagatagacagactggaaaaatattgaaggtgaacatgtggcgtatgctgctatgtgaagcagtagctgctgtcatggccaaggggtttgatatcctgggaataaaacctgtccaaaggatgtaatccttcataggtttgaacactgtgtgtttttaccaaagtggccattggcactgtttgcttttttacaatcatgtggacacaagcataagtaaagaaaatttgtcaaccaggaaaaa

SEQ ID NO: 456628 - DNA, 768 bp, Homo sapiens
tgaccgtttccgcttccgtccacttggcgagtgagacgctgatgggaggatggacatactggtgtctgagtgctccgcgcggctgctgcagcaggaagaagagattaaatctctgactgctgaaattgaccggttgaaaaactgtggctgtttaggagcttctccaaatttggagcagttacaagaagaaaatttaaaattaaagtatcgactgaatattcttcgaaagagtcttcaggcagaaaggaacaaaccaactaaaaatatgattaacattattagccgcctacaagaggtctttggtcatgcaattaaggctgcatatccagatttggaaaatcctcctctgctagtgacaccaagtcagcaggccaagtttggggactatcagtgtaatagtgctatgggtatttctcagatgctcaaaaccaaggaacagaaagttaatccaagagaaattgctgaaaacattaccaaacacctcccagacaatgaatgtattgaaaaagttgaaattgctggtcctggtatgacataatgttatccttcttaatagttgtattgaacatgagtcctttttgaagttaaaaaagaacacacattttaattacagggttaaactttgtatactgaacaagatggtgaaagcactgtggattgtgatataggaaattgaagttttaatctagactcagctaccacttttagctgccttatcttgaatgagttactttgcctctctgtgattcagtttttcatcagcaaaat

SEQ ID NO: 456629 - DNA, 3338 bp, Homo sapiens
  misc_feature (50)..(50): n is a, c, g, or t
  misc_feature (142)..(142): n is a, c, g, or t
  misc_feature (178)..(178): n is a, c, g, or t
tggatgtgtatctcaagatcctggcattcagactggggctctacaagtcncactatatttgcaagttgtagcagaactatattaaaaacatgccctgcctgtttcccctcgttggtcctcccattcagagaggggctttctngccttgtgctttaaatagtcctcagacggtaatgtngatagtagatgaacacaattcttgtgaatccatttgccttgtgcttgggagttctattcttagaccacaatcaccggaatagaaagcctccgaccccacatccgaactgaagccatgtgggcctggctaatggatttctttgggaagctgggacaaaggaccgggtctgcttctgtcattgactaggccaggtatggagcagtccattagaaaccagtctcctcccaattgtctggagtttatgagcctggcttacctgggatcattttcatgttatgatcctaattaaagttcagcctgtttactctgctccagtcaaggagttacagggggaatcaaggcagataagatgtttatgggtgaaccctgtttcattttcctcggatccacaattaaagaattaacagcacttgttatttattgagcagaaccgtgggcgggaggagggctttagtgcttgttttgctgcttctgtgagcccagggctgcgccagcagcatttcacttttaatccttagtattgttaggcctatacttccacctatagaggtggcaattgaggatcttgacttgcccaggggttcatgatcacgaaccttctactacttcataccttgaacaccatctcttctaatagatgggcaacaatatggtcatttctgtgaagatactggtgacttaaaagcattactaaatgtttattaaacacttgaatatagtaattatatatgtgagaatggattcacatctagggctcctgacagtatctgtcaagatgctggccccaaaccctgagtttgtcatgttatgtgggcatatttggttgcccaactctgaagccaaatgatgccagggagagagagcctccatgctgtgggggtgtttctaagagcagcctggtccttaattatcctactaaagacagtgtcctctgtgatctcagactcataacatccctgttaagataggagggggctgaaatcatttgttctccttcacattgaggggagactcaggcacagatgagagacagaggcagagaagttaaataattagtccaaggtcacatcaaatgatttccaactcagctgatgaatctgtctaggtctcggtctccaaatattgcagcttcccttacaatgtaatttgatctcaaacactttacgtgtcttatttttcttcctcctttttctattttggtaaataagatgttttttacacctactgccagattaatgttgggttttaatttagcccttcaagatgatcaatgacttaaccgaggaaactgctgccagaatgtagtttataatgtaccttttttcctatactcggttttctgcttctgtattttgtacattgtcagtctctgtgggttaagaactttgggactctcaagggtcatcttgacagaggagcttctgcagttgggaattgttacctttctcagagcagtgctattgggaaaaaaaaatctaagcatttttgttctcagcttcacagaggaagtgaagcacattcaagggtagcccattggcttctcgtataggaatagtatagatttggcttattttattccttgcttattataatattattattcataagcataccttttcagttaccctcatgatttactatctgtaagagcataagcttactgtttgtgtaatatttgtccctgtattttagatgggagttgctgaggtggtataaggtttggtaactgcatccggcctctcagggaaataaccaagttgttcagattcttagctgtattatgtgaagttgtttgtcagcttcattgcttactactgtgaaataagttataaagaggaacttttaataaaaataaatggattcactcaggggaggggtattcattgttggtgaaatatgtcgaggaccagatgctttttggtctcccaaagacctatcaaactgcagatcttttggctttgtaatatattcagttccacatttattcattcaagatttttgtgtcctcattatgtgccaagtactgggttggacactaggtgacagagatgaacaaatccctaatcttgggatttcacagtggatgttggaatttagtaccgtttagcttcattaggttctgcagtagtcccaagattttccaagatcatcctgtcctccagtgttctattgattcaacttcagaatatatcccagactctgtccctctttactcctcactgctgttgccctgggtccatctgccatcatctctcacctggattatctcagtagtttcccaactggtttccttgtttccattcttgcctccttctgtctactctcaatataacagctagaacaatccttttacaatggaattcagatcatgtttacccctctgttcaaattctccagtgactttccagtttttacatgatctggctcctactacctgtctcactgtgtttcctactactctcctgctctttctcctcttaataaacactgggctcatggtgtttcctttaacatgccaggcatgcttgaccctgtcctgtctcagggccctgctgttccctctgcctggaacattcttcccatagtgtctgcatggctcgctctctcactgctttggattgctgctcaaaagtcaccttatcaaaggcctttcccaaaggtttaaaaatcattctactataaagacacatgcatacatatgtttattgcagcactattcacaataacaaagacttggaaccaacccaaatgcccatcaatgatagactggataaagaaaatatggcacgtaagcaccatggaatactatgcagccataaaaaagaatgagttcatgtcctttgcagggacatggatgaagctggaaaccattattctcagcaaactaacacaggaacagaaaaccaaacaccgcatgttctcactcataagtgggagttgaacaatgagaacatacgggcacagtggggggaacatcacacaccagggcctgtcggggggtgagaggcaagggaagtgatagcattaagagaaatacctaatgtagattatgggttgatgggggcagcaaaccaccatggcacatgtgtacctatgtaacaaacctgcacattctgcacatatatcccagaacttaaagtataattaaagaaaaaaaaaa

SEQ ID NO: 456630 - DNA, 5944 bp, Homo sapiens
  misc_feature (3)..(3): n is a, c, g, or t
  misc_feature (4503)..(4503): n is a, c, g, or t
ggnagatttgaatacttcactgaggcgagccgggcgttgtgagcggactgctagaggcggctgtctgtttccgctctaaggaaactcagagcgtgtggaccccaaacaagtctgcgcaaaatttgtcgaggaggtttgccgcggcagaaaagttttcttcaaaaatggatggggtgtcttcagaggctaatgaagaaaatgacaatatagagagacctgttagaagacggcattcttcaatattgaaacccccaaggagtcctcttcaggacctcagaggtgggaatgaaacagttcaggaatccaatgctttgagaaataagaaaaactctcgtcgagtcagctttgcagatactataaaggtattccagacggagtctcatatgaaaatagtgagaaagtcagaaatggaagaaacagaagcaggagaaaatcttcttttgatacagaataagaaattagaagataattactgtgaaattactgggatgaacacattgctttctgctcccattcatacccagatgcaacagaaggagttttcaattatagaacatacccgtgaaaggaaacatgcaaatgaccagacagtcattttttcagatgaaaaccagatggacctgacatcaagtcacactgtaatgattaccaaaggccttttagataatcccataagtgaaaagtccaccaagatagataccacatcatttctagctaatttaaagcttcacaccgaggactcaagaatgaaaaaagaagtaaatttttccgtggatcaaaacacttcttcagaaaataaaatagatttcaatgacttcataaaaagattgaaaacaggaaaatgtagtgcttttcctgatgtgcctgataaagaaaattttgagatacctatttattccaaggaaccgaacagtgcctcttctacacatcaaatgcatgtatctcttaaggaagatgaaaataacagtaatattactaggctctttagagaaaaagatgatgggatgaatttcacccagtgtcatacagccaatattcagacattgattcccacatccagtgagaccaactcacgggaatctaaaggtaatgatattacaatttatggcaatgactttatggacttgacatttaaccacactttgcagatcttacctgcaacaggtaatttttctgaaatagaaaatcaaactcagaatgccatggatgtaacaacaggttatggaactaaagcttcaggaaataaaacagtttttaagagtaaacaaaatactgcttttcaagacctttccataaactctgcagacaaaatacatattaccagaagtcatattatgggggcagaaactcacatagtctcacagacttgtaatcaggatgccagaatattagccatgaccccagaatctatatattctaatccatctattcaaggttgtaagactgttttctattctagttgtaatgatgccatggaaatgaccaaatgtctctcaaatatgagagaggagaaaaatttgctaaagcatgacagtaattattctaaaatgtattgcaatccagatgctatgtcttctctcacagagaaaactatttattccggagaggagaacatggacattaccaagagtcatacagttgcaatagataatcaaatttttaaacaagatcaatcaaatgtgcaaatagcagctgcaccaacacccgaaaaagaaatgatgctccaaaatcttatgaccacatcagaagatgggaaaatgaatgtaaattgtaactcagttcctcatgtatctaaggaaagaatacagcagagcctgtcaaatcctttgtctatttcattgactgatagaaagactgaactcttatcaggtgaaaatacggatttgactgaaagtcacacaagtaacttaggaagtcaggttcctcttgcagcttataatctagcaccggagagtaccagtgaatctcactctcagagcaaaagctcttcagatgaatgtgaagaaattaccaaaagtcgtaatgaaccatttcagcgatcagacataatagccaaaaacagcttaaccgacacctggaacaaagacaaagattgggttttgaagattttgccctaccttgataaagattctcctcagtcagctgattgtaatcaggagatagcaacaagccataatatagtctactgtggtggagttcttgataaacaaataactaatagaaatacagtatcatgggaacaatctttgttttctaccacaaagccattattttcatcaggacagttctctatgaaaaatcatgatactgctataagtagtcatacagtgaaatctgtactaggccagaattctaaactggctgagccactgaggaaaagtttaagcaatcccacacctgactattgccatgacaagatgattatatgttcagaggaagagcaaaatatggatctaacaaagagccacactgtcgtcattggatttggtccttctgaactacaagaacttggtaaaactaatttagaacacactactggccagctaacaacaatgaacagacagatagctgtaaaagttgaaaaatgtggtaaaagtcccatagaaaaaagtggagtgcttaaatctaactgtattatggatgtgttagaggacgaaagtgtacagaaacctaaatttccaaaggaaaagcaaaatgtcaaaatttggggaaggaaaagtgttggtggaccaaaaattgataagactattgtattttcagaagacgataagaatgatatggatatcactaagagttatacaatagaaataaaccatagacctttattagagaaacgtgattgtcatttggtgccattggcaggaacttctgaaactattttatatacatgtgggcaggatgacatggagatcactagaagtcacacaactgccttagaatgtaaaactgtctcaccagatgaaataactactaggcctatggacaaaactgtagtgtttgtagataatcatgttgaactagaaatgacagagtcccatactgttttcattgactaccaagaaaaggaaagaacagacagacctaactttgaactatcccaaaggaaaagcctaggaacaccaacagtgatatgtactcctactgaggagagtgttttctttccaggaaatggtgaaagtgaccgtctagtagcaaatgacagccagctaacccctctggaggaatggtctaataataggggccctgtagaggtagctgataacatggaattgtctaaatcagccacttgcaaaaacatcaaagatgtacaaagtcctggatttctgaatgaacctctatcaagcaaaagtcagagaagaaaaagccttaagctaaaaaatgacaagaccattgtattttcagagaatcataaaaatgatatggatattacccagagttgtatggtggaaatagataacgaaagtgccctggaggataaagaggacttccatttggcaggggcttctaaaactattttgtattcatgtgggcaggatgacatggagatcactaggagtcacacaactgccttagaatgtaaaactctcctgccaaatgaaatagctattaggcccatggacaaaaccgtattgttcacagataattacagtgatctggaagtcaccgattcccatactgttttcattgactgtcaagccacagagaaaatacttgaagaaaaccctaaatttggaataggaaaaggaaaaaacttgggtgtttcctttcctaaggataatagctgtgttcaagaaatcgctgaaaaacaagcactggctgtaggaaacaaaatagttcttcacaccgagcaaaagcaacaactctttgctgctactaatagaactactaatgaaatcatcaaatttcatagtgctgctatggatgaaaaggtcataggggaagttgtagaccaggcctgtacattggaaaaagcgcaagttgaaagctgtcagttaaataatagagatagaagaaatgtggactttacaagtagtcatgcaactgctgtttgtggatccagtgataattattcctgtttaccaaatgttatttcctgtactgataatttggagggtagtgccatgctcttatgtgataaagatgaggaaaaagccaattattgcccagtgcaaaatgatcttgcttatgcaaatgattttgccagtgaatattacttggaatctgagggacagcctctctctgctccttgtcctttgttagagaaggaagaagttattcaaaccagtaccaaaggacagttagactgtgttataacactgcacaaagatcaagatctgattaaggatccacgaaatctattggctaatcaaactttagtatatagtcaagatctgggggagatgactaaacttaattcaaagcgagtatcttttaagcttccaaaggatcaaatgaaagtctatgttgatgacatttatgttattcctcagcctcatttctcanccgaccaacctccattacctaaaaaaggacagagtagtatcaataaagaagaagtaatactgtctaaagctggaaataagagtttaaatattatagaaaattcctctgcacccatatgtgaaaacaagcccaaaatactcaatagtgaggaatggtttgctgcagcctgtaaaaaagaactgaaggaaaatattcaaacaactaactataatacagctctagatttccacagtaactcagacgtaactaagcaagtcattcaaactcatgtcaatgctggagaagcaccagatcctgtaattacatctaatgttccatgttttcatagtatcaaaccaaatctgaataatttgaatggaaaaactggagagtttttagcctttcaaactgttcatctaccaccccttccagagcaattacttgaattaggaaataaggcacacaatgatatgcatatagtgcaagctacagaaatacataatattaacataatctccagcaatgctaaagatagtagagatgaggaaaataaaaagtctcataatggagctgaaaccacctctctaccgccaaagacagtttttaaagataaagtaaggagatgttctttgggaatctttttgcctagattgcccaacaagagaaattgtagtgtcactggtattgatgacctggaacagattccagcagacacaactgatataaatcacttagaaactcagccggtctctagcaaagattcaggcattggatctgttgcaggtaaactgaacctaagtccttctcaatatataaatgaggaaaatcttcctgtatatcctgatgagatcaattcttcagactctattaacatagaaactgaggaaaaggccttgattgagacataccaaaaagagatttcaccatatgaaaataaaatgggaaaaacttgcaatagccaaaaaagaacgtgggtacaagaagaagaagatattcataaggagaaaaaaatcagaaaaaatgagattaagtttagtgatacgacacaagatcgggaggtgagctctgtcttgaaccaaagaatgttcttgaattttgggttttgttttgttttcttaaattgtgggtattctcaaattttaatcttagtctcgggtaggcagaaaataattatttccacttagagggctggagaaatattcttatgtagaaccttcagaaattaattgactaacagctagacttcaaagcaatttaaagtgacaaatagtcacaaaaaaattaaatggaaaattgtacaaaaagtagccaaagttaaaattgtataatttcaaaaatttcaaaaggtatgtatactgtcacctctagtgatttgtcaatttggctttataataaagaatctctagggaggttatatatagcttgaaaagtcatcttcagtgttgttatatttggggagtaa

SEQ ID NO: 456631 - DNA, 519 bp, Homo sapiens
gtaagtgagccactaagcattgaaatgttttcataatttcactggattttttttcccactttttctagatgcttgaagaattctcactggtagtgcaccattgcagactccttggagaggagattgagtatttaaagagatggggaccaaattataacctaatgaacatagatattaataataatgagtaagtgtattagttcccaaggactgccatgacagagtactacaaattgggtaccttaacaggttctggaggctggaggtctgagattaaggtgtaagcgggtgttattctttctgagggctgttagaatctgtccatgccttctcccagtgtctggtggtttgctggcaatctttggcattccttggcttgtaaatgcataaccttgatctctcccttcatgttgacatggtgtctttcattgtgcatgtctgcatccacatttcccctttttataaggacactagtcatagtggattaggggcccaccttactctagtaggacttcatct

SEQ ID NO: 456632 - DNA, 8614 bp, Homo sapiens
  misc_feature (3)..(3): n is a, c, g, or t
  misc_feature (4503)..(4503): n is a, c, g, or t
ggnagatttgaatacttcactgaggcgagccgggcgttgtgagcggactgctagaggcggctgtctgtttccgctctaaggaaactcagagcgtgtggaccccaaacaagtctgcgcaaaatttgtcgaggaggtttgccgcggcagaaaagttttcttcaaaaatggatggggtgtcttcagaggctaatgaagaaaatgacaatatagagagacctgttagaagacggcattcttcaatattgaaacccccaaggagtcctcttcaggacctcagaggtgggaatgaaacagttcaggaatccaatgctttgagaaataagaaaaactctcgtcgagtcagctttgcagatactataaaggtattccagacggagtctcatatgaaaatagtgagaaagtcagaaatggaagaaacagaagcaggagaaaatcttcttttgatacagaataagaaattagaagataattactgtgaaattactgggatgaacacattgctttctgctcccattcatacccagatgcaacagaaggagttttcaattatagaacatacccgtgaaaggaaacatgcaaatgaccagacagtcattttttcagatgaaaaccagatggacctgacatcaagtcacactgtaatgattaccaaaggccttttagataatcccataagtgaaaagtccaccaagatagataccacatcatttctagctaatttaaagcttcacaccgaggactcaagaatgaaaaaagaagtaaatttttccgtggatcaaaacacttcttcagaaaataaaatagatttcaatgacttcataaaaagattgaaaacaggaaaatgtagtgcttttcctgatgtgcctgataaagaaaattttgagatacctatttattccaaggaaccgaacagtgcctcttctacacatcaaatgcatgtatctcttaaggaagatgaaaataacagtaatattactaggctctttagagaaaaagatgatgggatgaatttcacccagtgtcatacagccaatattcagacattgattcccacatccagtgagaccaactcacgggaatctaaaggtaatgatattacaatttatggcaatgactttatggacttgacatttaaccacactttgcagatcttacctgcaacaggtaatttttctgaaatagaaaatcaaactcagaatgccatggatgtaacaacaggttatggaactaaagcttcaggaaataaaacagtttttaagagtaaacaaaatactgcttttcaagacctttccataaactctgcagacaaaatacatattaccagaagtcatattatgggggcagaaactcacatagtctcacagacttgtaatcaggatgccagaatattagccatgaccccagaatctatatattctaatccatctattcaaggttgtaagactgttttctattctagttgtaatgatgccatggaaatgaccaaatgtctctcaaatatgagagaggagaaaaatttgctaaagcatgacagtaattattctaaaatgtattgcaatccagatgctatgtcttctctcacagagaaaactatttattccggagaggagaacatggacattaccaagagtcatacagttgcaatagataatcaaatttttaaacaagatcaatcaaatgtgcaaatagcagctgcaccaacacccgaaaaagaaatgatgctccaaaatcttatgaccacatcagaagatgggaaaatgaatgtaaattgtaactcagttcctcatgtatctaaggaaagaatacagcagagcctgtcaaatcctttgtctatttcattgactgatagaaagactgaactcttatcaggtgaaaatacggatttgactgaaagtcacacaagtaacttaggaagtcaggttcctcttgcagcttataatctagcaccggagagtaccagtgaatctcactctcagagcaaaagctcttcagatgaatgtgaagaaattaccaaaagtcgtaatgaaccatttcagcgatcagacataatagccaaaaacagcttaaccgacacctggaacaaagacaaagattgggttttgaagattttgccctaccttgataaagattctcctcagtcagctgattgtaatcaggagatagcaacaagccataatatagtctactgtggtggagttcttgataaacaaataactaatagaaatacagtatcatgggaacaatctttgttttctaccacaaagccattattttcatcaggacagttctctatgaaaaatcatgatactgctataagtagtcatacagtgaaatctgtactaggccagaattctaaactggctgagccactgaggaaaagtttaagcaatcccacacctgactattgccatgacaagatgattatatgttcagaggaagagcaaaatatggatctaacaaagagccacactgtcgtcattggatttggtccttctgaactacaagaacttggtaaaactaatttagaacacactactggccagctaacaacaatgaacagacagatagctgtaaaagttgaaaaatgtggtaaaagtcccatagaaaaaagtggagtgcttaaatctaactgtattatggatgtgttagaggacgaaagtgtacagaaacctaaatttccaaaggaaaagcaaaatgtcaaaatttggggaaggaaaagtgttggtggaccaaaaattgataagactattgtattttcagaagacgataagaatgatatggatatcactaagagttatacaatagaaataaaccatagacctttattagagaaacgtgattgtcatttggtgccattggcaggaacttctgaaactattttatatacatgtgggcaggatgacatggagatcactagaagtcacacaactgccttagaatgtaaaactgtctcaccagatgaaataactactaggcctatggacaaaactgtagtgtttgtagataatcatgttgaactagaaatgacagagtcccatactgttttcattgactaccaagaaaaggaaagaacagacagacctaactttgaactatcccaaaggaaaagcctaggaacaccaacagtgatatgtactcctactgaggagagtgttttctttccaggaaatggtgaaagtgaccgtctagtagcaaatgacagccagctaacccctctggaggaatggtctaataataggggccctgtagaggtagctgataacatggaattgtctaaatcagccacttgcaaaaacatcaaagatgtacaaagtcctggatttctgaatgaacctctatcaagcaaaagtcagagaagaaaaagccttaagctaaaaaatgacaagaccattgtattttcagagaatcataaaaatgatatggatattacccagagttgtatggtggaaatagataacgaaagtgccctggaggataaagaggacttccatttggcaggggcttctaaaactattttgtattcatgtgggcaggatgacatggagatcactaggagtcacacaactgccttagaatgtaaaactctcctgccaaatgaaatagctattaggcccatggacaaaaccgtattgttcacagataattacagtgatctggaagtcaccgattcccatactgttttcattgactgtcaagccacagagaaaatacttgaagaaaaccctaaatttggaataggaaaaggaaaaaacttgggtgtttcctttcctaaggataatagctgtgttcaagaaatcgctgaaaaacaagcactggctgtaggaaacaaaatagttcttcacaccgagcaaaagcaacaactctttgctgctactaatagaactactaatgaaatcatcaaatttcatagtgctgctatggatgaaaaggtcataggggaagttgtagaccaggcctgtacattggaaaaagcgcaagttgaaagctgtcagttaaataatagagatagaagaaatgtggactttacaagtagtcatgcaactgctgtttgtggatccagtgataattattcctgtttaccaaatgttatttcctgtactgataatttggagggtagtgccatgctcttatgtgataaagatgaggaaaaagccaattattgcccagtgcaaaatgatcttgcttatgcaaatgattttgccagtgaatattacttggaatctgagggacagcctctctctgctccttgtcctttgttagagaaggaagaagttattcaaaccagtaccaaaggacagttagactgtgttataacactgcacaaagatcaagatctgattaaggatccacgaaatctattggctaatcaaactttagtatatagtcaagatctgggggagatgactaaacttaattcaaagcgagtatcttttaagcttccaaaggatcaaatgaaagtctatgttgatgacatttatgttattcctcagcctcatttctcanccgaccaacctccattacctaaaaaaggacagagtagtatcaataaagaagaagtaatactgtctaaagctggaaataagagtttaaatattatagaaaattcctctgcacccatatgtgaaaacaagcccaaaatactcaatagtgaggaatggtttgctgcagcctgtaaaaaagaactgaaggaaaatattcaaacaactaactataatacagctctagatttccacagtaactcagacgtaactaagcaagtcattcaaactcatgtcaatgctggagaagcaccagatcctgtaattacatctaatgttccatgttttcatagtatcaaaccaaatctgaataatttgaatggaaaaactggagagtttttagcctttcaaactgttcatctaccaccccttccagagcaattacttgaattaggaaataaggcacacaatgatatgcatatagtgcaagctacagaaatacataatattaacataatctccagcaatgctaaagatagtagagatgaggaaaataaaaagtctcataatggagctgaaaccacctctctaccgccaaagacagtttttaaagataaagtaaggagatgttctttgggaatctttttgcctagattgcccaacaagagaaattgtagtgtcactggtattgatgacctggaacagattccagcagacacaactgatataaatcacttagaaactcagccggtctctagcaaagattcaggcattggatctgttgcaggtaaactgaacctaagtccttctcaatatataaatgaggaaaatcttcctgtatatcctgatgagatcaattcttcagactctattaacatagaaactgaggaaaaggccttgattgagacataccaaaaagagatttcaccatatgaaaataaaatgggaaaaacttgcaatagccaaaaaagaacgtgggtacaagaagaagaagatattcataaggagaaaaaaatcagaaaaaatgagattaagtttagtgatacgacacaagatcgggagatttttgatcaccatactgaagaggatatagataaaagtgctaacagtgtattgataaaaaacctgagcaggaccccatctagttgcagcagctctctggattcaatcaaggctgatgggacctctctggacttcagcacttaccgcagtagtcaaatggaatcacagtttctcagagatactatttgtgaagagagcttgagggagaaactccaagatgggagaataacaataagggagttctttatacttctccaggtccacatcttgatacagaaaccccgacagagcaatctcccaggcaattttactgtaaacacaccacctactccagaagacctgatgttaagtcaatatgtttaccgacccaagatacagatttatagagaagattgtgaggctcgtcgccaaaagattgaagaattaaagctttctgcatcgaaccaagataagctgttggttgatataaataagaacctgtgggaaaaaatgagacactgctctgacaaagagctgaaggcctttggaatttatcttaacaaaataaagtcatgttttaccaagatgactaaagtcttcactcaccaaggaaaagtggctctgtatggcaagctggtgcagtcagctcagaatgagagggagaaacttcaaataaagatagatgagatggataaaatacttaagaagatcgataactgcctcactgagatggaaacagaaactaagaatttggaggatgaagagaaaaacaatcctgtggaagaatgggattctgaaatgagagctgcagaaaaagaattggaacagctgaaaactgaagaagaggagcttcaaagaaatctcttagaactggaggtacaaaaagagcagacccttgctcaaatagactttatgcaaaaacaaagaaatagaactgaagagctactggatcagttgagcttgtctgagtgggatgtcgttgagtggagtgatgatcaagctgtattcacctttgtttatgacacgatacaactcaccatcacctttgaagagtcagttgttggtttccctttcctggacaagcgttataggaagattgttgatgtcaattttcaatctctgttagatgaggatcaagctcctccttcctcccttttagttcataagcttattttccagtacgttgaagaaaaggaatcctggaagaagacatgtacaacccagcatcagttacccaagatgcttgaagaattctcactggtagtgcaccattgcagactccttggagaggagattgagtatttaaagagatggggaccaaattataacctaatgaacatagatattaataataatgaattgagacttttattctctagctccgcagcatttgcaaagtttgaaataactttgtttctctcagcctattatccatctgtaccattaccttccaccattcagaatcacgttgggaacactagccaagatgatattgctaccattctatctaaagtgccactggagaacaactacctgaagaatgtagtcaagcaaatttaccaagatctgtttcaggactgccatttctaccactagacccttggaccaccattggaacaaccaagcagaatgtacttgatattatttcagggtcccattgctgttcagcctttgtttttacgtcattacaagctgagtaaaattccttctgatgatgttatagttaatctgtatgttttttatatctctgcagaatgatggtgatgaagtctggatggtaggcctcatagcctactatcaacttactcatctttgtaccaaaggtttaagtaataggacacttaggaaaaatgtctcctaactaaactagtgctttctgctttagtacaagccctaaggattaacttaagtataagaagtgttatcactgacaagaacattagccattttcccataactagatagagctatgattttttaggttgcctggcttctgcctagcagatatttctggagtagaaatgtatctgtctacaaactattatcctttttctccgttactaaaatgctattaagagaaagtagggctgggagccaccacacccagcaatgttttcttaataagtatagtttttctagggaaagttaattcatttttgtctagtacatatatgtaaatatattaatgttgtttttgtgtttgtgatgtagtaaggagatgtacatagaaattcattgaggtatatagatactcatctgtctaggcagttcccaattttctgaagaatgttttacagcaaaattttctattttcttttattaaatagtgacacgtcaaacaatgtcacatccaaaacactagtttcatcaatttctagcagtaataatagacttgctgtaagtattgttttctgatgccatacccttgtcatacatattattaaatgaccaatattatgtatgaagtagacaaaaaaatttactcaaacttcattcaaatcctaattgtgataatttttgttttatatttaattataaaccaaaatacatttgcatttttaagctaatttgtctcaaaattttgctttatatttttggatcaggttaaagtcctgtggatcccctgaatgttattgtccctcttgattggtttttacttctgagctatacgtcaaaagacacataagcttcaaaagtcaagacaaacctcatttgccataaaaatcaagatatagatgttctgttccgtaaactccttgaaaaacattttaaagtcatcaatatgatctgtttcccatgaaacttaagttagctttcttattggagttatttcttttctgtaagtctgaaaagtagagattttgttttacgcattttagtaacctgcaacaaccaactctaaaaaagatttggcttgtaatgacggtctctgcttttttgggtttggagtacacaattgtaatatttacttagttatttgtgtttttctttgttcaaggtattgactagtttcataaattttttgaaagtttttctttcattggttggaaagcagattacattttgcactattaaaataagtttattactttaaa

SEQ ID NO: 456633 - DNA, 8496 bp, Homo sapiens
  misc_feature (3)..(3): n is a, c, g, or t
  misc_feature (4503)..(4503): n is a, c, g, or t
ggnagatttgaatacttcactgaggcgagccgggcgttgtgagcggactgctagaggcggctgtctgtttccgctctaaggaaactcagagcgtgtggaccccaaacaagtctgcgcaaaatttgtcgaggaggtttgccgcggcagaaaagttttcttcaaaaatggatggggtgtcttcagaggctaatgaagaaaatgacaatatagagagacctgttagaagacggcattcttcaatattgaaacccccaaggagtcctcttcaggacctcagaggtgggaatgaaacagttcaggaatccaatgctttgagaaataagaaaaactctcgtcgagtcagctttgcagatactataaaggtattccagacggagtctcatatgaaaatagtgagaaagtcagaaatggaagaaacagaagcaggagaaaatcttcttttgatacagaataagaaattagaagataattactgtgaaattactgggatgaacacattgctttctgctcccattcatacccagatgcaacagaaggagttttcaattatagaacatacccgtgaaaggaaacatgcaaatgaccagacagtcattttttcagatgaaaaccagatggacctgacatcaagtcacactgtaatgattaccaaaggccttttagataatcccataagtgaaaagtccaccaagatagataccacatcatttctagctaatttaaagcttcacaccgaggactcaagaatgaaaaaagaagtaaatttttccgtggatcaaaacacttcttcagaaaataaaatagatttcaatgacttcataaaaagattgaaaacaggaaaatgtagtgcttttcctgatgtgcctgataaagaaaattttgagatacctatttattccaaggaaccgaacagtgcctcttctacacatcaaatgcatgtatctcttaaggaagatgaaaataacagtaatattactaggctctttagagaaaaagatgatgggatgaatttcacccagtgtcatacagccaatattcagacattgattcccacatccagtgagaccaactcacgggaatctaaaggtaatgatattacaatttatggcaatgactttatggacttgacatttaaccacactttgcagatcttacctgcaacaggtaatttttctgaaatagaaaatcaaactcagaatgccatggatgtaacaacaggttatggaactaaagcttcaggaaataaaacagtttttaagagtaaacaaaatactgcttttcaagacctttccataaactctgcagacaaaatacatattaccagaagtcatattatgggggcagaaactcacatagtctcacagacttgtaatcaggatgccagaatattagccatgaccccagaatctatatattctaatccatctattcaaggttgtaagactgttttctattctagttgtaatgatgccatggaaatgaccaaatgtctctcaaatatgagagaggagaaaaatttgctaaagcatgacagtaattattctaaaatgtattgcaatccagatgctatgtcttctctcacagagaaaactatttattccggagaggagaacatggacattaccaagagtcatacagttgcaatagataatcaaatttttaaacaagatcaatcaaatgtgcaaatagcagctgcaccaacacccgaaaaagaaatgatgctccaaaatcttatgaccacatcagaagatgggaaaatgaatgtaaattgtaactcagttcctcatgtatctaaggaaagaatacagcagagcctgtcaaatcctttgtctatttcattgactgatagaaagactgaactcttatcaggtgaaaatacggatttgactgaaagtcacacaagtaacttaggaagtcaggttcctcttgcagcttataatctagcaccggagagtaccagtgaatctcactctcagagcaaaagctcttcagatgaatgtgaagaaattaccaaaagtcgtaatgaaccatttcagcgatcagacataatagccaaaaacagcttaaccgacacctggaacaaagacaaagattgggttttgaagattttgccctaccttgataaagattctcctcagtcagctgattgtaatcaggagatagcaacaagccataatatagtctactgtggtggagttcttgataaacaaataactaatagaaatacagtatcatgggaacaatctttgttttctaccacaaagccattattttcatcaggacagttctctatgaaaaatcatgatactgctataagtagtcatacagtgaaatctgtactaggccagaattctaaactggctgagccactgaggaaaagtttaagcaatcccacacctgactattgccatgacaagatgattatatgttcagaggaagagcaaaatatggatctaacaaagagccacactgtcgtcattggatttggtccttctgaactacaagaacttggtaaaactaatttagaacacactactggccagctaacaacaatgaacagacagatagctgtaaaagttgaaaaatgtggtaaaagtcccatagaaaaaagtggagtgcttaaatctaactgtattatggatgtgttagaggacgaaagtgtacagaaacctaaatttccaaaggaaaagcaaaatgtcaaaatttggggaaggaaaagtgttggtggaccaaaaattgataagactattgtattttcagaagacgataagaatgatatggatatcactaagagttatacaatagaaataaaccatagacctttattagagaaacgtgattgtcatttggtgccattggcaggaacttctgaaactattttatatacatgtgggcaggatgacatggagatcactagaagtcacacaactgccttagaatgtaaaactgtctcaccagatgaaataactactaggcctatggacaaaactgtagtgtttgtagataatcatgttgaactagaaatgacagagtcccatactgttttcattgactaccaagaaaaggaaagaacagacagacctaactttgaactatcccaaaggaaaagcctaggaacaccaacagtgatatgtactcctactgaggagagtgttttctttccaggaaatggtgaaagtgaccgtctagtagcaaatgacagccagctaacccctctggaggaatggtctaataataggggccctgtagaggtagctgataacatggaattgtctaaatcagccacttgcaaaaacatcaaagatgtacaaagtcctggatttctgaatgaacctctatcaagcaaaagtcagagaagaaaaagccttaagctaaaaaatgacaagaccattgtattttcagagaatcataaaaatgatatggatattacccagagttgtatggtggaaatagataacgaaagtgccctggaggataaagaggacttccatttggcaggggcttctaaaactattttgtattcatgtgggcaggatgacatggagatcactaggagtcacacaactgccttagaatgtaaaactctcctgccaaatgaaatagctattaggcccatggacaaaaccgtattgttcacagataattacagtgatctggaagtcaccgattcccatactgttttcattgactgtcaagccacagagaaaatacttgaagaaaaccctaaatttggaataggaaaaggaaaaaacttgggtgtttcctttcctaaggataatagctgtgttcaagaaatcgctgaaaaacaagcactggctgtaggaaacaaaatagttcttcacaccgagcaaaagcaacaactctttgctgctactaatagaactactaatgaaatcatcaaatttcatagtgctgctatggatgaaaaggtcataggggaagttgtagaccaggcctgtacattggaaaaagcgcaagttgaaagctgtcagttaaataatagagatagaagaaatgtggactttacaagtagtcatgcaactgctgtttgtggatccagtgataattattcctgtttaccaaatgttatttcctgtactgataatttggagggtagtgccatgctcttatgtgataaagatgaggaaaaagccaattattgcccagtgcaaaatgatcttgcttatgcaaatgattttgccagtgaatattacttggaatctgagggacagcctctctctgctccttgtcctttgttagagaaggaagaagttattcaaaccagtaccaaaggacagttagactgtgttataacactgcacaaagatcaagatctgattaaggatccacgaaatctattggctaatcaaactttagtatatagtcaagatctgggggagatgactaaacttaattcaaagcgagtatcttttaagcttccaaaggatcaaatgaaagtctatgttgatgacatttatgttattcctcagcctcatttctcanccgaccaacctccattacctaaaaaaggacagagtagtatcaataaagaagaagtaatactgtctaaagctggaaataagagtttaaatattatagaaaattcctctgcacccatatgtgaaaacaagcccaaaatactcaatagtgaggaatggtttgctgcagcctgtaaaaaagaactgaaggaaaatattcaaacaactaactataatacagctctagatttccacagtaactcagacgtaactaagcaagtcattcaaactcatgtcaatgctggagaagcaccagatcctgtaattacatctaatgttccatgttttcatagtatcaaaccaaatctgaataatttgaatggaaaaactggagagtttttagcctttcaaactgttcatctaccaccccttccagagcaattacttgaattaggaaataaggcacacaatgatatgcatatagtgcaagctacagaaatacataatattaacataatctccagcaatgctaaagatagtagagatgaggaaaataaaaagtctcataatggagctgaaaccacctctctaccgccaaagacagtttttaaagataaagtaaggagatgttctttgggaatctttttgcctagattgcccaacaagagaaattgtagtgtcactggtattgatgacctggaacagattccagcagacacaactgatataaatcacttagaaactcagccggtctctagcaaagattcaggcattggatctgttgcaggtaaactgaacctaagtccttctcaatatataaatgaggaaaatcttcctgtatatcctgatgagatcaattcttcagactctattaacatagaaactgaggaaaaggccttgattgagacataccaaaaagagatttcaccatatgaaaataaaatgggaaaaacttgcaatagccaaaaaagaacgtgggtacaagaagaagaagatattcataaggagaaaaaaatcagaaaaaatgagattaagtttagtgatacgacacaagatcgggagatttttgatcaccatactgaagaggatatagataaaagtgctaacagtgtattgataaaaaacctgagcaggaccccatctagttgcagcagctctctggattcaatcaaggctgatgggacctctctggacttcagcacttaccgcagtagtcaaatggaatcacagtttctcagagatactatttgtgaagagagcttgagggagaaactccaagatgggagaataacaataagggagttctttatacttctccaggtccacatcttgatacagaaaccccgacagagcaatctcccaggcaattttactgtaaacacaccacctactccagaagacctgatgttaagtcaatatgtttaccgacccaagatacagatttatagagaagattgtgaggctcgtcgccaaaagattgaagaattaaagctttctgcatcgaaccaagataagctgttggttgatataaataagaacctgtgggaaaaaatgagacactgctctgacaaagagctgaaggcctttggaatttatcttaacaaaataaagtcatgttttaccaagatgactaaagtcttcactcaccaaggaaaagtggctctgtatggcaagctggtgcagtcagctcagaatgagagggagaaacttcaaataaagatagatgagatggataaaatacttaagaagatcgataactgcctcactgagatggaaacagaaactaagaatttggaggatgaagagaaaaacaatcctgtggaagaatgggattctgaaatgagagctgcagaaaaagaattggaacagctgaaaactgaagaagaggagcttcaaagaaatctcttagaactggaggtacaaaaagagcagacccttgctcaaatagactttatgcaaaaacaaagaaatagaactgaagagctactggatcagttgagcttgtctgagtgggatgtcgttgagtggagtgatgatcaagctgtattcacctttgtttatgacacgatacaactcaccatcacctttgaagagtcagttgttggtttccctttcctggacaagcgttataggaagattgttgatgtcaattttcaatctctgttagatgaggatcaagctcctccttcctcccttttagttcataagcttattttccagtacgttgaagaaaaggaatcctggaagaagacatgtacaacccagcatcagttacccaagatgcttgaagaattctcactggtagtgcaccattgcagactccttggagaggagattgagtatttaaagagatggggaccaaattataacctaatgaacatagatattaataataatgaattgagacttttattctctagctccgcagcatttgcaaagtttgaaataactttgtttctctcagcctattatccatctgtaccattaccttccaccattcagaatcacgttgggaacactagccaagatgatattgctaccattctatctaaagtgccactggagaacaactacctgaagaatgtagtcaagcaaatttaccaagatctgtttcaggactgccatttctaccactagacccttggaccaccattggaacaaccaagcagaatgtacttgatattatttcagggtcccattgctgttcagcctttgtttttacgtcattacaagctgagtaaaattccttctgatgatgttatagttaatctgtatgttttttatatctctgcagaatgatggtgatgaagtctggatggtaggcctcatagcctactatcaacttactcatctttgtaccaaaggtttaagtaataggacacttaggaaaaatgtctcctaactaaactagtgctttctgctttagtacaagccctaaggattaacttaagtataagaagtgttatcactgacaagaacattagccattttcccataactagatagagctatgattttttaggttgcctggcttctgcctagcagatatttctggagtagaaatgtatctgtctacaaactattatcctttttctccgttactaaaatgctattaagagaaagtagggctgggagccaccacacccagcaatgttttcttaataagtatagtttttctagggaaagttaattcatttttgtctagtacatatatgtaaatatattaatgttgtttttgtgtttgtgatgtagtaaggagatgtacatagaaattcattgaggtatatagatactcatctgtctaggcagttcccaattttctgaagaatgttttctgatgccatacccttgtcatacatattattaaatgaccaatattatgtatgaagtagacaaaaaaatttactcaaacttcattcaaatcctaattgtgataatttttgttttatatttaattataaaccaaaatacatttgcatttttaagctaatttgtctcaaaattttgctttatatttttggatcaggttaaagtcctgtggatcccctgaatgttattgtccctcttgattggtttttacttctgagctatacgtcaaaagacacataagcttcaaaagtcaagacaaacctcatttgccataaaaatcaagatatagatgttctgttccgtaaactccttgaaaaacattttaaagtcatcaatatgatctgtttcccatgaaacttaagttagctttcttattggagttatttcttttctgtaagtctgaaaagtagagattttgttttacgcattttagtaacctgcaacaaccaactctaaaaaagatttggcttgtaatgacggtctctgcttttttgggtttggagtacacaattgtaatatttacttagttatttgtgtttttctttgttcaaggtattgactagtttcataaattttttgaaagtttttctttcattggttggaaagcagattacattttgcactattaaaataagtttattactttaaa

SEQ ID NO: 456634 - DNA, 1160 bp, Homo sapiens
ccgagtagctgggactacaggtgcccaccaccatgccgggctaattttttgtctttttagtagaaatggggtttcacgatgttggccaggatggtctcgatctcctgacctcgtgatccgcctgcctcggcttcaaagtgctgggattacaggtgtgagccaccacacccagcaatgttttcttaataagtatagtttttctagggaaagttaattcatttttgtctagtacatatatgtaaatatattaatgttgtttttgtgtttgtgatgtagtaaggagatgtacatagaaattcattgaggtatatagatactcatctgtctaggcagttcccaattttctgaagaatgttttacagcaaaattttctattttcttttattaaatagtgacacgtcaaacaatgtcacatccaaaacactagtttcatcaatttctagcagtaataatagacttgctgtaagtattgttttctgatgccatacccttgtcatacatattattaaatgaccaatattatgtatgaagtagacaaaaaaatttactcaaacttcattcaaatcctaattgtgataatttttgttttatatttaattataaaccaaaatacatttgcatttttaagctaatttgtctcaaaattttgctttatatttttggatcaggttaaagtcctgtggatcccctgaatgttattgtccctcttgattggtttttacttctgagctatacgtcaaaagacacataagcttcaaaagtcaagacaaacctcatttgccataaaaatcaagatatagatgttctgttccgtaaactccttgaaaaacattttaaagtcatcaatatgatctgtttcccatgaaacttaagttagctttcttattggagttatttcttttctgtaagtctgaaaagtagagattttgttttacgcattttagtaacctgcaacaaccaactctaaaaaagatttggcttgtaatgacggtctctgcttttttgggtttggagtacacaattgtaatatttacttagttatttgtgtttttctttgttcaaggtattgactagtttcataaattttttgaaagtttttctttcattggttggaaagcagattacattttgcactattaaaataagtttattactttaaa

SEQ ID NO: 456635 - DNA, 6786 bp, Homo sapiens
  misc_feature (3)..(3): n is a, c, g, or t
  misc_feature (4503)..(4503): n is a, c, g, or t
ggnagatttgaatacttcactgaggcgagccgggcgttgtgagcggactgctagaggcggctgtctgtttccgctctaaggaaactcagagcgtgtggaccccaaacaagtctgcgcaaaatttgtcgaggaggtttgccgcggcagaaaagttttcttcaaaaatggatggggtgtcttcagaggctaatgaagaaaatgacaatatagagagacctgttagaagacggcattcttcaatattgaaacccccaaggagtcctcttcaggacctcagaggtgggaatgaaacagttcaggaatccaatgctttgagaaataagaaaaactctcgtcgagtcagctttgcagatactataaaggtattccagacggagtctcatatgaaaatagtgagaaagtcagaaatggaagaaacagaagcaggagaaaatcttcttttgatacagaataagaaattagaagataattactgtgaaattactgggatgaacacattgctttctgctcccattcatacccagatgcaacagaaggagttttcaattatagaacatacccgtgaaaggaaacatgcaaatgaccagacagtcattttttcagatgaaaaccagatggacctgacatcaagtcacactgtaatgattaccaaaggccttttagataatcccataagtgaaaagtccaccaagatagataccacatcatttctagctaatttaaagcttcacaccgaggactcaagaatgaaaaaagaagtaaatttttccgtggatcaaaacacttcttcagaaaataaaatagatttcaatgacttcataaaaagattgaaaacaggaaaatgtagtgcttttcctgatgtgcctgataaagaaaattttgagatacctatttattccaaggaaccgaacagtgcctcttctacacatcaaatgcatgtatctcttaaggaagatgaaaataacagtaatattactaggctctttagagaaaaagatgatgggatgaatttcacccagtgtcatacagccaatattcagacattgattcccacatccagtgagaccaactcacgggaatctaaaggtaatgatattacaatttatggcaatgactttatggacttgacatttaaccacactttgcagatcttacctgcaacaggtaatttttctgaaatagaaaatcaaactcagaatgccatggatgtaacaacaggttatggaactaaagcttcaggaaataaaacagtttttaagagtaaacaaaatactgcttttcaagacctttccataaactctgcagacaaaatacatattaccagaagtcatattatgggggcagaaactcacatagtctcacagacttgtaatcaggatgccagaatattagccatgaccccagaatctatatattctaatccatctattcaaggttgtaagactgttttctattctagttgtaatgatgccatggaaatgaccaaatgtctctcaaatatgagagaggagaaaaatttgctaaagcatgacagtaattattctaaaatgtattgcaatccagatgctatgtcttctctcacagagaaaactatttattccggagaggagaacatggacattaccaagagtcatacagttgcaatagataatcaaatttttaaacaagatcaatcaaatgtgcaaatagcagctgcaccaacacccgaaaaagaaatgatgctccaaaatcttatgaccacatcagaagatgggaaaatgaatgtaaattgtaactcagttcctcatgtatctaaggaaagaatacagcagagcctgtcaaatcctttgtctatttcattgactgatagaaagactgaactcttatcaggtgaaaatacggatttgactgaaagtcacacaagtaacttaggaagtcaggttcctcttgcagcttataatctagcaccggagagtaccagtgaatctcactctcagagcaaaagctcttcagatgaatgtgaagaaattaccaaaagtcgtaatgaaccatttcagcgatcagacataatagccaaaaacagcttaaccgacacctggaacaaagacaaagattgggttttgaagattttgccctaccttgataaagattctcctcagtcagctgattgtaatcaggagatagcaacaagccataatatagtctactgtggtggagttcttgataaacaaataactaatagaaatacagtatcatgggaacaatctttgttttctaccacaaagccattattttcatcaggacagttctctatgaaaaatcatgatactgctataagtagtcatacagtgaaatctgtactaggccagaattctaaactggctgagccactgaggaaaagtttaagcaatcccacacctgactattgccatgacaagatgattatatgttcagaggaagagcaaaatatggatctaacaaagagccacactgtcgtcattggatttggtccttctgaactacaagaacttggtaaaactaatttagaacacactactggccagctaacaacaatgaacagacagatagctgtaaaagttgaaaaatgtggtaaaagtcccatagaaaaaagtggagtgcttaaatctaactgtattatggatgtgttagaggacgaaagtgtacagaaacctaaatttccaaaggaaaagcaaaatgtcaaaatttggggaaggaaaagtgttggtggaccaaaaattgataagactattgtattttcagaagacgataagaatgatatggatatcactaagagttatacaatagaaataaaccatagacctttattagagaaacgtgattgtcatttggtgccattggcaggaacttctgaaactattttatatacatgtgggcaggatgacatggagatcactagaagtcacacaactgccttagaatgtaaaactgtctcaccagatgaaataactactaggcctatggacaaaactgtagtgtttgtagataatcatgttgaactagaaatgacagagtcccatactgttttcattgactaccaagaaaaggaaagaacagacagacctaactttgaactatcccaaaggaaaagcctaggaacaccaacagtgatatgtactcctactgaggagagtgttttctttccaggaaatggtgaaagtgaccgtctagtagcaaatgacagccagctaacccctctggaggaatggtctaataataggggccctgtagaggtagctgataacatggaattgtctaaatcagccacttgcaaaaacatcaaagatgtacaaagtcctggatttctgaatgaacctctatcaagcaaaagtcagagaagaaaaagccttaagctaaaaaatgacaagaccattgtattttcagagaatcataaaaatgatatggatattacccagagttgtatggtggaaatagataacgaaagtgccctggaggataaagaggacttccatttggcaggggcttctaaaactattttgtattcatgtgggcaggatgacatggagatcactaggagtcacacaactgccttagaatgtaaaactctcctgccaaatgaaatagctattaggcccatggacaaaaccgtattgttcacagataattacagtgatctggaagtcaccgattcccatactgttttcattgactgtcaagccacagagaaaatacttgaagaaaaccctaaatttggaataggaaaaggaaaaaacttgggtgtttcctttcctaaggataatagctgtgttcaagaaatcgctgaaaaacaagcactggctgtaggaaacaaaatagttcttcacaccgagcaaaagcaacaactctttgctgctactaatagaactactaatgaaatcatcaaatttcatagtgctgctatggatgaaaaggtcataggggaagttgtagaccaggcctgtacattggaaaaagcgcaagttgaaagctgtcagttaaataatagagatagaagaaatgtggactttacaagtagtcatgcaactgctgtttgtggatccagtgataattattcctgtttaccaaatgttatttcctgtactgataatttggagggtagtgccatgctcttatgtgataaagatgaggaaaaagccaattattgcccagtgcaaaatgatcttgcttatgcaaatgattttgccagtgaatattacttggaatctgagggacagcctctctctgctccttgtcctttgttagagaaggaagaagttattcaaaccagtaccaaaggacagttagactgtgttataacactgcacaaagatcaagatctgattaaggatccacgaaatctattggctaatcaaactttagtatatagtcaagatctgggggagatgactaaacttaattcaaagcgagtatcttttaagcttccaaaggatcaaatgaaagtctatgttgatgacatttatgttattcctcagcctcatttctcanccgaccaacctccattacctaaaaaaggacagagtagtatcaataaagaagaagtaatactgtctaaagctggaaataagagtttaaatattatagaaaattcctctgcacccatatgtgaaaacaagcccaaaatactcaatagtgaggaatggtttgctgcagcctgtaaaaaagaactgaaggaaaatattcaaacaactaactataatacagctctagatttccacagtaactcagacgtaactaagcaagtcattcaaactcatgtcaatgctggagaagcaccagatcctgtaattacatctaatgttccatgttttcatagtatcaaaccaaatctgaataatttgaatggaaaaactggagagtttttagcctttcaaactgttcatctaccaccccttccagagcaattacttgaattaggaaataaggcacacaatgatatgcatatagtgcaagctacagaaatacataatattaacataatctccagcaatgctaaagatagtagagatgaggaaaataaaaagtctcataatggagctgaaaccacctctctaccgccaaagacagtttttaaagataaagtaaggagatgttctttgggaatctttttgcctagattgcccaacaagagaaattgtagtgtcactggtattgatgacctggaacagattccagcagacacaactgatataaatcacttagaaactcagccggtctctagcaaagattcaggcattggatctgttgcaggtaaactgaacctaagtccttctcaatatataaatgaggaaaatcttcctgtatatcctgatgagatcaattcttcagactctattaacatagaaactgaggaaaaggccttgattgagacataccaaaaagagatttcaccatatgaaaataaaatgggaaaaacttgcaatagccaaaaaagaacgtgggtacaagaagaagaagatattcataaggagaaaaaaatcagaaaaaatgagattaagtttagtgatacgacacaagatcgggagatttttgatcaccatactgaagaggatatagataaaagtgctaacagtgtattgataaaaaacctgagcaggaccccatctagttgcagcagctctctggattcaatcaaggctgatgggacctctctggacttcagcacttaccgcagtagtcaaatggaatcacagtttctcagagatactatttgtgaagagagcttgagggagaaactccaagatgggagaataacaataagggagttctttatacttctccaggtccacatcttgatacagaaaccccgacagagcaatctcccaggcaattttactgtaaacacaccacctactccagaagacctgatgttaagtcaatatgtttaccgacccaagatacagatttatagagaagattgtgaggctcgtcgccaaaagattgaagaattaaagctttctgcatcgaaccaagataagctgttggttgatataaataagaacctgtgggaaaaaatgagacactgctctgacaaagagctgaaggcctttggaatttatcttaacaaaataaagtcatgttttaccaagatgactaaagtcttcactcaccaaggaaaagtggctctgtatggcaagctggtgcagtcagctcagaatgagagggagaaacttcaaataaagatagatgagatggataaaatacttaagaagatcgataactgcctcactgagatggaaacagaaactaagaatttggaggatgaagagaaaaacaatcctgtggaagaatgggattctgaaatgagagctgcagaaaaagaattggaacagctgaaaactgaagaagaggagcttcaaagaaatctcttagaactggaggtacaaaaagagcagacccttgctcaaatagactttatgcaaaaacaaagaaatagaactgaagagctactggatcagttgagcttgtctgagtgggatgtcgttgagtggagtgatgatcaagctgtattcacctttgtttatgacacgatacaactcaccatcacctttgaagagtcagttgttggtttccctttcctggacaagcgttataggaagattgttgatgtcaattttcaatctctgttagatgaggatcaagctcctccttcctcccttttagttcataagcttattttccagtacgttgaagaaaaggaatcctggaagaagacatgtacaacccagcatcagttacccaaggtaaagcccgattgaagtatttaaagga

SEQ ID NO: 456636 - DNA, 1707 bp, Homo sapiens
  misc_feature (3)..(3): n is a, c, g, or t
ggnagatttgaatacttcactgaggcgagccgggcgttgtgagcggactgctagaggcggctgtctgtttccgctctaaggaaactcagagcgtgtggaccccaaacaagtctgcgcaaaatttgtcgaggaggtttgccgcggcagaaaagttttcttcaaaaatggatggggtgtcttcagaggctaatgaagaaaatgacaatatagagagacctgttagaagacggcattcttcaatattgaaacccccaaggagtcctcttcaggacctcagaggtgggaatgaaacagttcaggaatccaatgctttgagaaataagaaaaactctcgtcgagtcagctttgcagatactataaaggtattccagacggagtctcatatgaaaatagtgagaaagtcagaaatggaagaaacagaagcaggagaaaatcttcttttgatacagaataagaaattagaagataattactgtgaaattactgggatgaacacattgctttctgctcccattcatacccagatgcaacagaaggagttttcaattatagaacatacccgtgaaaggaaacatgcaaatgaccagacagtcattttttcagatgaaaaccagatggacctgacatcaagtcacactgtaatgattaccaaaggccttttagataatcccataagtgaaaagtccaccaagatagataccacatcatttctagctaatttaaagcttcacaccgaggactcaagaatgaaaaaagaagtaaatttttccgtggatcaaaacacttcttcagaaaataaaatagatttcaatgacttcataaaaagattgaaaacaggaaaatgtagtgcttttcctgatgtgcctgataaagaaaattttgagatacctatttattccaaggaaccgaacagtgcctcttctacacatcaaatgcatgtatctcttaaggaagatgaaaataacagtaatattactaggctctttagagaaaaagatgatgggatgaatttcacccagtgtcatacagccaatattcagacattgattcccacatccagtgagaccaactcacgggaatctaaaggtaatgatattacaatttatggcaatgactttatggacttgacatttaaccacactttgcagatcttacctgcaacaggtaatttttctgaaatagaaaatcaaactcagaatgccatggatgtaacaacaggttatggaactaaagcttcaggaaataaaacagtttttaagagtaaacaaaatactgcttttcaagacctttccataaactctgcagacaaaatacatattaccagaagtcatattatgggggcagaaactcacatagtctcacagacttgtaatcaggatgccagaatattagccatgaccccagaatctatatattctaatccatctattcaaggttgtaagactgttttctattctagttgtaatgatgccatggaaatgaccaaatgtctctcaaatatgagagaggagaaaaatttgctaaagcatgacagtaattattctaaaatgtattgcaatccagatgctatgtcttctctcacagagaaaactatttattccggagaggagaacatggacattaccaagagtcatacagttgcaatagataatcaaatttttaaacaagatcaatcaaatgtgcaaatagcagctgcaccaacacccg

SEQ ID NO: 456637 - DNA, 8490 bp, Homo sapiens
  misc_feature (3)..(3): n is a, c, g, or t
  misc_feature (4503)..(4503): n is a, c, g, or t
ggnagatttgaatacttcactgaggcgagccgggcgttgtgagcggactgctagaggcggctgtctgtttccgctctaaggaaactcagagcgtgtggaccccaaacaagtctgcgcaaaatttgtcgaggaggtttgccgcggcagaaaagttttcttcaaaaatggatggggtgtcttcagaggctaatgaagaaaatgacaatatagagagacctgttagaagacggcattcttcaatattgaaacccccaaggagtcctcttcaggacctcagaggtgggaatgaaacagttcaggaatccaatgctttgagaaataagaaaaactctcgtcgagtcagctttgcagatactataaaggtattccagacggagtctcatatgaaaatagtgagaaagtcagaaatggaagaaacagaagcaggagaaaatcttcttttgatacagaataagaaattagaagataattactgtgaaattactgggatgaacacattgctttctgctcccattcatacccagatgcaacagaaggagttttcaattatagaacatacccgtgaaaggaaacatgcaaatgaccagacagtcattttttcagatgaaaaccagatggacctgacatcaagtcacactgtaatgattaccaaaggccttttagataatcccataagtgaaaagtccaccaagatagataccacatcatttctagctaatttaaagcttcacaccgaggactcaagaatgaaaaaagaagtaaatttttccgtggatcaaaacacttcttcagaaaataaaatagatttcaatgacttcataaaaagattgaaaacaggaaaatgtagtgcttttcctgatgtgcctgataaagaaaattttgagatacctatttattccaaggaaccgaacagtgcctcttctacacatcaaatgcatgtatctcttaaggaagatgaaaataacagtaatattactaggctctttagagaaaaagatgatgggatgaatttcacccagtgtcatacagccaatattcagacattgattcccacatccagtgagaccaactcacgggaatctaaaggtaatgatattacaatttatggcaatgactttatggacttgacatttaaccacactttgcagatcttacctgcaacaggtaatttttctgaaatagaaaatcaaactcagaatgccatggatgtaacaacaggttatggaactaaagcttcaggaaataaaacagtttttaagagtaaacaaaatactgcttttcaagacctttccataaactctgcagacaaaatacatattaccagaagtcatattatgggggcagaaactcacatagtctcacagacttgtaatcaggatgccagaatattagccatgaccccagaatctatatattctaatccatctattcaaggttgtaagactgttttctattctagttgtaatgatgccatggaaatgaccaaatgtctctcaaatatgagagaggagaaaaatttgctaaagcatgacagtaattattctaaaatgtattgcaatccagatgctatgtcttctctcacagagaaaactatttattccggagaggagaacatggacattaccaagagtcatacagttgcaatagataatcaaatttttaaacaagatcaatcaaatgtgcaaatagcagctgcaccaacacccgaaaaagaaatgatgctccaaaatcttatgaccacatcagaagatgggaaaatgaatgtaaattgtaactcagttcctcatgtatctaaggaaagaatacagcagagcctgtcaaatcctttgtctatttcattgactgatagaaagactgaactcttatcaggtgaaaatacggatttgactgaaagtcacacaagtaacttaggaagtcaggttcctcttgcagcttataatctagcaccggagagtaccagtgaatctcactctcagagcaaaagctcttcagatgaatgtgaagaaattaccaaaagtcgtaatgaaccatttcagcgatcagacataatagccaaaaacagcttaaccgacacctggaacaaagacaaagattgggttttgaagattttgccctaccttgataaagattctcctcagtcagctgattgtaatcaggagatagcaacaagccataatatagtctactgtggtggagttcttgataaacaaataactaatagaaatacagtatcatgggaacaatctttgttttctaccacaaagccattattttcatcaggacagttctctatgaaaaatcatgatactgctataagtagtcatacagtgaaatctgtactaggccagaattctaaactggctgagccactgaggaaaagtttaagcaatcccacacctgactattgccatgacaagatgattatatgttcagaggaagagcaaaatatggatctaacaaagagccacactgtcgtcattggatttggtccttctgaactacaagaacttggtaaaactaatttagaacacactactggccagctaacaacaatgaacagacagatagctgtaaaagttgaaaaatgtggtaaaagtcccatagaaaaaagtggagtgcttaaatctaactgtattatggatgtgttagaggacgaaagtgtacagaaacctaaatttccaaaggaaaagcaaaatgtcaaaatttggggaaggaaaagtgttggtggaccaaaaattgataagactattgtattttcagaagacgataagaatgatatggatatcactaagagttatacaatagaaataaaccatagacctttattagagaaacgtgattgtcatttggtgccattggcaggaacttctgaaactattttatatacatgtgggcaggatgacatggagatcactagaagtcacacaactgccttagaatgtaaaactgtctcaccagatgaaataactactaggcctatggacaaaactgtagtgtttgtagataatcatgttgaactagaaatgacagagtcccatactgttttcattgactaccaagaaaaggaaagaacagacagacctaactttgaactatcccaaaggaaaagcctaggaacaccaacagtgatatgtactcctactgaggagagtgttttctttccaggaaatggtgaaagtgaccgtctagtagcaaatgacagccagctaacccctctggaggaatggtctaataataggggccctgtagaggtagctgataacatggaattgtctaaatcagccacttgcaaaaacatcaaagatgtacaaagtcctggatttctgaatgaacctctatcaagcaaaagtcagagaagaaaaagccttaagctaaaaaatgacaagaccattgtattttcagagaatcataaaaatgatatggatattacccagagttgtatggtggaaatagataacgaaagtgccctggaggataaagaggacttccatttggcaggggcttctaaaactattttgtattcatgtgggcaggatgacatggagatcactaggagtcacacaactgccttagaatgtaaaactctcctgccaaatgaaatagctattaggcccatggacaaaaccgtattgttcacagataattacagtgatctggaagtcaccgattcccatactgttttcattgactgtcaagccacagagaaaatacttgaagaaaaccctaaatttggaataggaaaaggaaaaaacttgggtgtttcctttcctaaggataatagctgtgttcaagaaatcgctgaaaaacaagcactggctgtaggaaacaaaatagttcttcacaccgagcaaaagcaacaactctttgctgctactaatagaactactaatgaaatcatcaaatttcatagtgctgctatggatgaaaaggtcataggggaagttgtagaccaggcctgtacattggaaaaagcgcaagttgaaagctgtcagttaaataatagagatagaagaaatgtggactttacaagtagtcatgcaactgctgtttgtggatccagtgataattattcctgtttaccaaatgttatttcctgtactgataatttggagggtagtgccatgctcttatgtgataaagatgaggaaaaagccaattattgcccagtgcaaaatgatcttgcttatgcaaatgattttgccagtgaatattacttggaatctgagggacagcctctctctgctccttgtcctttgttagagaaggaagaagttattcaaaccagtaccaaaggacagttagactgtgttataacactgcacaaagatcaagatctgattaaggatccacgaaatctattggctaatcaaactttagtatatagtcaagatctgggggagatgactaaacttaattcaaagcgagtatcttttaagcttccaaaggatcaaatgaaagtctatgttgatgacatttatgttattcctcagcctcatttctcanccgaccaacctccattacctaaaaaaggacagagtagtatcaataaagaagaagtaatactgtctaaagctggaaataagagtttaaatattatagaaaattcctctgcacccatatgtgaaaacaagcccaaaatactcaatagtgaggaatggtttgctgcagcctgtaaaaaagaactgaaggaaaatattcaaacaactaactataatacagctctagatttccacagtaactcagacgtaactaagcaagtcattcaaactcatgtcaatgctggagaagcaccagatcctgtaattacatctaatgttccatgttttcatagtatcaaaccaaatctgaataatttgaatggaaaaactggagagtttttagcctttcaaactgttcatctaccaccccttccagagcaattacttgaattaggaaataaggcacacaatgatatgcatatagtgcaagctacagaaatacataatattaacataatctccagcaatgctaaagatagtagagatgaggaaaataaaaagtctcataatggagctgaaaccacctctctaccgccaaagacagtttttaaagataaagtaaggagatgttctttgggaatctttttgcctagattgcccaacaagagaaattgtagtgtcactggtattgatgacctggaacagattccagcagacacaactgatataaatcacttagaaactcagccggtctctagcaaagattcaggcattggatctgttgcaggtaaactgaacctaagtccttctcaatatataaatgaggaaaatcttcctgtatatcctgatgagatcaattcttcagactctattaacatagaaactgaggaaaaggccttgattgagacataccaaaaagagatttcaccatatgaaaataaaatgggaaaaacttgcaatagccaaaaaagaacgtgggtacaagaagaagaagatattcataaggagaaaaaaatcagaaaaaatgagattaagtttagtgatacgacacaagatcgggagatttttgatcaccatactgaagaggatatagataaaagtgctaacagtgtattgataaaaaacctgagcaggaccccatctagttgcagcagctctctggattcaatcaaggctgatgggacctctctggacttcagcacttaccgcagtagtcaaatggaatcacagtttctcagagatactatttgtgaagagagcttgagggagaaactccaagatgggagaataacaataagggagttctttatacttctccaggtccacatcttgatacagaaaccccgacagagcaatctcccaggcaattttactgtaaacacaccacctactccagaagacctgatgttaagtcaatatgtttaccgacccaagatacagatttatagagaagattgtgaggctcgtcgccaaaagattgaagaattaaagctttctgcatcgaaccaagataagctgttggttgatataaataagaacctgtgggaaaaaatgagacactgctctgacaaagagctgaaggcctttggaatttatcttaacaaaataaagtcatgttttaccaagatgactaaagtcttcactcaccaaggaaaagtggctctgtatggcaagctggtgcagtcagctcagaatgagagggagaaacttcaaataaagatagatgagatggataaaatacttaagaagatcgataactgcctcactgagatggaaacagaaactaagaatttggaggatgaagagaaaaacaatcctgtggaagaatgggattctgaaatgagagctgcagaaaaagaattggaacagctgaaaactgaagaagaggagcttcaaagaaatctcttagaactggaggtacaaaaagagcagacccttgctcaaatagactttatgcaaaaacaaagaaatagaactgaagagctactggatcagttgagcttgtctgagtgggatgtcgttgagtggagtgatgatcaagctgtattcacctttgtttatgacacgatacaactcaccatcacctttgaagagtcagttgttggtttccctttcctggacaagcgttataggaagattgttgatgtcaattttcaatctctgttagatgaggatcaagctcctccttcctcccttttagttcataagcttattttccagtacgttgaagaaaaggaatcctggaagaagacatgtacaacccagcatcagttacccaagatgcttgaagaattctcactggtagtgcaccattgcagactccttggagaggagattgagtatttaaagagatggggaccaaattataacctaatgaacatagatattaataataatgaattgagacttttattctctagctccgcagcatttgcaaagtttgaaataactttgtttctctcagcctattatccatctgtaccattaccttccaccattcagaatcacgttgggaacactagccaagatgatattgctaccattctatctaaagtgccactggagaacaactacctgaagaatgtagtcaagcaaatttaccaagatctgtttcaggactgccatttctaccactagacccttggaccaccattggaacaaccaagcagaatgtacttgatattatttcagggtcccattgctgttcagcctttgtttttacgtcattacaagctgagtaaaattccttctgatgatgttatagttaatctgtatgttttttatatctctgcagaatgatggtgatgaagtctggatggtaggcctcatagcctactatcaacttactcatctttgtaccaaaggtttaagtaataggacacttaggaaaaatgtctcctaactaaactagtgctttctgctttagtacaagccctaaggattaacttaagtataagaagtgttatcactgacaagaacattagccattttcccataactagatagaggagccaccacacccagcaatgttttcttaataagtatagtttttctagggaaagttaattcatttttgtctagtacatatatgtaaatatattaatgttgtttttgtgtttgtgatgtagtaaggagatgtacatagaaattcattgaggtatatagatactcatctgtctaggcagttcccaattttctgaagaatgttttacagcaaaattttctattttcttttattaaatagtgacacgtcaaacaatgtcacatccaaaacactagtttcatcaatttctagcagtaataatagacttgctgtaagtattgttttctgatgccatacccttgtcatacatattattaaatgaccaatattatgtatgaagtagacaaaaaaatttactcaaacttcattcaaatcctaattgtgataatttttgttttatatttaattataaaccaaaatacatttgcatttttaagctaatttgtctcaaaattttgctttatatttttggatcaggttaaagtcctgtggatcccctgaatgttattgtccctcttgattggtttttacttctgagctatacgtcaaaagacacataagcttcaaaagtcaagacaaacctcatttgccataaaaatcaagatatagatgttctgttccgtaaactccttgaaaaacattttaaagtcatcaatatgatctgtttcccatgaaacttaagttagctttcttattggagttatttcttttctgtaagtctgaaaagtagagattttgttttacgcattttagtaacctgcaacaaccaactctaaaaaagatttggcttgtaatgacggtctctgcttttttgggtttggagtacacaattgtaatatttacttagttatttgtgtttttctttgttcaaggtattgactagtttcataaattttttgaaagtttttctttcattggttggaaagcagattacattttgcactattaaaataagtttattactttaaa

SEQ ID NO: 456638 - DNA, 1945 bp, Homo sapiens
  misc_feature (1443)..(1443): n is a, c, g, or t
atttaaagaaacacaggacagacactgctttccctacagagaccatgctctgggaggctcactctcaggtcagagtgagaggaaggggcctctcactgtgctgcctcggctgttgagctcacacttctccctgcgcctgctcgctcctccatcctgcctcattgctggcccaaggggcctttaggagtggcccctggtgactgtgcaccccactcccctataccccaagaggagcagccagagctgcctgcgtctcttctgggagggagaggaggtcaggtttgggggggcataggaaaccccgcgcacaccctgcctccttaccactgcaatgcctgctcaggacagaattccagagctgcccccacaaaacagactcttagtccggagctgctgacaggcagggaggcccctgggcctcagccttttccatagcagccacagctggtcctgtctccacccctagcttccactctggggtctatagccaggtttgtatgtgggggattcatgtatgcggtacgagtgcccctgaagatagacaagaaaacccttcttctggcaaagcagagggcactggggacccctcaagagggaaacattgctgtgtcagtctctgaaccaaaccgagggtcccagtagctgtgattcccggctctgagttctccctcctcactccttgctctcctcacccattgcggtttgggctggttctgcctccacaatgaccaggctgatgatggccccggcgctcaaactgcccctggtggagcctctctctgaccaccctgtcttctttgcccttttcctccccaggtggtagtcaactctccagccaagttagtatcaaaggacagcatgtgtgtgcgcttgcgtgccagccccagcatgtgtctgcgtgtgtctggcgtggatagagtgtgcctgctggcatgtgtacatgtatgtgcatatgtatgagtggggtacacttgtacccctgggtgagcctgcatgtgtgaagctggagtagaagcatttgggggtgggagtgggggctccatccgatggttctaatttcattcccaatttcctgctgcagcagctgcttaagatgtgcctggggttggtgacggtggcgggcgcagggggagggggacacaggctgtgctgctgctgggcctgtgtgagcctgaagacctttctgtcctggcgacccctcagaagggctgcactggatcttgtctgcccggggagcgcacctatccattggagggaagagcctcctgtgggtagaggatggccagctactcagcaaactggacttgagggggcctgggcagctggagccctgctctgaggaagaagcacattccctgaagcgtctggaagatcagagccctgggccaccaagggggtggcctgcaggaagagccccttcacggagaaaccttgctcagaatncctgcgggtgccagtggagccgcttttcgcctttggggcattctggactcagcttgggctgctgctcccgacccctacccccagccccatgcctgcgcttcccctgctgtgtgtagtgggagatctctctgtgcctggcagcccctgcagaccctgggagggagctcaggctgagccaggcactgcaggggagctgggaaagccaagatgggcaaggaaacccttctatggccaggagtggtggctcatgcctgtaatcccaacactgtgagatgccaaggcagaaggatcagcttgaggtcaggagttcaagaccaacctgggcaacatcgtgagactctgtctttacagaaaaaaaaaaaatagtggcatatgcctgtggtcctagctacctcaggaggctgaggtgagaggatcacttgagcccaagaggttgagactggagtgagtggagatcacaccactgcactccaccatgggcgacaaagcgagaccctgtatc

SEQ ID NO: 456639 - DNA, 812 bp, Homo sapiens
cgacatggagaaaccctgtctctactaaaaatacaaaatcagccgggtgtggtggtacatgcctgtaatcccagctactggggaggctgaggcaggagaattgcttgaacctgggaggcggacgtggtggtgagccggagatcacgccattgcactccagcctgggcaacaagagcgaaactccatctcgaaaaacaaaacaaaagtattttttgggttccctttatttcgttactctgttgattgaataactgatgttttgataaattgtaaatgcctacagaaaagggggctcttgttcttcttcaattgagtgaacatttgcatgtcctctgtatgagatatgagtcgtggtagaagcttttgattataaaagtgaataaggtttggttacatctgcttttaatgttgagataggtgtgtcaatacaggaaaacttgaacacagataagaccatggccgttaacagttagaggggttgacatgtggagagctagaagagcacaggaagtaagacaattatggggattcgagtgtgcattgtggagatgggactgggtctcgatcttgaagagtggatggatgggctttttatggtggaacctgaggacttgacagtctattggaggaagtcatgtgggcaatgggtggtggtgggaaatgaaggtgactttgaagaatgacagagtcatatccctggagcatcagatgagggagagagggagggagagtgagtttggtatgctcagggagtgaaggggacacttgtggacatgagagtggggatccactagtttagagcggctagtagt

SEQ ID NO: 456640 - DNA, 239 bp, Homo sapiens
tcccttatacgctgttgttgagaatgcagttgggcacatgatgaaggggcccggaattccggggagagctagaagagcacaggaagtaagacaattatggggattcgagtgtgcattgtggagatgggactgggtctcgatcttgaagagtggatggatgggcttttcctggataagtggtggattagttttgagaccaagctgaggtgtctgtcccagaggtggtgtttgagtgcgtg

SEQ ID NO: 456641 - DNA, 1121 bp, Homo sapiens
atatggaaatgtatatttatatcaaatttaaatttttagaatgatggtgctactatattctaattgttaatttgataattgtaattgtaatttgttaatttgttctaataatattttcatgacattattcatttgctgcttggcttgatggcataacaagtatgggttatttaccctgaaaaggaaacagtatcacccttccagaatctctatttacagctacagaagatgcaacacacctgtttctggaccacttccagatcagatgtgatgcatgctttagatcatttactttgatctaggaattactgtctggcatttcgtggtgtagggtaggtgtctccagcactgtataggtgtctggaattgagataagaatcaatttcaatacaaaatacattttttgcttaaagcacgcaaggattctatgaattcaggtaaattcacagggtggaaaacaggaactaatgttatatattcctgtagttatcttcataatgaagcagaaagaaaaacaaaaaagttacaaaaataaatgaaaagaactgtattttctagaattgaaaaataattcttttagatgatagataagatgtttacatcaacctgcaaaaagtcaatgttgaagaggtctcattgtatctcacagaattttgatttgcctactcacccacaggagacatttctgggacagtagcaacataaggtccatcccaaaactttggctcattatcattaatatcctgcactttgatgatgaattctgattcaggctccaggggctttctggtttctatgtccacagcctgagcacgaagagtgtagaaaggtttttcttctctatctaggctccttattgcatgaatgtcccctgtggtttcatcaatggtaaaaacggtgccagcgccatctcctgagagggtgtatttcgcagtgccctctcccttgtctaagtcggaatggagctttagggaagagagggagagagagaggaagagaaagagaaggacaaagaaagaacaccattaaaaggaagttgccaaattaaaaagtcataatttgcaatacaattcctttaatcaaaaatgttaaataaaaatcttatggttctgttaaattgt

SEQ ID NO: 456642 - DNA, 775 bp, Homo sapiens
agagttctataaatgatggctgtagaaataggcactgtccaggcagttgttttgtggaagtagtgttgttattttctggtgttttccaagtcatctcagatggtgcgtgaaaatgagatgccaaagaaggcttaaaaaagataccctgcaccagcttcagaatgtaagcaaatctttcattccagcgcttaaaagttttgagaaagctaatctaaagttaaatgtttactagcatctctccgattatattttagaaactactgcacaaaaataaaacaaatttcttattttctctgggttgaaaagtgcacataaaatggaaaatgctttttataccactatttccagcagggattttattttcatttgtcatttgccagcctggggtatgttgggagaaggaacaattgatttttgaaaaggtgcatttgtgtgaaaaccaaaaattgtgttcaacaaatactactactaacccatatgtggatatatgtgttttatacatgagtaaaaaaaaaaaaaaaaacatacatatatgtatggcatatatatatatatatatatatatatatatatatatatatatgctatagaaatgccatcaagttaccagtttacttctaaatgtaactgcttaatataaaatatgcatctttttgtagtacctaattcttgcaattcagtgtatttcctggcgagaggcagagatgaacaaccctggacagttaccacatatggctcttatgaggtaatgaggatggttgtgatgagaagggta

SEQ ID NO: 456643 - DNA, 478 bp, Homo sapiens
caatgtttttctcagaggcaaaattaacatggttgacagtttaattgacatatttctttttcgttgtgtgcctttgccaattaaacaaattgcaccctattttgatgttcattttgttaattatttgtaaaactgtagactctgattttttttttttttaattttcaggtgtcagtttcttggtcgggaatgaaaatagtgccaacctgtgataccttcactctaattttactttctgaggaagttttctgtaatagttatttggtgataattattaatactggtgagttttaaaatttttgctttcagcaattttccatttttttcaacatacttatatcgcaatgaggcaaccaaatatgaatcctgagaatgaagatggaaaatgaatattttaatccaatatcgagttgttctttcaacatttttagttttagttttaatcgaaaatataaagttacataattgtgtgaggaat

SEQ ID NO: 456644 - DNA, 372 bp, Homo sapiens
ttaaaaaatatttgatatattcacatttcttaattgcagtatagacaaaatgacctacgaatcaagcattttgttccacggtctctactgttagctgtatgtctcagaaacagcttctttctcaagagagaacaagagggataatgctggatctaaaggcatcatctgaagaagacaaagatatcaacaatcgcaactatttggctttctgtccatcactgagacttttcataatcttcccttcataaataggatctcttgatcagaacagaaaagttgagtcttaaatttcctgtatttatttctgactgatactgagggaagtgcaaatttggttgctatgattaaactccttgattgttcttaatggga

SEQ ID NO: 456645 - DNA, 98 bp, Homo sapiens
ggtatattaaaaaaaagacctttggttattctggctgccaccaattgctttcttgtttcagctgaattttgaagtagctaatcatattttggcatttt

SEQ ID NO: 456646 - DNA, 1585 bp, Homo sapiens
ttgtgaccaactccacctacgcagcagacaaggtgctctgtatgtggatgtgatccgtgtgaacagctactactcttggtatcgcaactacggcacctgggagttgattcagctgcagctgaccgcccagtttgagaattggtgtaagacatcacaatcccattattcagagcgcgtatggagtggaaacgcttgtaaggcttcaccaggatccacctctgatgttcagtgaagaggaccggaaaagtctgctagagcagtaccatctgggtctggatcaaaaacgcagaaaatacgtggttggagagctcatctggaattttgccgatttcatgactaaccagtccaaggatgaaggaaaaactggacctcattatggatttacttttgggatacactcattattccagaggagggtaaaaggctgagaagcttaagatggagctggcttgaaatcctcttgtttatggcagtacatatcggttatgattcaaaaaatatagcccatttccaaaaacctgcaacaaagagatactttctcaggtgtcagtttcttggtcgggaatgaaaatagtgccaacctgtgataccttcactctaattttactttctgaggaagttttctgtaatagttatttggtgataattattaatactggtgagaaaatcaatgtaaaagaggagaaataacccacacaaccacatacaactaggaaatgatagatggatctgaaaaaaaggatatgcactcttaacaagttcaacacccaagtactattgcaagtaccagctgtatttcatggaaaaaaaaaaaagaataactcaaaaggcagaacgaagagcctagaggtcagagatgagaggcatgaataattattcacaggcgttgaatataatcaaatgacttgcaacatttaccactgggattttaaaatgtggtggaccaatcattcttttagtctgtgcattttcccatttttttcaacaggaatgtctagagacattattcctgttttgccactgtatttttggtgaatgtgtagtaagtaactggcctctttagtatcacaaagctggatgaagaaaatgtggtacatatacaccatgaaatactatgccgccacaaaaaggaaatgagatcatgtcctctgcagggacatggatgaagctggaagccattatccttagcaaagtaacgcaggaacagaaaaccaaacaccacatgttgtctcttagaagtgggagctgaacgtatagacaaaatgacctacgaatcaagcattttgttccacggtctctactgttagctgtatgtctcagaaacagcttctttctcaagagagaacaagagggataatgctggatctaaaggcatcatctgaagaagacaaagatatcaacaatcgcaactatttggctttctgtccatcactgagacttttcataatcttcccttcataaataggatctcttgatcagaacagaaaagttgagtcttaaatttcctgtatttatttctgactgatactgagggaagtgcaaatttggttgctatgattaaactccttgattgttcttaatggga

SEQ ID NO: 456647 - DNA, 1030 bp, Homo sapiens
tgactgcacttccccagggattgtggcaaatggtaaatatatattttctccttgctacttgcaataaccctgctcataaagtgttactattattcacttgcaggtgagaaaatcaatgtaaaagaggagaaataacccacacaaccacatacaactaggaaatgatagatggatctgaaaaaaaggatatgcactcttaacaagttcaacacccaagtactattgcaagtaccagctgtatttcatggaaaaaaaaaaaagaataactcaaaaggcagaacgaagagcctagaggtcagagatgagaggcatgaataattattcacaggcgttgaatataatcaaatgacttgcaacatttaccactgggattttaaaatgtggtggaccaatcattcttttagtctgtgcattttcccatttttttcaacaggaatgtctagagacattattcctgttttgccactgtatttttggtgaatgtgtagtaagtaactggcctctttagtatcacaaagctggatgaagaaaatgtggtacatatacaccatgaaatactatgccgccacaaaaaggaaatgagatcatgtcctctgcagggacatggatgaagctggaagccattatccttagcaaagtaacgcaggaacagaaaaccaaacaccacatgttgtctcttagaagtgggagctgaacgtatagacaaaatgacctacgaatcaagcattttgttccacggtctctactgttagctgtatgtctcagaaacagcttctttctcaagagagaacaagagggataatgctggatctaaaggcatcatctgaagaagacaaagatatcaacaatcgcaactatttggctttctgtccatcactgagacttttcataatcttcccttcataaataggatctcttgatcagaacagaaaagttgagtcttaaatttcctgtatttatttctgactgatactgagggaagtgcaaatttggttgctatgattaaactccttgattgttcttaatggga

SEQ ID NO: 456648 - DNA, 1136 bp, Homo sapiens
ctgcccacacagccataacatcctatggccctgaaaatagttctgccaagctgcgtgcagtggacacttcacggctggcacaggagagatcacaaggccttgctcaatttcatcaaaagtgttaaagcgactcagcagattgtgaagcacaagtggaagctgataattggtgtttcttacaaatcaacggcttgtctccacacatcaaggtgagaaaatcaatgtaaaagaggagaaataacccacacaaccacatacaactaggaaatgatagatggatctgaaaaaaaggatatgcactcttaacaagttcaacacccaagtactattgcaagtaccagctgtatttcatggaaaaaaaaaaaagaataactcaaaaggcagaacgaagagcctagaggtcagagatgagaggcatgaataattattcacaggcgttgaatataatcaaatgacttgcaacatttaccactgggattttaaaatgtggtggaccaatcattcttttagtctgtgcattttcccatttttttcaacaggaatgtctagagacattattcctgttttgccactgtatttttggtgaatgtgtagtaagtaactggcctctttagtatcacaaagctggatgaagaaaatgtggtacatatacaccatgaaatactatgccgccacaaaaaggaaatgagatcatgtcctctgcagggacatggatgaagctggaagccattatccttagcaaagtaacgcaggaacagaaaaccaaacaccacatgttgtctcttagaagtgggagctgaacgtatagacaaaatgacctacgaatcaagcattttgttccacggtctctactgttagctgtatgtctcagaaacagcttctttctcaagagagaacaagagggataatgctggatctaaaggcatcatctgaagaagacaaagatatcaacaatcgcaactatttggctttctgtccatcactgagacttttcataatcttcccttcataaataggatctcttgatcagaacagaaaagttgagtcttaaatttcctgtatttatttctgactgatactgagggaagtgcaaatttggttgctatgattaaactccttgattgttcttaatggga

SEQ ID NO: 456649 - DNA, 1170 bp, Homo sapiens
ttgtgaccaactccacctacgcagcagacaaggtgctctgtatgtggatgtgatccgtgtgaacagctactactcttggtatcgcaactacggcacctgggagttgattcagctgcagctgaccgcccagtttgagaattggtgtaagacatcacaatcccattattcagagcgcgtatggagtggaaacgcttgtaaggcttcaccaggatccacctctgatgttcagtgaagaggaccggaaaagtctgctagagcagtaccatctgggtctggatcaaaaacgcagaaaatacgtggttggagagctcatctggaattttgccgatttcatgactaaccagtgtgtcagtttcttggtcgggaatgaaaatagtgccaacctgtgataccttcactctaattttactttctgaggaagttttctgtaatagttatttggtgataattattaatactggtgagaaaatcaatgtaaaagaggagaaataacccacacaaccacatacaactaggaaatgatagatggatctgaaaaaaaggatatgcactcttaacaagttcaacacccaagtactattgcaagtaccagctgtatttcatggaaaaaaaaaaaagaataactcaaaaggcagaacgaagagcctagaggtcagagatgagaggcatgaataattattcacaggcgttgaatataatcaaatgacttgcaacatttaccactgggattttaaaatgtggtggaccaatcattcttttagtctgtgcattttcccatttttttcaacaggaatgtctagagacattattcctgttttgccactgtatttttggtgaatgtgtagtaagtaactggcctctttagtatcacaaagctggatgaagaaaatgtggtacatatacaccatgaaatactatgccgccacaaaaaggaaatgagatcatgtcctctgcagggacatggatgaagctggaagccattatccttagcaaagtaacgcaggaacagaaaaccaaacaccacatgttgtctcttagaagtgggagctgaacgtacctaattcttgcaattcagtgtatttcctggcgagaggcagagatgaacaaccctggacagttaccacatatggctcttatgaggtaatgaggatggttgtgatgagaagggta

SEQ ID NO: 456650 - DNA, 380 bp, Homo sapiens
ggtatattaaaaaaaagacctttggttattctggctgccaccaattgctttcttgtttcagctgaattttgaagtagctaatcatattttggcattttcttgtcatcaaagcatttcgtgaaattatcccattacaatgtttttctcagaggcaaaattaacatggttgacagtttaattgacatatttctttttcgttgtgtgcctttgccaattaaacaaattgcaccctattttgatgttcattttgttaattatttgtaaaactgtagactctgattttttttttttttaattttcaggtgtcagtttcttggtcgggaatgaaaatagtgccaacctgtgataccttcactctaattttactttctgaggaagtt

SEQ ID NO: 456651 - DNA, 1387 bp, Homo sapiens
ttgtgaccaactccacctacgcagcagacaaggtgctctgtatgtggatgtgatccgtgtgaacagctactactcttggtatcgcaactacggcacctgggagttgattcagctgcagctgaccgcccagtttgagaattggtgtaagacatcacaatcccattattcagagcgcgtatggagtggaaacgcttgtaaggcttcaccaggatccacctctgatgttcagtgaagaggaccggaaaagtctgctagagcagtaccatctgggtctggatcaaaaacgcagaaaatacgtggttggagagctcatctggaattttgccgatttcatgactaaccagtgtgtcagtttcttggtcgggaatgaaaatagtgccaacctgtgataccttcactctaattttactttctgaggaagttttctgtaatagttatttggtgataattattaatactggtgagaaaatcaatgtaaaagaggagaaataacccacacaaccacatacaactaggaaatgatagatggatctgaaaaaaaggatatgcactcttaacaagttcaacacccaagtactattgcaagtaccagctgtatttcatggaaaaaaaaaaaagaataactcaaaaggcagaacgaagagcctagaggtcagagatgagaggcatgaataattattcacaggcgttgaatataatcaaatgacttgcaacatttaccactgggattttaaaatgtggtggaccaatcattcttttagtctgtgcattttcccatttttttcaacaggaatgtctagagacattattcctgttttgccactgtatttttggtgaatgtgtagtaagtaactggcctctttagtatcacaaagctggatgaagaaaatgtggtacatatacaccatgaaatactatgccgccacaaaaaggaaatgagatcatgtcctctgcagggacatggatgaagctggaagccattatccttagcaaagtaacgcaggaacagaaaaccaaacaccacatgttgtctcttagaagtgggagctgaacgtatagacaaaatgacctacgaatcaagcattttgttccacggtctctactgttagctgtatgtctcagaaacagcttctttctcaagagagaacaagagggataatgctggatctaaaggcatcatctgaagaagacaaagatatcaacaatcgcaactatttggctttctgtccatcactgagacttttcataatcttcccttcataaataggatctcttgatcagaacagaaaagttgagtcttaaatttcctgtatttatttctgactgatactgagggaagtgcaaatttggttgctatgattaaactccttgattgttcttaatggga

SEQ ID NO: 456652 - DNA, 1611 bp, Homo sapiens
ttgtgaccaactccacctacgcagcagacaaggtgctctgtatgtggatgtgatccgtgtgaacagctactactcttggtatcgcaactacggcacctgggagttgattcagctgcagctgaccgcccagtttgagaattggtgtaagacatcacaatcccattattcagagcgcgtatggagtggaaacgcttgtaaggcttcaccaggatccacctctgatgttcagtgaagaggaccggaaaagtctgctagagcagtaccatctgggtctggatcaaaaacgcagaaaatacgtggttggagagctcatctggaattttgccgatttcatgactaaccagtccaaggatgaaggaaaaactggacctcattatggatttacttttgggatacactcattattccagaggagggtaaaaggctgagaagcttaagtaataaataaaataattttcgaccagatggagctggcttgaaatcctcttgtttatggcagtacatatcggttatgattcaaaaaatatagcccatttccaaaaacctgcaacaaagagatactttctcaggtgtcagtttcttggtcgggaatgaaaatagtgccaacctgtgataccttcactctaattttactttctgaggaagttttctgtaatagttatttggtgataattattaatactggtgagaaaatcaatgtaaaagaggagaaataacccacacaaccacatacaactaggaaatgatagatggatctgaaaaaaaggatatgcactcttaacaagttcaacacccaagtactattgcaagtaccagctgtatttcatggaaaaaaaaaaaagaataactcaaaaggcagaacgaagagcctagaggtcagagatgagaggcatgaataattattcacaggcgttgaatataatcaaatgacttgcaacatttaccactgggattttaaaatgtggtggaccaatcattcttttagtctgtgcattttcccatttttttcaacaggaatgtctagagacattattcctgttttgccactgtatttttggtgaatgtgtagtaagtaactggcctctttagtatcacaaagctggatgaagaaaatgtggtacatatacaccatgaaatactatgccgccacaaaaaggaaatgagatcatgtcctctgcagggacatggatgaagctggaagccattatccttagcaaagtaacgcaggaacagaaaaccaaacaccacatgttgtctcttagaagtgggagctgaacgtatagacaaaatgacctacgaatcaagcattttgttccacggtctctactgttagctgtatgtctcagaaacagcttctttctcaagagagaacaagagggataatgctggatctaaaggcatcatctgaagaagacaaagatatcaacaatcgcaactatttggctttctgtccatcactgagacttttcataatcttcccttcataaataggatctcttgatcagaacagaaaagttgagtcttaaatttcctgtatttatttctgactgatactgagggaagtgcaaatttggttgctatgattaaactccttgattgttcttaatggga

SEQ ID NO: 456653 - DNA, 1327 bp, Homo sapiens
ttgtgaccaactccacctacgcagcagacaaggtgctctgtatgtggatgtgatccgtgtgaacagctactactcttggtatcgcaactacggcacctgggagttgattcagctgcagctgaccgcccagtttgagaattggtgtaagacatcacaatcccattattcagagcgcgtatggagtggaaacgcttgtaaggcttcaccaggatccacctctgatgttcagtgaagaggaccggaaaagtctgctagagcagtaccatctgggtctggatcaaaaacgcagaaaatacgtggttggagagctcatctggaattttgccgatttcatgactaaccagtgtgtcagtttcttggtcgggaatgaaaatagtgccaacctgtgataccttcactctaattttactttctgaggaagttttctgtaatagttatttggtgataattattaatactggtgagaaaatcaatgtaaaagaggagaaataacccacacaaccacatacaactaggaaatgatagatggatctgaaaaaaaggatatgcactcttaacaagttcaacacccaagtactattgcaagtaccagctgtatttcatggaaaaaaaaaaaagaataactcaaaaggcagaacgaagagcctagaggtcagagatgagaggcatgaataattattcacaggcgttgaatataatcaaatgacttgcaacatttaccactgggattttaaaatgtggtggaccaatcattcttttagtctgtgcattttcccatttttttcaacaggaatgtctagagacattattcctgttttgccactgtatttttggtgaatgtgtagtaagtaactggcctctttagtatcacaaagctggatgaagaaaatgtggtacatatacaccatgaaatactatgccgccacaaaaaggaaatgagatcatgtcctctgcagggacatggatgaagctggaagccattatccttagcaaagtaacgcaggaacagaaaaccaaacaccacatgttgtctcttagaagtgggagctgaacggctccttattgcatgaatgtcccctgtggtttcatcaatggtaaaaacggtgccagcgccatctcctgagagggtgtatttcgcagtgccctctcccttgtctaagtcggaatggagctttagggaagagagggagagagagaggaagagaaagagaaggacaaagaaagaacaccattaaaaggaagttgccaaattaaaaagtcataatttgcaatacaattcctttaatcaaaaatgttaaataaaaatcttatggttctgttaaattgt

SEQ ID NO: 456654 - DNA, 3680 bp, Homo sapiens
aaaataattgtaatatgctaacaccaattgtatcttaaaaagaggtactggaaattccatcttgcattcttccgttttttcctgttatagaaaaacgcactccctgatactcagtagaggatcaacttatttctagttaatcagcatgaacgtttccagcagaatagatgctttggtgtagcacttgcctgggagtcatggttagcattccgcattttttagagagctgaattcagcagcctaggaaacattaggaagaacaccttcaaacagggaacaacgtcttgggggaagagagtcactgcctccgctagggatcccgagggggtacaaaagcaacaacaacaaaaactcgtggagagtaggctccacgacatgcgcatgcgacgaactcccgcactcagcggggcaggtttcgtccttcatcttctcagtcggcaggacctgcttctcgctgaggatgagtgaggacagccgcagctcggcggggacggcccgttagcctagagcgccggcacccgagtcccgccgccggagccgcgcctggagccgcggtgggggaggggcagcggcggcccgcgctgcgtcgagcttcccagaattcccagcggccgcggggaaagtttacgggatgtaggcggcggcggcggtagtggtagcggttattcggcggcccgcggcggaccatggccctggcccggcgtcgctgggctttcctcacggcgtccccgagcagcgtcgcagagcgggccgacttccgggaaggaactgaccagcgactgagcggcggccggcgcgcttagcgccctgaacatgcggcagtccctgcgggcgaccccgggctccggacaggcggcggcggaggcggcggctcgggagggaaggaggcggcggcgccggcggaggtggcggcggagacggccggcgcccggcgcggagccctagggaggcagttcagcgcggcctcgggcctcgtcgagaaggatgctgtcccgaaagaaaaccaaaaacgaagtgtccaagccggccgaggtgcaggggaagtacgtgaagaaggagacgtcgcctctgcttcggaatcttatgccttcattcatccggcatggtccaacaattccaagacgaactgatatctgtcttccagattcaagccctaatgccttttcaacttctggagatgtagtttcaagaaaccagagtttccttagaactccaattcaaagaacacctcatgaaataatgagaagagaaagcaacagattatctgcaccttcttatcttgccagaagtctagcagatgtccctagagagtatggttcttctcagtcatttgtaacggaagttagttttgctgttgaaaatggagactctggttcccgatattattattcagacaatttttttgatggtcagagaaagcggccacttggagatcgtgcacatgaagactacagatattatgaatacaaccatgatctcttccaaagaatgccacagaatcaggggaggcatgcttcaggtattgggagagttgctgctacatctttaggaaatttgactaaccatggttctgaagatttaccccttcctcctggctggtctgtggactggacaatgagagggagaaaatattatatagatcataacacaaatacaactcactggagccatcctcttgagcgagaaggacttcctcctggatgggaacgagttgagtcatccgaatttggaacctattatgtagatcacacaaataagaaggcccaatacaggcatccctgtgctcctagtgtacctcggtatgatcaaccacctcctgtcacataccagccacagcaaactgaaagaaatcagtcccttctggtacctgcaaatccatatcatactgcagaaattcctgactggcttcaggtttacgcacgagcccctgtgaaatatgaccacattctgaagtgggaactcttccagctggctgacctggatacataccagggaatgctaaagttgctcttcatgaaagaattggagcagattgttaaaatgtatgaagcatacagacaagcccttcttacagagttggaaaaccgaaagcagagacagcagtggtatgcccaacaacatggaaaaaatttttgagctgattttttaaaaatttaagttttgtaagagctttaaaatattttcacagataaaaaattgcaaacaagtactctggttaataaatgctgcttcctttgtggaaattataaaattctaactttacatgtattttgttattagaaattttcttttattgaatgagaaaaattagtctatcattttaagagccaatatggcaaacactttcaaatactgtatattaggaaactgttttggtattcttgatggaaaaaaatgcagcggaaatgtcattatgaacagatgttaaataggaaattattacttgttaacttcttacagcagtagtaccttctttaaaaaaaaaaaagaatctgcggtatttttttaaaaaaaaagtttactgctgtagtgtgaaatattgtctggaaagggatggtttaaatattaccatgatgtagttgaaatataaaataggatttggaaccttattgtgataaatatttatatatgatgtatgtttgtctcccctctccaaagtaaggaacccagctgggcgtggtggctcactcctgtaatcccagcattttgggaggccgaggtgggtggaccgcttgagtccacgagtttaagaccagcctgggcaacatggtgaagccccatctctacaaaaaatacaaaaaaattagccgggtatgatggtgtgtgcctctagtcccagctacttgggaggctgaggtcagaggatggcttgagcccaagaggcagaggttgcagggtcaagatcgcaccacttgcactgcagcctgagagagagagagccagaccttgtctcaaaaaataaaaaataaaaaaataaaaacaaaataaggaatccttttaaagcatgttgagaaagtattttttggtatgaatgggtgacgggccttttaatctttcaggaatacatataagcaggaatacttagcctgtattgggaaggtgcgtgaaactcaaagttgctaacatcatcttccttattttcagccagtgctgttactgcatttagcatggctctgacgaggcagtggagagttcctgacagcatagcatactgccttctgacagactgggttaagctaccaaaaatgacaaccagggattcaaaaaaaatttttggtcattaaatcgaatgtatattattactttttaattttctaagtatttatcacaggactttaacaccatatatttccctcccagtttttctccccttttggtttaatagttaaaacatttttcataattagtgctgtacatttgattgcaaacaaattggtgatacttctaaactataactataaatctctagaattctgtgaatttcaacattatttgaagtagttcttcagttatatttacatgtgttgtaaatatgtaaatatacttttagcttaggaagtcttccagaatacaaactactcccagttagatatcagtgagtttgaataactgaagaaatgttgacaatgttaagtgtttgattttatataacaagcttattaaatatatttttgtggaaa

SEQ ID NO: 456655 - DNA, 1256 bp, Homo sapiens
  misc_feature (138)..(138): n is a, c, g, or t
gtattgctatcatcccgtgccacattttcctcgcgccacatatggcgcggttgctccccctatagccggctaagttttattgtgcctggggcttatattctcgttggattgtgggttcgcctgagatggtgccccccncgcaaacgtgttggggtgtcctttccacacaatgtatccccccactatgcctgttgttccccacgcacggctttttgttaacgcgcgccgcctttcttctgttattatactgctcctctttatggggccccctttgttacacgaaagacctggtgattcttaaatttggggccccccccggggggattcttttgcgccccccccccttttgttttttttttttttttttttttttttttttttttgtttttttttttgtttttgtttttgttttttactttttgagttggaatctcactctctcgctcaggctggaatgcagtggtggcacgatcttggctcactgcaacctcctcccaggttcaagctattctcttgcctcagcctccccagtggctgggactacaggtgcctgccaccacacctggctaattttttgtatttttagtagagatggggcctcaccatgttagccaggctggtctcgaactcctgacctaacgtgatccgcccacctcagtctcccaaagtgctgggattacaggcgtgagccaccgcgcctggccttgattttcttatggcattacgtctgtatggtaccatcttcagatctgtgaatgtatattggtgcaacatagtattgttttccattatattctgattctaaggcattcaatttaattctaattctcttatattttttcttaagctttgatttacaaagttgaaatttgcttttgcttttttaatgaacttgcttactgaattttgcataaaataacttcttattgacttgtaaatagtaaatggtatttgattcgaggacataatccaattatatgccacagtagaaactgaggaaagaattatctctatagttgttcaagatcagctttgcttcctgaagataatgacctaaatgattccagagtggtaatttttcttagtgtaacagatgattccttcgtggatgcctagagtcttttctgagatatgtagtgttgcacatgtgcggtaggagaaatgaacactaatttacaggtcaggcctgaggtctgccaagaaagaatacatactggcctgggccctgcttaaagtggtatgtattactgtcagtc

SEQ ID NO: 456656 - DNA, 3623 bp, Homo sapiens
aaaataattgtaatatgctaacaccaattgtatcttaaaaagaggtactggaaattccatcttgcattcttccgttttttcctgttatagaaaaacgcactccctgatactcagtagaggatcaacttatttctagttaatcagcatgaacgtttccagcagaatagatgctttggtgtagcacttgcctgggagtcatggttagcattccgcattttttagagagctgaattcagcagcctaggaaacattaggaagaacaccttcaaacagggaacaacgtcttgggggaagagagtcactgcctccgctagggatcccgagggggtacaaaagcaacaacaacaaaaactcgtggagagtaggctccacgacatgcgcatgcgacgaactcccgcactcagcggggcaggtttcgtccttcatcttctcagtcggcaggacctgcttctcgctgaggatgagtgaggacagccgcagctcggcggggacggcccgttagcctagagcgccggcacccgagtcccgccgccggagccgcgcctggagccgcggtgggggaggggcagcggcggcccgcgctgcgtcgagcttcccagaattcccagcggccgcggggaaagtttacgggatgtaggcggcggcggcggtagtggtagcggttattcggcggcccgcggcggaccatggccctggcccggcgtcgctgggctttcctcacggcgtccccgagcagcgtcgcagagcgggccgacttccgggaaggaactgaccagcgactgagcggcggccggcgcgcttagcgccctgaacatgcggcagtccctgcgggcgaccccgggctccggacaggcggcggcggaggcggcggctcgggagggaaggaggcggcggcgccggcggaggtggcggcggagacggccggcgcccggcgcggagccctagggaggcagttcagcgcggcctcgggcctcgtcgagaaggatgctgtcccgaaagaaaaccaaaaacgaagtgtccaagccggccgaggtgcaggggaagtacgtgaagaaggagacgtcgcctctgcttcggaatcttatgccttcattcatccggcatggtccaacaattccaagacgaactgatatctgtcttccagattcaagccctaatgccttttcaacttctggagatgtagtttcaagaaaccagagtttccttagaactccaattcaaagaacacctcatgaaataatgagaagagaaagcaacagattatctgcaccttcttatcttgccagaagtctagcagatgtccctagagagtatggttcttctcagtcatttgtaacggaagttagttttgctgttgaaaatggagactctggttcccgatattattattcagacaatttttttgatggtcagagaaagcggccacttggagatcgtgcacatgaagactacagatattatgaatacaaccatgatctcttccaaagaatgccacagaatcaggggaggcatgcttcaggtattgggagagttgctgctacatctttaggaaatttgactaaccatggttctgaagatttaccccttcctcctggctggtctgtggactggacaatgagagggagaaaatattatatagatcataacacaaatacaactcactggagccatcctcttgagcgagaaggacttcctcctggatgggaacgagttgagtcatccgaatttggaacctattatgtagatcacacaaataagaaggcccaatacaggcatccctgtgctcctagtgtacctcggtatgatcaaccacctcctgtcacataccagccacagcaaactgaaagaaatcagtcccttctggtacctgcaaatccatatcatactgcagaaattcctgactggcttcaggtttacgcacgagcccctgtgaaatatgaccacattctgaagtgggaactcttccagctggctgacctggatacataccagggaatgctaaagttgctcttcatgaaagaattggagcagattgttaaaatgtatgaagcatacagacaagcccttcttacagagttggaaaaccgaaagcagagacagcagtggtatgcccaacaacatggaaaaaatttttgagctgattttttaaaaatttaagttttgtaagagctttaaaatattttcacagataaaaaattgcaaacaagtactctggttaataaatgctgcttcctttgtggaaattataaaattctaactttacatgtattttgttattagaaattttcttttattgaatgagaaaaattagtctatcattttaagagccaatatggcaaacactttcaaatactgtatattaggaaactgttttggtattcttgatggaaaaaaatgcagcggaaatgtcattatgaacagatgttaaataggaaattattacttgttaacttcttacagcagtagtaccttctttaaaaaaaaaaaagaatctgcggtatttttttaaaaaaaaagtttactgctgtagtgtgaaatattgtctggaaagggatggtttaaatattaccatgatgtagttgaaatataaaataggatttggaaccttattgtgataaatatttatatatgatgtatgtttgtctcccctctccaaagtaaggaacccagctgggcgtggtggctcactcctgtaatcccagcattttgggaggccgaggtgggtggaccgcttgagtccacgagtttaagaccagcctgggcaacatggtgaagccccatctctacaaaaaatacaaaaaaattagccgggtatgatggtgtgtgcctctagtcccagctacttgggaggctgaggtcagaggatggcttgagcccaagaggcagaggttgcagggtcaagatcgcaccacttgcactgcagcctgagagagagagagccagaccttgtctcaaaaaataaaaaataaaaaaataaaaacaaaataaggaatccttttaaagcatgttgagaaagtattttttggtatgaatgggtgacgggccttttaatctttcaggaatacatataagcaggaatacttagcctgtattgggaaggtgcgtgaaactcaaagttgctaacatcatcttccttattttcagccagtgctgttactgcatttagcatggctctgacgaggcagtggagagttcctgacagcatagcatactgccttctgacagactgggttaagctaccaaaaatgacaaccagggattctatttatcacaggactttaacaccatatatttccctcccagtttttctccccttttggtttaatagttaaaacatttttcataattagtgctgtacatttgattgcaaacaaattggtgatacttctaaactataactataaatctctagaattctgtgaatttcaacattatttgaagtagttcttcagttatatttacatgtgttgtaaatatgtaaatatacttttagcttaggaagtcttccagaatacaaactactcccagttagatatcagtgagtttgaataactgaagaaatgttgacaatgttaagtgtttgattttatataacaagcttattaaatatatttttgtggaaa

SEQ ID NO: 456657 - DNA, 3605 bp, Homo sapiens
aaaataattgtaatatgctaacaccaattgtatcttaaaaagaggtactggaaattccatcttgcattcttccgttttttcctgttatagaaaaacgcactccctgatactcagtagaggatcaacttatttctagttaatcagcatgaacgtttccagcagaatagatgctttggtgtagcacttgcctgggagtcatggttagcattccgcattttttagagagctgaattcagcagcctaggaaacattaggaagaacaccttcaaacagggaacaacgtcttgggggaagagagtcactgcctccgctagggatcccgagggggtacaaaagcaacaacaacaaaaactcgtggagagtaggctccacgacatgcgcatgcgacgaactcccgcactcagcggggcaggtttcgtccttcatcttctcagtcggcaggacctgcttctcgctgaggatgagtgaggacagccgcagctcggcggggacggcccgttagcctagagcgccggcacccgagtcccgccgccggagccgcgcctggagccgcggtgggggaggggcagcggcggcccgcgctgcgtcgagcttcccagaattcccagcggccgcggggaaagtttacgggatgtaggcggcggcggcggtagtggtagcggttattcggcggcccgcggcggaccatggccctggcccggcgtcgctgggctttcctcacggcgtccccgagcagcgtcgcagagcgggccgacttccgggaaggaactgaccagcgactgagcggcggccggcgcgcttagcgccctgaacatgcggcagtccctgcgggcgaccccgggctccggacaggcggcggcggaggcggcggctcgggagggaaggaggcggcggcgccggcggaggtggcggcggagacggccggcgcccggcgcggagccctagggaggcagttcagcgcggcctcgggcctcgtcgagaaggatgctgtcccgaaagaaaaccaaaaacgaagtgtccaagccggccgaggtgcaggggaagtacgtgaagaaggagacgtcgcctctgcttcggaatgcgtcgagatgtgcgtcatgtttgcaaacattgcgggtgtctctcgactgtgctgcaagttgtgcgaactctggggcagaattccttagtcctgctgccggatgcagacttgagaagatcttatgccttcattcatccggcatggtccaacaattccaagacgaactgatatctgtcttccagattcaagccctaatgccttttcaacttgactctggttcccgatattattattcagacaatttttttgatggtcagagaaagcggccacttggagatcgtgcacatgaagactacagatattatgaatacaaccatgatctcttccaaagaatgccacagaatcaggggaggcatgcttcaggtattgggagagttgctgctacatctttaggaaatttgactaaccatggttctgaagatttaccccttcctcctggctggtctgtggactggacaatgagagggagaaaatattatatagatcataacacaaatacaactcactggagccatcctcttgagcgagaaggacttcctcctggatgggaacgagttgagtcatccgaatttggaacctattatgtagatcacacaaataagaaggcccaatacaggcatccctgtgctcctagtgtacctcggtatgatcaaccacctcctgtcacataccagccacagcaaactgaaagaaatcagtcccttctggtacctgcaaatccatatcatactgcagaaattcctgactggcttcaggtttacgcacgagcccctgtgaaatatgaccacattctgaagtgggaactcttccagctggctgacctggatacataccagggaatgctaaagttgctcttcatgaaagaattggagcagattgttaaaatgtatgaagcatacagacaagcccttcttacagagttggaaaaccgaaagcagagacagcagtggtatgcccaacaacatggaaaaaatttttgagctgattttttaaaaatttaagttttgtaagagctttaaaatattttcacagataaaaaattgcaaacaagtactctggttaataaatgctgcttcctttgtggaaattataaaattctaactttacatgtattttgttattagaaattttcttttattgaatgagaaaaattagtctatcattttaagagccaatatggcaaacactttcaaatactgtatattaggaaactgttttggtattcttgatggaaaaaaatgcagcggaaatgtcattatgaacagatgttaaataggaaattattacttgttaacttcttacagcagtagtaccttctttaaaaaaaaaaaagaatctgcggtatttttttaaaaaaaaagtttactgctgtagtgtgaaatattgtctggaaagggatggtttaaatattaccatgatgtagttgaaatataaaataggatttggaaccttattgtgataaatatttatatatgatgtatgtttgtctcccctctccaaagtaaggaacccagctgggcgtggtggctcactcctgtaatcccagcattttgggaggccgaggtgggtggaccgcttgagtccacgagtttaagaccagcctgggcaacatggtgaagccccatctctacaaaaaatacaaaaaaattagccgggtatgatggtgtgtgcctctagtcccagctacttgggaggctgaggtcagaggatggcttgagcccaagaggcagaggttgcagggtcaagatcgcaccacttgcactgcagcctgagagagagagagccagaccttgtctcaaaaaataaaaaataaaaaaataaaaacaaaataaggaatccttttaaagcatgttgagaaagtattttttggtatgaatgggtgacgggccttttaatctttcaggaatacatataagcaggaatacttagcctgtattgggaaggtgcgtgaaactcaaagttgctaacatcatcttccttattttcagccagtgctgttactgcatttagcatggctctgacgaggcagtggagagttcctgacagcatagcatactgccttctgacagactgggttaagctaccaaaaatgacaaccagggattcaaaaaaaatttttggtcattaaatcgaatgtatattattactttttaattttctaagtatttatcacaggactttaacaccatatatttccctcccagtttttctccccttttggtttaatagttaaaacatttttcataattagtgctgtacatttgattgcaaacaaattggtgatacttctaaactataactataaatctctagaattctgtgaatttcaacattatttgaagtagttcttcagttatatttacatgtgttgtaaatatgtaaatatacttttagcttaggaagtcttccagaatacaaactactcccagttagatatcagtgagtttgaataactgaagaaatgttgacaatgttaagtgtttgattttatataacaagcttattaaatatatttttgtggaaa

SEQ ID NO: 456658 - DNA, 3632 bp, Homo sapiens
aaaataattgtaatatgctaacaccaattgtatcttaaaaagaggtactggaaattccatcttgcattcttccgttttttcctgttatagaaaaacgcactccctgatactcagtagaggatcaacttatttctagttaatcagcatgaacgtttccagcagaatagatgctttggtgtagcacttgcctgggagtcatggttagcattccgcattttttagagagctgaattcagcagcctaggaaacattaggaagaacaccttcaaacagggaacaacgtcttgggggaagagagtcactgcctccgctagggatcccgagggggtacaaaagcaacaacaacaaaaactcgtggagagtaggctccacgacatgcgcatgcgacgaactcccgcactcagcggggcaggtttcgtccttcatcttctcagtcggcaggacctgcttctcgctgaggatgagtgaggacagccgcagctcggcggggacggcccgttagcctagagcgccggcacccgagtcccgccgccggagccgcgcctggagccgcggtgggggaggggcagcggcggcccgcgctgcgtcgagcttcccagaattcccagcggccgcggggaaagtttacgggatgtaggcggcggcggcggtagtggtagcggttattcggcggcccgcggcggaccatggccctggcccggcgtcgctgggctttcctcacggcgtccccgagcagcgtcgcagagcgggccgacttccgggaaggaactgaccagcgactgagcggcggccggcgcgcttagcgccctgaacatgcggcagtccctgcgggcgaccccgggctccggacaggcggcggcggaggcggcggctcgggagggaaggaggcggcggcgccggcggaggtggcggcggagacggccggcgcccggcgcggagccctagggaggcagttcagcgcggcctcgggcctcgtcgagaaggatgctgtcccgaaagaaaaccaaaaacgaagtgtccaagccggccgaggtgcaggggaagtacgtgaagaaggagacgtcgcctctgcttcggaatcttatgccttcattcatccggcatggtccaacaattccaagacgaactgatatctgtcttccagattcaagccctaatgccttttcaacttctggagatgtagtttcaagaaaccagagtttccttagaactccaattcaaagaacacctcatgaaataatgagaagagaaagcaacagattatctgcaccttcttatcttgccagaagtctagcagatgtccctagagagtatggttcttctcagtcatttgtaacggaagttagttttgctgttgaaaatggaagaaagcggccacttggagatcgtgcacatgaagactacagatattatgaatacaaccatgatctcttccaaagaatgccacagaatcaggggaggcatgcttcaggtattgggagagttgctgctacatctttaggaaatttgactaaccatggttctgaagatttaccccttcctcctggctggtctgtggactggacaatgagagggagaaaatattatatagatcataacacaaatacaactcactggagccatcctcttgagcgagaaggacttcctcctggatgggaacgagttgagtcatccgaatttggaacctattatgtagatcacacaaataagaaggcccaatacaggcatccctgtgctcctagtgtacctcggtatgatcaaccacctcctgtcacataccagccacagcaaactgaaagaaatcagtcccttctggtacctgcaaatccatatcatactgcagaaattcctgactggcttcaggtttacgcacgagcccctgtgaaatatgaccacattctgaagtgggaactcttccagctggctgacctggatacataccagggaatgctaaagttgctcttcatgaaagaattggagcagattgttaaaatgtatgaagcatacagacaagcccttcttacagagttggaaaaccgaaagcagagacagcagtggtatgcccaacaacatggaaaaaatttttgagctgattttttaaaaatttaagttttgtaagagctttaaaatattttcacagataaaaaattgcaaacaagtactctggttaataaatgctgcttcctttgtggaaattataaaattctaactttacatgtattttgttattagaaattttcttttattgaatgagaaaaattagtctatcattttaagagccaatatggcaaacactttcaaatactgtatattaggaaactgttttggtattcttgatggaaaaaaatgcagcggaaatgtcattatgaacagatgttaaataggaaattattacttgttaacttcttacagcagtagtaccttctttaaaaaaaaaaaagaatctgcggtatttttttaaaaaaaaagtttactgctgtagtgtgaaatattgtctggaaagggatggtttaaatattaccatgatgtagttgaaatataaaataggatttggaaccttattgtgataaatatttatatatgatgtatgtttgtctcccctctccaaagtaaggaacccagctgggcgtggtggctcactcctgtaatcccagcattttgggaggccgaggtgggtggaccgcttgagtccacgagtttaagaccagcctgggcaacatggtgaagccccatctctacaaaaaatacaaaaaaattagccgggtatgatggtgtgtgcctctagtcccagctacttgggaggctgaggtcagaggatggcttgagcccaagaggcagaggttgcagggtcaagatcgcaccacttgcactgcagcctgagagagagagagccagaccttgtctcaaaaaataaaaaataaaaaaataaaaacaaaataaggaatccttttaaagcatgttgagaaagtattttttggtatgaatgggtgacgggccttttaatctttcaggaatacatataagcaggaatacttagcctgtattgggaaggtgcgtgaaactcaaagttgctaacatcatcttccttattttcagccagtgctgttactgcatttagcatggctctgacgaggcagtggagagttcctgacagcatagcatactgccttctgacagactgggttaagctaccaaaaatgacaaccagggattcaaaaaaaatttttggtcattaaatcgaatgtatattattactttttaattttctaagtatttatcacaggactttaacaccatatatttccctcccagtttttctccccttttggtttaatagttaaaacatttttcataattagtgctgtacatttgattgcaaacaaattggtgatacttctaaactataactataaatctctagaattctgtgaatttcaacattatttgaagtagttcttcagttatatttacatgtgttgtaaatatgtaaatatacttttagcttaggaagtcttccagaatacaaactactcccagttagatatcagtgagtttgaataactgaagaaatgttgacaatgttaagtgtttgattttatataacaagcttattaaatatatttttgtggaaa

SEQ ID NO: 456659 - DNA, 2338 bp, Homo sapiens
aaaataattgtaatatgctaacaccaattgtatcttaaaaagaggtactggaaattccatcttgcattcttccgttttttcctgttatagaaaaacgcactccctgatactcagtagaggatcaacttatttctagttaatcagcatgaacgtttccagcagaatagatgctttggtgtagcacttgcctgggagtcatggttagcattccgcattttttagagagctgaattcagcagcctaggaaacattaggaagaacaccttcaaacagggaacaacgtcttgggggaagagagtcactgcctccgctagggatcccgagggggtacaaaagcaacaacaacaaaaactcgtggagagtaggctccacgacatgcgcatgcgacgaactcccgcactcagcggggcaggtttcgtccttcatcttctcagtcggcaggacctgcttctcgctgaggatgagtgaggacagccgcagctcggcggggacggcccgttagcctagagcgccggcacccgagtcccgccgccggagccgcgcctggagccgcggtgggggaggggcagcggcggcccgcgctgcgtcgagcttcccagaattcccagcggccgcggggaaagtttacgggatgtaggcggcggcggcggtagtggtagcggttattcggcggcccgcggcggaccatggccctggcccggcgtcgctgggctttcctcacggcgtccccgagcagcgtcgcagagcgggccgacttccgggaaggaactgaccagcgactgagcggcggccggcgcgcttagcgccctgaacatgcggcagtccctgcgggcgaccccgggctccggacaggcggcggcggaggcggcggctcgggagggaaggaggcggcggcgccggcggaggtggcggcggagacggccggcgcccggcgcggagccctagggaggcagttcagcgcggcctcgggcctcgtcgagaaggatgctgtcccgaaagaaaaccaaaaacgaagtgtccaagccggccgaggtgcaggggaagtacgtgaagaaggagacgtcgcctctgcttcggaatcttatgccttcattcatccggcatggtccaacaattccaagacgaactgatatctgtcttccagattcaagccctaatgccttttcaacttctggagatgtagtttcaagaaaccagagtttccttagaactccaattcaaagaacacctcatgaaataatgagaagagaaagcaacagattatctgcaccttcttatcttgccagaagtctagcagatgtccctagagagtatggttcttctcagtcatttgtaacggaagttagttttgctgttgaaaatggagactctggttcccgatattattattcagacaatttttttgatggtcagagaaagcggccacttggagatcgtgcacatgaagactacagatattatgaatacaaccatgatctcttccaaagaatgccacagaatcaggggaggcatgcttcagaggatggcttgagcccaagaggcagaggttgcagggtcaagatcgcaccacttgcactgcagcctgagagagagagagccagaccttgtctcaaaaaataaaaaataaaaaaataaaaacaaaataaggaatccttttaaagcatgttgagaaagtattttttggtatgaatgggtgacgggccttttaatctttcaggaatacatataagcaggaatacttagcctgtattgggaaggtgcgtgaaactcaaagttgctaacatcatcttccttattttcagccagtgctgttactgcatttagcatggctctgacgaggcagtggagagttcctgacagcatagcatactgccttctgacagactgggttaagctaccaaaaatgacaaccagggattcaaaaaaaatttttggtcattaaatcgaatgtatattattactttttaattttctaagtatttatcacaggactttaacaccatatatttccctcccagtttttctccccttttggtttaatagttaaaacatttttcataattagtgctgtacatttgattgcaaacaaattggtgatacttctaaactataactataaatctctagaattctgtgaatttcaacattatttgaagtagttcttcagttatatttacatgtgttgtaaatatgtaaatatacttttagcttaggaagtcttccagaatacaaactactcccagttagatatcagtgagtttgaataactgaagaaatgttgacaatgttaagtgtttgattttatataacaagcttattaaatatatttttgtggaaa

SEQ ID NO: 456660 - DNA, 1612 bp, Homo sapiens
aaaataattgtaatatgctaacaccaattgtatcttaaaaagaggtactggaaattccatcttgcattcttccgttttttcctgttatagaaaaacgcactccctgatactcagtagaggatcaacttatttctagttaatcagcatgaacgtttccagcagaatagatgctttggtgtagcacttgcctgggagtcatggttagcattccgcattttttagagagctgaattcagcagcctaggaaacattaggaagaacaccttcaaacagggaacaacgtcttgggggaagagagtcactgcctccgctagggatcccgagggggtacaaaagcaacaacaacaaaaactcgtggagagtaggctccacgacatgcgcatgcgacgaactcccgcactcagcggggcaggtttcgtccttcatcttctcagtcggcaggacctgcttctcgctgaggatgagtgaggacagccgcagctcggcggggacggcccgttagcctagagcgccggcacccgagtcccgccgccggagccgcgcctggagccgcggtgggggaggggcagcggcggcccgcgctgcgtcgagcttcccagaattcccagcggccgcggggaaagtttacgggatgtaggcggcggcggcggtagtggtagcggttattcggcggcccgcggcggaccatggccctggcccggcgtcgctgggctttcctcacggcgtccccgagcagcgtcgcagagcgggccgacttccgggaaggaactgaccagcgactgagcggcggccggcgcgcttagcgccctgaacatgcggcagtccctgcgggcgaccccgggctccggacaggcggcggcggaggcggcggctcgggagggaaggaggcggcggcgccggcggaggtggcggcggagacggccggcgcccggcgcggagccctagggaggcagttcagcgcggcctcgggcctcgtcgagaaggatgctgtcccgaaagaaaaccaaaaacgaagtgtccaagccggccgaggtacaggcgtgagccaccgcgcctggccttgattttcttatggcattacgtctgtatggtaccatcttcagatctgtgaatgtatattggtgcaacatagtattgttttccattatattctgattctaaggcattcaatttaattctaattctcttatattttttcttaagctttgatttacaaagttgaaatttgcttttgcttttttaatgaacttgcttactgaattttgcataaaataacttcttattgacttgtaaatagtaaatggtatttgattcgaggacataatccaattatatgccacagtagaaactgaggaaagaattatctctatagttgttcaagatcagctttgcttcctgaagataatgacctaaatgattccagagtggtaatttttcttagtgtaacagatgattccttcgtggatgcctagagtcttttctgagatatgtagtgttgcacatgtgcggtaggagaaatgaacactaatttacaggtcaggcctgaggtctgccaagaaagaatacatactggcctgggccctgcttaaagtggtatgtattactgtcagtc

SEQ ID NO: 456661 - DNA, 1539 bp, Homo sapiens
aaaataattgtaatatgctaacaccaattgtatcttaaaaagaggtactggaaattccatcttgcattcttccgttttttcctgttatagaaaaacgcactccctgatactcagtagaggatcaacttatttctagttaatcagcatgaacgtttccagcagaatagatgctttggtgtagcacttgcctgggagtcatggttagcattccgcattttttagagagctgaattcagcagcctaggaaacattaggaagaacaccttcaaacagggaacaacgtcttgggggaagagagtcactgcctccgctagggatcccgagggggtacaaaagcaacaacaacaaaaactcgtggagagtaggctccacgacatgcgcatgcgacgaactcccgcactcagcggggcaggtttcgtccttcatcttctcagtcggcaggacctgcttctcgctgaggatgagtgaggacagccgcagctcggcggggacggcccgttagcctagagcgccggcacccgagtcccgccgccggagccgcgcctggagccgcggtgggggaggggcagcggcggcccgcgctgcgtcgagcttcccagaattcccagcggccgcggggaaagtttacgggatgtaggcggcggcggcggtagtggtagcggttattcggcggcccgcggcggaccatggccctggcccggcgtcgctgggctttcctcacggcgtccccgagcagcgtcgcagagcgggccgacttccgggaaggaactgaccagcgactgagaggcagttcagcgcggcctcgggcctcgtcgagaaggatgctgtcccgaaagaaaaccaaaaacgaagtgtccaagccggccgaggtgcaggggaagtacgtgaagaaggagacgtcgcctctgcttcggaatcttatgccttcattcatccggcatggtccaacaattccaagacgaactgatatctgtcttccagattcaagccctaatgccttttcaacttctggagatgtagtttcaagaaaccagagtttccttagaactccaattcaaagaacacctcatgaaataatgagaagagaaagcaacagattatctgcaccttcttatcttgccagaagtctagcagatgtccctagagagtatggttcttctcagtcatttgtaacggaagttagttttgctgttgaaaatggagactctggttcccgatattattattcagacaatttttttgatggtcagagaaagcggccacttggagatcgtgcacatgaagactacagatattatgaatacaaccatgatctcttccaaagaatgccacagaatcaggggaggcatgcttcagtcaggtagcttaacattataaataatatagtagtttatatttattgacatgtcaattaaaaagatgttcttttctagattttcttgggacacgaacaaatactactagcgaaatgtttttccactttgctcatcctgcttaagcctgtgtgcaaatagttgttaatctacactgaatggaaga

SEQ ID NO: 456662 - DNA, 3984 bp, Homo sapiens
aaaataattgtaatatgctaacaccaattgtatcttaaaaagaggtactggaaattccatcttgcattcttccgttttttcctgttatagaaaaacgcactccctgatactcagtagaggatcaacttatttctagttaatcagcatgaacgtttccagcagaatagatgctttggtgtagcacttgcctgggagtcatggttagcattccgcattttttagagagctgaattcagcagcctaggaaacattaggaagaacaccttcaaacagggaacaacgtcttgggggaagagagtcactgcctccgctagggatcccgagggggtacaaaagcaacaacaacaaaaactcgtggagagtaggctccacgacatgcgcatgcgacgaactcccgcactcagcggggcaggtttcgtccttcatcttctcagtcggcaggacctgcttctcgctgaggatgagtgaggacagccgcagctcggcggggacggcccgttagcctagagcgccggcacccgagtcccgccgccggagccgcgcctggagccgcggtgggggaggggcagcggcggcccgcgctgcgtcgagcttcccagaattcccagcggccgcggggaaagtttacgggatgtaggcggcggcggcggtagtggtagcggttattcggcggcccgcggcggaccatggccctggcccggcgtcgctgggctttcctcacggcgtccccgagcagcgtcgcagagcgggccgacttccgggaaggaactgaccagcgactgagcggcggccggcgcgcttagcgccctgaacatgcggcagtccctgcgggcgaccccgggctccggacaggcggcggcggaggcggcggctcgggagggaaggaggcggcggcgccggcggaggtggcggcggagacggccggcgcccggcgcggagccctagggaggcagttcagcgcggcctcgggcctcgtcgagaaggatgctgtcccgaaagaaaaccaaaaacgaagtgtccaagccggccgaggtgcaggggaagtacgtgaagaaggagacgtcgcctctgcttcggaatcttatgccttcattcatccggcatggtccaacaattccaagacgaactgatatctgtcttccagattcaagccctaatgccttttcaacttctggagatgtagtttcaagaaaccagagtttccttagaactccaattcaaagaacacctcatgaaataatgagaagagaaagcaacagattatctgcaccttcttatcttgccagaagtctagcagatgtccctagagagtatggttcttctcagtcatttgtaacggaagttagttttgctgttgaaaatggagactctggttcccgatattattattcagacaatttttttgatggtcagagaaagcggccacttggagatcgtgcacatgaagactacagatattatgaatacaaccatgatctcttccaaagaatgccacagaatcaggggaggcatgcttcaggtattgggagagttgctgctacatctttaggaaatttgactaaccatggttctgaagatttaccccttcctcctggctggtctgtggactggacaatgagagggagaaaatattatatagatcataacacaaatacaactcactggagccatcctcttgagcgagaaggacttcctcctggatgggaacgagttgagtcatccgaatttggaacctattatgtagatcacacaaataagaaggcccaatacaggcatccctgtgctcctagtgtacctcggtatgatcaaccacctcctgtcacataccagccacagcaaactgaaagaaatcagtcccttctggtacctgcaaatccatatcatactgcagaaattcctgactggcttcaggtttacgcacgagcccctgtgaaatatgaccacattctgaagtgggaactcttccagctggctgacctggatacataccagggaatgctaaagttgctcttcatgaaagaattggagcagattgttaaaatgtatgaagcatacagacaagcccttcttacagagttggaaaaccgaaagcagagacagcagtggtatgcccaacaacatggaaaaaatttttgagctgattttttaaaaatttaagttttgtaagagctttaaaatattttcacagataaaaaattgcaaacaagtactctggttaataaatgctgcttcctttgtggaaattataaaattctaactttacatgtattttgttattagaaattttcttttattgaatgagaaaaattagtctatcattttaagagccaatatggcaaacactttcaaatactgtatattaggaaactgttttggtattcttgatggaaaaaaatgcagcggaaatgtcattatgaacagatgttaaataggaaattattacttgttaacttcttacagcagtagtaccttctttaaaaaaaaaaaagaatctgcggtatttttttaaaaaaaaagtttactgctgtagtgtgaaatattgtctggaaagggatggtttaaatattaccatgatgtagttgaaatataaaataggatttggaaccttattgtgataaatatttatatatgatgtatgtttgtctcccctctccaaagtaaggaacccagctgggcgtggtggctcactcctgtaatcccagcattttgggaggccgaggtgggtggaccgcttgagtccacgagtttaagaccagcctgggcaacatggtgaagccccatctctacaaaaaatacaaaaaaattagccgggtatgatggtgtgtgcctctagtcccagctacttgggaggctgaggtcagaggatggcttgagcccaagaggcagaggttgcagggtcaagatcgcaccacttgcactgcagcctgagagagagagagccagaccttgtctcaaaaaataaaaaataaaaaaataaaaacaaaataaggaatccttttaaagcatgttgagaaagtattttttggtatgaatgggtgacgggccttttaatctttcaggaatacatataagcaggaatacttagcctgtattgggaaggtgcgtgaaactcaaagttgctaacatcatcttccttattttcagccagtgctgttactgcatttagcatggctctgacgaggcagtggagagttcctgacagcatagcatactgccttctgacagactgggttaagctaccaaaaatgacaaccagggattcaaaaaaaatttttggtcattaaatcgaatgtatattattactttttaattttctaagtatttatcacaggactttaacaccatatatttccctcccagtttttctccccttttggtttaatagttaaaacatttttcataattagtgctgtacatttgattgcaaacaaattggtgatacttctaaactataactataaatctctagaattctgtgaatttcaacattatttgaagtagttcttcagttatatttacatgtgttgtaaatatgtaaatatacttttagcttaggaagtcttccagaatacaaactactcccagttagatatcagtgagtttgaataactgaagaaatgttgacaatgttaagtgtttgattttatataacaagcttattaaatatatttttgtggaaacaaaaaaaaatggtttttgagtccatgttttagacatagtgctgtatttcatttttctgttcagtggccatctaatagtttatgctgtacagcataacctcattgtgatgagatatttggaggtggggatcaatcagagggggaaatagaatgatcagtactgcggcggataggcctaggattgtgggggcaacgaatgaagcgaacaggttttcgttcattttggttctcagggtttgttataattttatattttaatgggcttaggtgcgggaggtaagtggtagttcgtgtaaaatatata

SEQ ID NO: 456663 - DNA, 3517 bp, Homo sapiens
aaaataattgtaatatgctaacaccaattgtatcttaaaaagaggtactggaaattccatcttgcattcttccgttttttcctgttatagaaaaacgcactccctgatactcagtagaggatcaacttatttctagttaatcagcatgaacgtttccagcagaatagatgctttggtgtagcacttgcctgggagtcatggttagcattccgcattttttagagagctgaattcagcagcctaggaaacattaggaagaacaccttcaaacagggaacaacgtcttgggggaagagagtcactgcctccgctagggatcccgagggggtacaaaagcaacaacaacaaaaactcgtggagagtaggctccacgacatgcgcatgcgacgaactcccgcactcagcggggcaggtttcgtccttcatcttctcagtcggcaggacctgcttctcgctgaggatgagtgaggacagccgcagctcggcggggacggcccgttagcctagagcgccggcacccgagtcccgccgccggagccgcgcctggagccgcggtgggggaggggcagcggcggcccgcgctgcgtcgagcttcccagaattcccagcggccgcggggaaagtttacgggatgtaggcggcggcggcggtagtggtagcggttattcggcggcccgcggcggaccatggccctggcccggcgtcgctgggctttcctcacggcgtccccgagcagcgtcgcagagcgggccgacttccgggaaggaactgaccagcgactgagaggcagttcagcgcggcctcgggcctcgtcgagaaggatgctgtcccgaaagaaaaccaaaaacgaagtgtccaagccggccgaggtgcaggggaagtacgtgaagaaggagacgtcgcctctgcttcggaatcttatgccttcattcatccggcatggtccaacaattccaagacgaactgatatctgtcttccagattcaagccctaatgccttttcaacttctggagatgtagtttcaagaaaccagagtttccttagaactccaattcaaagaacacctcatgaaataatgagaagagaaagcaacagattatctgcaccttcttatcttgccagaagtctagcagatgtccctagagagtatggttcttctcagtcatttgtaacggaagttagttttgctgttgaaaatggagactctggttcccgatattattattcagacaatttttttgatggtcagagaaagcggccacttggagatcgtgcacatgaagactacagatattatgaatacaaccatgatctcttccaaagaatgccacagaatcaggggaggcatgcttcaggtattgggagagttgctgctacatctttaggaaatttgactaaccatggttctgaagatttaccccttcctcctggctggtctgtggactggacaatgagagggagaaaatattatatagatcataacacaaatacaactcactggagccatcctcttgagcgagaaggacttcctcctggatgggaacgagttgagtcatccgaatttggaacctattatgtagatcacacaaataagaaggcccaatacaggcatccctgtgctcctagtgtacctcggtatgatcaaccacctcctgtcacataccagccacagcaaactgaaagaaatcagtcccttctggtacctgcaaatccatatcatactgcagaaattcctgactggcttcaggtttacgcacgagcccctgtgaaatatgaccacattctgaagtgggaactcttccagctggctgacctggatacataccagggaatgctaaagttgctcttcatgaaagaattggagcagattgttaaaatgtatgaagcatacagacaagcccttcttacagagttggaaaaccgaaagcagagacagcagtggtatgcccaacaacatggaaaaaatttttgagctgattttttaaaaatttaagttttgtaagagctttaaaatattttcacagataaaaaattgcaaacaagtactctggttaataaatgctgcttcctttgtggaaattataaaattctaactttacatgtattttgttattagaaattttcttttattgaatgagaaaaattagtctatcattttaagagccaatatggcaaacactttcaaatactgtatattaggaaactgttttggtattcttgatggaaaaaaatgcagcggaaatgtcattatgaacagatgttaaataggaaattattacttgttaacttcttacagcagtagtaccttctttaaaaaaaaaaaagaatctgcggtatttttttaaaaaaaaagtttactgctgtagtgtgaaatattgtctggaaagggatggtttaaatattaccatgatgtagttgaaatataaaataggatttggaaccttattgtgataaatatttatatatgatgtatgtttgtctcccctctccaaagtaaggaacccagctgggcgtggtggctcactcctgtaatcccagcattttgggaggccgaggtgggtggaccgcttgagtccacgagtttaagaccagcctgggcaacatggtgaagccccatctctacaaaaaatacaaaaaaattagccgggtatgatggtgtgtgcctctagtcccagctacttgggaggctgaggtcagaggatggcttgagcccaagaggcagaggttgcagggtcaagatcgcaccacttgcactgcagcctgagagagagagagccagaccttgtctcaaaaaataaaaaataaaaaaataaaaacaaaataaggaatccttttaaagcatgttgagaaagtattttttggtatgaatgggtgacgggccttttaatctttcaggaatacatataagcaggaatacttagcctgtattgggaaggtgcgtgaaactcaaagttgctaacatcatcttccttattttcagccagtgctgttactgcatttagcatggctctgacgaggcagtggagagttcctgacagcatagcatactgccttctgacagactgggttaagctaccaaaaatgacaaccagggattcaaaaaaaatttttggtcattaaatcgaatgtatattattactttttaattttctaagtatttatcacaggactttaacaccatatatttccctcccagtttttctccccttttggtttaatagttaaaacatttttcataattagtgctgtacatttgattgcaaacaaattggtgatacttctaaactataactataaatctctagaattctgtgaatttcaacattatttgaagtagttcttcagttatatttacatgtgttgtaaatatgtaaatatacttttagcttaggaagtcttccagaatacaaactactcccagttagatatcagtgagtttgaataactgaagaaatgttgacaatgttaagtgtttgattttatataacaagcttattaaatatatttttgtggaaa

SEQ ID NO: 456664 - DNA, 2246 bp, Homo sapiens
aaaataattgtaatatgctaacaccaattgtatcttaaaaagaggtactggaaattccatcttgcattcttccgttttttcctgttatagaaaaacgcactccctgatactcagtagaggatcaacttatttctagttaatcagcatgaacgtttccagcagaatagatgctttggtgtagcacttgcctgggagtcatggttagcattccgcattttttagagagctgaattcagcagcctaggaaacattaggaagaacaccttcaaacagggaacaacgtcttgggggaagagagtcactgcctccgctagggatcccgagggggtacaaaagcaacaacaacaaaaactcgtggagagtaggctccacgacatgcgcatgcgacgaactcccgcactcagcggggcaggtttcgtccttcatcttctcagtcggcaggacctgcttctcgctgaggatgagtgaggacagccgcagctcggcggggacggcccgttagcctagagcgccggcacccgagtcccgccgccggagccgcgcctggagccgcggtgggggaggggcagcggcggcccgcgctgcgtcgagcttcccagaattcccagcggccgcggggaaagtttacgggatgtaggcggcggcggcggtagtggtagcggttattcggcggcccgcggcggaccatggccctggcccggcgtcgctgggctttcctcacggcgtccccgagcagcgtcgcagagcgggccgacttccgggaaggaactgaccagcgactgagcggcggccggcgcgcttagcgccctgaacatgcggcagtccctgcgggcgaccccgggctccggacaggcggcggcggaggcggcggctcgggagggaaggaggcggcggcgccggcggaggtggcggcggagacggccggcgcccggcgcggagccctagggaggcagttcagcgcggcctcgggcctcgtcgagaaggatgctgtcccgaaagaaaaccaaaaacgaagtgtccaagccggccgaggtgcaggggaagtacgtgaagaaggagacgtcgcctctgcttcggaatcttatgccttcattcatccggcatggtccaacaattccaagacgaactgatatctgtcttccagattcaagccctaatgccttttcaacttctggagatgtagtttcaagaaaccagagtttccttagaactccaattcaaagaacacctcatgaaataatgagaagagaaagcaacagattatctgcaccttcttatcttgccagaagtctagcagatgtccctagagagtatggttcttctcagtcatttgtaacggaagttagttttgctgttgaaaatggagactctggttcccgatattattattcagacaatttttttgatggtcagagaaagcggccacttggagatcgtgcacatgaagactacagatattatgaatacaaccatgatctcttccaaagaatgccacagaatcaggggaggcatgcttcaggtattgggagagttgctgctacatctttaggaaatttgactaaccatggttctgaagatttaccccttcctcctggctggtctgtggactggacaatgagagggagaaaatattatatagatcataacacaaatacaactcactggagccatcctcttgagcgagaaggacttcctcctggatgggaacgagttgagtcatccgaatttggaacctattatgtagatcacacaaataagaaggcccaatacaggcatccctgtgctcctagtgtacctcggtatgatcaaccacctcctgtcacataccagccacagcaaactgaaagaaatcagtcccttctggtacctgcaaatccatatcatactgcagaaattcctgactggcttcaggtttacgcacgagcccctgtgaaatatgaccacattctgaagtgggaactcttccagctggctgacctggatacataccagggaatgctaaagttgctcttcatgaaagaattggagcagattgttaaaatgtatgaagcatacagacaagcccttcttacagagttggaaaaccgaaagcagagacagcagtggtatgcccaacaacatggaaaaaatttttgagctgattttttaaaaatttaagttttgtaagagctttaaaatattttcacagataaaaaattgcaaacaagtactctggttaataaatgctgcttcctttgtggaaatta

SEQ ID NO: 456665 - DNA, 1702 bp, Homo sapiens
aaaataattgtaatatgctaacaccaattgtatcttaaaaagaggtactggaaattccatcttgcattcttccgttttttcctgttatagaaaaacgcactccctgatactcagtagaggatcaacttatttctagttaatcagcatgaacgtttccagcagaatagatgctttggtgtagcacttgcctgggagtcatggttagcattccgcattttttagagagctgaattcagcagcctaggaaacattaggaagaacaccttcaaacagggaacaacgtcttgggggaagagagtcactgcctccgctagggatcccgagggggtacaaaagcaacaacaacaaaaactcgtggagagtaggctccacgacatgcgcatgcgacgaactcccgcactcagcggggcaggtttcgtccttcatcttctcagtcggcaggacctgcttctcgctgaggatgagtgaggacagccgcagctcggcggggacggcccgttagcctagagcgccggcacccgagtcccgccgccggagccgcgcctggagccgcggtgggggaggggcagcggcggcccgcgctgcgtcgagcttcccagaattcccagcggccgcggggaaagtttacgggatgtaggcggcggcggcggtagtggtagcggttattcggcggcccgcggcggaccatggccctggcccggcgtcgctgggctttcctcacggcgtccccgagcagcgtcgcagagcgggccgacttccgggaaggaactgaccagcgactgagcggcggccggcgcgcttagcgccctgaacatgcggcagtccctgcgggcgaccccgggctccggacaggcggcggcggaggcggcggctcgggagggaaggaggcggcggcgccggcggaggtggcggcggagacggccggcgcccggcgcggagccctagggaggcagttcagcgcggcctcgggcctcgtcgagaaggatgctgtcccgaaagaaaaccaaaaacgaagtgtccaagccggccgaggtgcaggggaagtacgtgaagaaggagacgtcgcctctgcttcggaatcttatgccttcattcatccggcatggtccaacaattccaagacgaactgatatctgtcttccagattcaagccctaatgccttttcaacttctggagatgtagtttcaagaaaccagagtttccttagaactccaattcaaagaacacctcatgaaataatgagaagagaaagcaacagattatctgcaccttcttatcttgccagaagtctagcagatgtccctagagagtatggttcttctcagtcatttgtaacggaagttagttttgctgttgaaaatggagactctggttcccgatattattattcagacaatttttttgatggtcagagaaagcggccacttggagatcgtgcacatgaagactacagatattatgaatacaaccatgatctcttccaaagaatgccacagaatcaggggaggcatgcttcagtcaggtagcttaacattataaataatatagtagtttatatttattgacatgtcaattaaaaagatgttcttttctagattttcttgggacacgaacaaatactactagcgaaatgtttttccactttgctcatcctgcttaagcctgtgtgcaaatagttgttaatctacactgaatggaaga

SEQ ID NO: 456666 - DNA, 5662 bp, Homo sapiens
  misc_feature (3456)..(3456): n is a, c, g, or t
  misc_feature (3510)..(3510): n is a, c, g, or t
gatccggaagtcggagcctagctgcgcgagagtttctgctcgctcaaccgagttgtcgtgttgccctcgcttctcagatccccgccggaagtgaagagagcaagcagatttgaacctatctgctttcaagctggtcatcatgatgaaacttagacacaaaaataaaaagccaggtgaaggttccaagggccacaagaagataagttggccctaccctcagcctgcaaagcaaaatgggaagaaagcaacctccaaagtgccctctgcacctcattttgttcaccccaatgatcatgccaatcgagaggctgaattaaagaagaagtgggttgaggagatgagggagaagcagcaagccgcccgggagcaagaaagacaaaaacgcaggaccattgagagctactgtcaggatgtcctaagacgccaggaggagtttgagcataaggaggaagttttgcaggaattaaatatgtttcctcagctggatgacgaggccacgaggaaggcttattacaaggagttccgtaaggtggtggaatactctgatgtgattctggaagtcctggatgccagagacccattaggctgccgctgcttccaaatggaggaggctgtcctgcgagcacaaggcaacaagaagctggtcctggtcttgaacaagattgacctggtccccaaggaggttgtggagaaatggctggattaccttcggaatgagttgccaaccgtggctttcaaggccagtacccagcatcaggtcaaaaacctgaatcgttgcagtgtgccagtagatcaggcctctgagtcactgctgaaaagcaaagcctgctttggagctgaaaacctcatgagggttctggggaactattgccgccttggtgaagtgcgcacccacattcgtgtgggtgttgtgggtcttcccaatgttgggaagagcagcctgatcaatagcctgaagcgcagccgcgcatgcagcgtgggagctgttcctggaattaccaaattcatgcaggaggtctacctggacaagttcatccggctcttggatgctccaggcattgtcccagggcccaactcagaggtgggcaccatcctgcgtaactgcgtccacgtgcagaagctggcagaccctgtgaccccagtggagaccatcctgcagcgctgcaacctggaggagatttccaactattatggcgtctctgggttccagaccactgagcactttctgacggcagtggcccaccgtttggggaagaagaagaagggaggcttatatagtcaggaacaggcggccaaagctgtcctagctgactgggtgagcgggaagatcagcttctatataccaccaccagccactcacactctgcccacccatctcagtgctgagatcgttaaggaaatgaccgaggtctttgacatcgaggatactgagcaggccaatgaagacaccatggaatgcttggccaccggagaatctgatgagctgttgggtgacacggacccacttgaaatggagatcaagttgctccattctccgatgacgaaaatagcagatgccattgaaaataaaaccaccgtgtataagattggagatctcactgggtattgcaccaatccgaaccgtcatcagatggggtgggctaaacgcaatgtggaccaccgccctaagagcaacagtatggtggatgtctgctcagtggaccgccgctcagtgctgcagaggatcatggagacggaccccctgcaacagggccaggctctggcatctgccctgaaaaataagaagaagatgcagaaacgtgcagataaaatcgccagcaagctgtctgattccatgatgtctgctctcgacctctctggcaatgctgatgatggtgttggtgactaatcgactgatctcacttcccttccgctccaagcaccagttccggtggtacgggggaataccagtgaaatagtttggttctccctgaagcatctgcatattgaaagaacgctttccccactgtgtgtcttctccccctcctccagtaaaaacagtcccggctgggtgctgtggctcacgtctgtaatcccagcactttgggaggccgaggtgggcggatcacctgaggtcgggagttcgagaccagcctggccaacatggtgaagccccgtctctactaaaaatacaaaaaaatttagccgtgcttggtggcacctgtaatcccagctacttgggaggctgaggcaggagaatcgcctgaacctgggagactaaggcaggagaatcgcctggacctgggaggcagaggttgcagtgagcccagacggcaccattgcactctagcctgggcaacaacacgaaactccgtccccaaaaaaaaaaaaaaaaaaatcccaaggggctgcagctgccaaacccaataccctctatttaacccctactctgttttacaagagaaataaaagaagtatcagcagagctcaggtgctaacacctgttgagggctgacctacaaaactctgcctacaaaactctcttagacaggtgaatatgccactagaagttaggttgctggtagacctgggggtccctgcgggagggtgatggtttctttaccaccccacaggagatttcagtggcaaggcatgcctgcagtgggctttgggccatgcatcttccaagtccataggtcttcacctgggtggcagtgagaaaaagtagaaagtaatgagcctcctgtgtctctggaaggttctagggatagggtagagggaagaagagaacaaacaagcctggcttgtgctgaagtgtggtaggcactaccctgtttgcgtgaagagaaaacaaagcacctgttagtagggaggctttagggggaagccccgtcttgggggcatttctgggcagattgtgaattggaggaatctctttaactgaagtactctggctggaccctgcccttgtgtgaccatgtctcctattgcaccagcatttgaattccatggctcaagagggttctggtaccatttattcacagactgtatcctcgagagagctgctatatatgggagtgtaccagccaactccttttccagtgtctgtaagtcacctcattaaagtataattagctgtctcctctgggagatcctaccccatcagacaagggcagtgagcccaagcagtgccagaggccctcagaaagggattagggtagatgattgcaactgaaacacaatcttctttctttgccagggtattttgggggttttgccccaaaatataccctgggcatagcattactgcagtcttggatgtctaccccaaacttccacaccatccttcgacccacagctgcacctttatttatttattttgctctgttgcccaggctggagtgcaatggcgtgatctcggctcactgcaacctctgcctcccgggttcaggtgatcctcctgccttagcctcccangtagctgggattacaggcacctgccaccacgcctggctagtttttgtatttttngtagagacgatgtttcaccatgttgaccaggctggtctcgaactcttgacctcaggtgatccgctcgcttcggcctcccaaagtgctgggattataggcgtgagccactgtgcccagcctcacagctgcatcttaaccttacctttgcctctgcctctcaagctggtacctcctaatttacatcctaagagtggaaccatgtgacaaggactggagtgccattggctgtggactgttcaggcagggaagtacaagaccactcttgtattcaggggcaaccaaaggagagaattacgtacttgttgagtacaaactgcaccaagccctggagacccattaccaccgttaaccctcaatacagctctgctagtaagggattcgtctccccaaatgaaaaaaaaaagtaatctcagaatgttggccgagcatggtggctcacacctgtagtcccagttatgcaggaggctgaggcaggagaatcgcttgatctcaggaggcggaggttgcagtgagtcgacatcacaccactgcactccagcctgggggacagagtgagacttcgtctcggaaaaaaaaaaaaaaagttgacaggatggccagacccaagtgggcgtattaagtggtggtgctaggattggaacccaagcgtgattaaaaccctatgcaggccctttcctctatattgtactgcctccttaacaaaggaagattgattaagcccctactttgtgccagtctctgttatcaagtccgttaaatgcatttaacgttaaattttttcttttttggtttaaaaaactctagtttcttaaactactagtttttagtgtcttgctaaaactatgtgctcttgaataggctacaacttatttcacactatctcattgaactctcctggtatgtgatagtgttataatgaaaaattgcataccaggacagctaagtctattttgcaaccatacagcgtttcataatttagcatttaaaatacagacagtccccgacttttggtggtttgatgtgggatttttggtggaaaagcagtatacattcagaatgcacctctacttatgatggggctacttcctggtaaacccattgtaatgtgcaaattacgggtttatcaggaggtgaccccatcggtaatggagaagtgctgggaggtaaatattagaaatggaagtatctaaatgagtaagaaacagcatgggagcataatttggccaaaatcaaacagaactaaagtagtcatgtcggtaagaatttgggactgcaggccagttacgatagctctcacctgtaatcccagcattttgggaggccgaggcaggcggatcacttgaggtcaggagttcaagaccagcctaaacaatatggcgaaacctcatctctaccaaaaaaatacaaagattagctgggcatggtgtctcatgcctgtagtcccagctacctatggggctgaggcaggaggatctcttgagcccaggaggtcgatgctgcattgagccgagattgtgccactgcactccagcgtgggcaacagagtgagactgtctcagggggaaaaaaaaagaggaaaacaaaaaagacgttgggagtgcagtttctctacctacagcatatctcaaaggttttttttaaaaaagtattttcttaactttttaccttcatttttcaaaacaattagggtacaatttacatatagtaaagttcactctttatagttttagttatgtgagtttgtacaaacatatacaggagtgaaccactaccacaatcgaaatatagttgcatcacccccctaaaactctccaggcccttttgtagtcaactcctacccccgaccctcagattctgctaaccactgatttgttttctgcccctatagttttgctttagtatgactgtcatatcaatagaatcatacaatgagtaggcttattttatgccttcaggttttaaaaattataaacatttacattacagtaaaattcactctggtatacagttctataaagctctgataaatgtgtagagttgtgtaaccaccaatgcaaccaaggtacagaacagtcctcttagcctctccctaccaaatttattcctgctactttgtagtcaaaaccagtcccctacacccaaaccctggcag

SEQ ID NO: 456667 - DNA, 4969 bp, Homo sapiens
  misc_feature (3456)..(3456): n is a, c, g, or t
  misc_feature (3510)..(3510): n is a, c, g, or t
  misc_feature (4769)..(4769): n is a, c, g, or t
  misc_feature (4861)..(4861): n is a, c, g, or t
gatccggaagtcggagcctagctgcgcgagagtttctgctcgctcaaccgagttgtcgtgttgccctcgcttctcagatccccgccggaagtgaagagagcaagcagatttgaacctatctgctttcaagctggtcatcatgatgaaacttagacacaaaaataaaaagccaggtgaaggttccaagggccacaagaagataagttggccctaccctcagcctgcaaagcaaaatgggaagaaagcaacctccaaagtgccctctgcacctcattttgttcaccccaatgatcatgccaatcgagaggctgaattaaagaagaagtgggttgaggagatgagggagaagcagcaagccgcccgggagcaagaaagacaaaaacgcaggaccattgagagctactgtcaggatgtcctaagacgccaggaggagtttgagcataaggaggaagttttgcaggaattaaatatgtttcctcagctggatgacgaggccacgaggaaggcttattacaaggagttccgtaaggtggtggaatactctgatgtgattctggaagtcctggatgccagagacccattaggctgccgctgcttccaaatggaggaggctgtcctgcgagcacaaggcaacaagaagctggtcctggtcttgaacaagattgacctggtccccaaggaggttgtggagaaatggctggattaccttcggaatgagttgccaaccgtggctttcaaggccagtacccagcatcaggtcaaaaacctgaatcgttgcagtgtgccagtagatcaggcctctgagtcactgctgaaaagcaaagcctgctttggagctgaaaacctcatgagggttctggggaactattgccgccttggtgaagtgcgcacccacattcgtgtgggtgttgtgggtcttcccaatgttgggaagagcagcctgatcaatagcctgaagcgcagccgcgcatgcagcgtgggagctgttcctggaattaccaaattcatgcaggaggtctacctggacaagttcatccggctcttggatgctccaggcattgtcccagggcccaactcagaggtgggcaccatcctgcgtaactgcgtccacgtgcagaagctggcagaccctgtgaccccagtggagaccatcctgcagcgctgcaacctggaggagatttccaactattatggcgtctctgggttccagaccactgagcactttctgacggcagtggcccaccgtttggggaagaagaagaagggaggcttatatagtcaggaacaggcggccaaagctgtcctagctgactgggtgagcgggaagatcagcttctatataccaccaccagccactcacactctgcccacccatctcagtgctgagatcgttaaggaaatgaccgaggtctttgacatcgaggatactgagcaggccaatgaagacaccatggaatgcttggccaccggagaatctgatgagctgttgggtgacacggacccacttgaaatggagatcaagttgctccattctccgatgacgaaaatagcagatgccattgaaaataaaaccaccgtgtataagattggagatctcactgggtattgcaccaatccgaaccgtcatcagatggggtgggctaaacgcaatgtggaccaccgccctaagagcaacagtatggtggatgtctgctcagtggaccgccgctcagtgctgcagaggatcatggagacggaccccctgcaacagggccaggctctggcatctgccctgaaaaataagaagaagatgcagaaacgtgcagataaaatcgccagcaagctgtctgattccatgatgtctgctctcgacctctctggcaatgctgatgatggtgttggtgactaatcgactgatctcacttcccttccgctccaagcaccagttccggtggtacgggggaataccagtgaaatagtttggttctccctgaagcatctgcatattgaaagaacgctttccccactgtgtgtcttctccccctcctccagtaaaaacagtcccggctgggtgctgtggctcacgtctgtaatcccagcactttgggaggccgaggtgggcggatcacctgaggtcgggagttcgagaccagcctggccaacatggtgaagccccgtctctactaaaaatacaaaaaaatttagccgtgcttggtggcacctgtaatcccagctacttgggaggctgaggcaggagaatcgcctgaacctgggagactaaggcaggagaatcgcctggacctgggaggcagaggttgcagtgagcccagacggcaccattgcactctagcctgggcaacaacacgaaactccgtccccaaaaaaaaaaaaaaaaaaatcccaaggggctgcagctgccaaacccaataccctctatttaacccctactctgttttacaagagaaataaaagaagtatcagcagagctcaggtgctaacacctgttgagggctgacctacaaaactctgcctacaaaactctcttagacaggtgaatatgccactagaagttaggttgctggtagacctgggggtccctgcgggagggtgatggtttctttaccaccccacaggagatttcagtggcaaggcatgcctgcagtgggctttgggccatgcatcttccaagtccataggtcttcacctgggtggcagtgagaaaaagtagaaagtaatgagcctcctgtgtctctggaaggttctagggatagggtagagggaagaagagaacaaacaagcctggcttgtgctgaagtgtggtaggcactaccctgtttgcgtgaagagaaaacaaagcacctgttagtagggaggctttagggggaagccccgtcttgggggcatttctgggcagattgtgaattggaggaatctctttaactgaagtactctggctggaccctgcccttgtgtgaccatgtctcctattgcaccagcatttgaattccatggctcaagagggttctggtaccatttattcacagactgtatcctcgagagagctgctatatatgggagtgtaccagccaactccttttccagtgtctgtaagtcacctcattaaagtataattagctgtctcctctgggagatcctaccccatcagacaagggcagtgagcccaagcagtgccagaggccctcagaaagggattagggtagatgattgcaactgaaacacaatcttctttctttgccagggtattttgggggttttgccccaaaatataccctgggcatagcattactgcagtcttggatgtctaccccaaacttccacaccatccttcgacccacagctgcacctttatttatttattttgctctgttgcccaggctggagtgcaatggcgtgatctcggctcactgcaacctctgcctcccgggttcaggtgatcctcctgccttagcctcccangtagctgggattacaggcacctgccaccacgcctggctagtttttgtatttttngtagagacgatgtttcaccatgttgaccaggctggtctcgaactcttgacctcaggtgatccgctcgcttcggcctcccaaagtgctgggattataggcgtgagccactgtgcccagcctcacagctgcatcttaaccttacctttgcctctgcctctcaagctggtacctcctaatttacatcctaagagtggaaccatgtgacaaggactggagtgccattggctgtggactgttcaggcagggaagtacaagaccactcttgtattcaggggcaaccaaaggagagaattacgtacttgttgagtacaaactgcaccaagccctggagacccattaccaccgttaaccctcaatacagctctgctagtaagggattcgtctccccaaatgaaaaaaaaaagtaatctcagaatgttggccgagcatggtggctcacacctgtagtcccagttatgcaggaggctgaggcaggagaatcgcttgatctcaggaggcggaggttgcagtgagtcgacatcacaccactgcactccagcctgggggacagagtgagacttcgtctcggaaaaaaaaaaaaaaagttgacaggatggccagacccaagtgggcgtattaagtggtggtgctaggattggaacccaagcgtgattaaaaccctatgcaggccctttcctctatattgtactgcctccttaacaaaggaagattgattaagcccctactttgtgccagtctctgttatcaagtccgttaaatgcatttaacgttaaattttttcttttttggtttaaaaaactctagtttcttaaactactagtttttagtgtcttgctaaaactatgtgctcttgaataggctacaacttatttcacactatctcattgaactctcctggtatgtgatagtgttataatgaaaaattgcataccaggacagctaagtctattttgcaaccatacagcgtttcataatttagcatttaaaatacagacagtccccgacttttggtggtttgatgtgggatttttggtggaaaagcagtatacattcagaatgcacctctacttatgatggggctacttcctggtaaacccattgtaatgtgcaaattacgggtttatcaggaggtgaccccatcggtaatggagaagtgctgggattataggcgtgagccactgtgcccagcctcacagctgcatcttaaccttacctttgcctctgcctctcaagctggtacctcctaatttacatcctangagtggaaccatgtgacaaggactggagtgccattggctgtggactgttcaggcagggaagtacaagaccactcttgtattcaggggcaacnaaaggagagaattacgtacttgttgagtacaaactgcaccaagccctggagacccattaccaccgttaaccctcaatacagctctgctagtaagggattcgtctcccc

SEQ ID NO: 456668 - DNA, 5445 bp, Homo sapiens
  misc_feature (3456)..(3456): n is a, c, g, or t
  misc_feature (3510)..(3510): n is a, c, g, or t
gatccggaagtcggagcctagctgcgcgagagtttctgctcgctcaaccgagttgtcgtgttgccctcgcttctcagatccccgccggaagtgaagagagcaagcagatttgaacctatctgctttcaagctggtcatcatgatgaaacttagacacaaaaataaaaagccaggtgaaggttccaagggccacaagaagataagttggccctaccctcagcctgcaaagcaaaatgggaagaaagcaacctccaaagtgccctctgcacctcattttgttcaccccaatgatcatgccaatcgagaggctgaattaaagaagaagtgggttgaggagatgagggagaagcagcaagccgcccgggagcaagaaagacaaaaacgcaggaccattgagagctactgtcaggatgtcctaagacgccaggaggagtttgagcataaggaggaagttttgcaggaattaaatatgtttcctcagctggatgacgaggccacgaggaaggcttattacaaggagttccgtaaggtggtggaatactctgatgtgattctggaagtcctggatgccagagacccattaggctgccgctgcttccaaatggaggaggctgtcctgcgagcacaaggcaacaagaagctggtcctggtcttgaacaagattgacctggtccccaaggaggttgtggagaaatggctggattaccttcggaatgagttgccaaccgtggctttcaaggccagtacccagcatcaggtcaaaaacctgaatcgttgcagtgtgccagtagatcaggcctctgagtcactgctgaaaagcaaagcctgctttggagctgaaaacctcatgagggttctggggaactattgccgccttggtgaagtgcgcacccacattcgtgtgggtgttgtgggtcttcccaatgttgggaagagcagcctgatcaatagcctgaagcgcagccgcgcatgcagcgtgggagctgttcctggaattaccaaattcatgcaggaggtctacctggacaagttcatccggctcttggatgctccaggcattgtcccagggcccaactcagaggtgggcaccatcctgcgtaactgcgtccacgtgcagaagctggcagaccctgtgaccccagtggagaccatcctgcagcgctgcaacctggaggagatttccaactattatggcgtctctgggttccagaccactgagcactttctgacggcagtggcccaccgtttggggaagaagaagaagggaggcttatatagtcaggaacaggcggccaaagctgtcctagctgactgggtgagcgggaagatcagcttctatataccaccaccagccactcacactctgcccacccatctcagtgctgagatcgttaaggaaatgaccgaggtctttgacatcgaggatactgagcaggccaatgaagacaccatggaatgcttggccaccggagaatctgatgagctgttgggtgacacggacccacttgaaatggagatcaagttgctccattctccgatgacgaaaatagcagatgccattgaaaataaaaccaccgtgtataagattggagatctcactgggtattgcaccaatccgaaccgtcatcagatggggtgggctaaacgcaatgtggaccaccgccctaagagcaacagtatggtggatgtctgctcagtggaccgccgctcagtgctgcagaggatcatggagacggaccccctgcaacagggccaggctctggcatctgccctgaaaaataagaagaagatgcagaaacgtgcagataaaatcgccagcaagctgtctgattccatgatgtctgctctcgacctctctggcaatgctgatgatggtgttggtgactaatcgactgatctcacttcccttccgctccaagcaccagttccggtggtacgggggaataccagtgaaatagtttggttctccctgaagcatctgcatattgaaagaacgctttccccactgtgtgtcttctccccctcctccagtaaaaacagtcccggctgggtgctgtggctcacgtctgtaatcccagcactttgggaggccgaggtgggcggatcacctgaggtcgggagttcgagaccagcctggccaacatggtgaagccccgtctctactaaaaatacaaaaaaatttagccgtgcttggtggcacctgtaatcccagctacttgggaggctgaggcaggagaatcgcctgaacctgggagactaaggcaggagaatcgcctggacctgggaggcagaggttgcagtgagcccagacggcaccattgcactctagcctgggcaacaacacgaaactccgtccccaaaaaaaaaaaaaaaaaaatcccaaggggctgcagctgccaaacccaataccctctatttaacccctactctgttttacaagagaaataaaagaagtatcagcagagctcaggtgctaacacctgttgagggctgacctacaaaactctgcctacaaaactctcttagacaggtgaatatgccactagaagttaggttgctggtagacctgggggtccctgcgggagggtgatggtttctttaccaccccacaggagatttcagtggcaaggcatgcctgcagtgggctttgggccatgcatcttccaagtccataggtcttcacctgggtggcagtgagaaaaagtagaaagtaatgagcctcctgtgtctctggaaggttctagggatagggtagagggaagaagagaacaaacaagcctggcttgtgctgaagtgtggtaggcactaccctgtttgcgtgaagagaaaacaaagcacctgttagtagggaggctttagggggaagccccgtcttgggggcatttctgggcagattgtgaattggaggaatctctttaactgaagtactctggctggaccctgcccttgtgtgaccatgtctcctattgcaccagcatttgaattccatggctcaagagggttctggtaccatttattcacagactgtatcctcgagagagctgctatatatgggagtgtaccagccaactccttttccagtgtctgtaagtcacctcattaaagtataattagctgtctcctctgggagatcctaccccatcagacaagggcagtgagcccaagcagtgccagaggccctcagaaagggattagggtagatgattgcaactgaaacacaatcttctttctttgccagggtattttgggggttttgccccaaaatataccctgggcatagcattactgcagtcttggatgtctaccccaaacttccacaccatccttcgacccacagctgcacctttatttatttattttgctctgttgcccaggctggagtgcaatggcgtgatctcggctcactgcaacctctgcctcccgggttcaggtgatcctcctgccttagcctcccangtagctgggattacaggcacctgccaccacgcctggctagtttttgtatttttngtagagacgatgtttcaccatgttgaccaggctggtctcgaactcttgacctcaggtgatccgctcgcttcggcctcccaaagtgctgggattataggcgtgagccactgtgcccagcctcacagctgcatcttaaccttacctttgcctctgcctctcaagctggtacctcctaatttacatcctaagagtggaaccatgtgacaaggactggagtgccattggctgtggactgttcaggcagggaagtacaagaccactcttgtattcaggggcaaccaaaggagagaattacgtacttgttgagtacaaacactccagcctgggggacagagtgagacttcgtctcggaaaaaaaaaaaaaaagttgacaggatggccagacccaagtgggcgtattaagtggtggtgctaggattggaacccaagcgtgattaaaaccctatgcaggccctttcctctatattgtactgcctccttaacaaaggaagattgattaagcccctactttgtgccagtctctgttatcaagtccgttaaatgcatttaacgttaaattttttcttttttggtttaaaaaactctagtttcttaaactactagtttttagtgtcttgctaaaactatgtgctcttgaataggctacaacttatttcacactatctcattgaactctcctggtatgtgatagtgttataatgaaaaattgcataccaggacagctaagtctattttgcaaccatacagcgtttcataatttagcatttaaaatacagacagtccccgacttttggtggtttgatgtgggatttttggtggaaaagcagtatacattcagaatgcacctctacttatgatggggctacttcctggtaaacccattgtaatgtgcaaattacgggtttatcaggaggtgaccccatcggtaatggagaagtgctgggaggtaaatattagaaatggaagtatctaaatgagtaagaaacagcatgggagcataatttggccaaaatcaaacagaactaaagtagtcatgtcggtaagaatttgggactgcaggccagttacgatagctctcacctgtaatcccagcattttgggaggccgaggcaggcggatcacttgaggtcaggagttcaagaccagcctaaacaatatggcgaaacctcatctctaccaaaaaaatacaaagattagctgggcatggtgtctcatgcctgtagtcccagctacctatggggctgaggcaggaggatctcttgagcccaggaggtcgatgctgcattgagccgagattgtgccactgcactccagcgtgggcaacagagtgagactgtctcagggggaaaaaaaaagaggaaaacaaaaaagacgttgggagtgcagtttctctacctacagcatatctcaaaggttttttttaaaaaagtattttcttaactttttaccttcatttttcaaaacaattagggtacaatttacatatagtaaagttcactctttatagttttagttatgtgagtttgtacaaacatatacaggagtgaaccactaccacaatcgaaatatagttgcatcacccccctaaaactctccaggcccttttgtagtcaactcctacccccgaccctcagattctgctaaccactgatttgttttctgcccctatagttttgctttagtatgactgtcatatcaatagaatcatacaatgagtaggcttattttatgccttcaggttttaaaaattataaacatttacattacagtaaaattcactctggtatacagttctataaagctctgataaatgtgtagagttgtgtaaccaccaatgcaaccaaggtacagaacagtcctcttagcctctccctaccaaatttattcctgctactttgtagtcaaaaccagtcccctacacccaaaccctggcag

SEQ ID NO: 456669 - DNA, 5747 bp, Homo sapiens
  misc_feature (3541)..(3541): n is a, c, g, or t
  misc_feature (3595)..(3595): n is a, c, g, or t
ccccccgccccccccccccccccccaacataggcagtagaggccgggttaatcggcagagggtagtaagaaacttctctcctcttttctcacaatgtgcgctcacctagacggccgggcagttaggatcgtctattggatgtgaaaccagagatgcccgccaacctggaatagagaggaagagagcaagcagatttgaacctatctgctttcaagctggtcatcatgatgaaacttagacacaaaaataaaaagccaggtgaaggttccaagggccacaagaagataagttggccctaccctcagcctgcaaagcaaaatgggaagaaagcaacctccaaagtgccctctgcacctcattttgttcaccccaatgatcatgccaatcgagaggctgaattaaagaagaagtgggttgaggagatgagggagaagcagcaagccgcccgggagcaagaaagacaaaaacgcaggaccattgagagctactgtcaggatgtcctaagacgccaggaggagtttgagcataaggaggaagttttgcaggaattaaatatgtttcctcagctggatgacgaggccacgaggaaggcttattacaaggagttccgtaaggtggtggaatactctgatgtgattctggaagtcctggatgccagagacccattaggctgccgctgcttccaaatggaggaggctgtcctgcgagcacaaggcaacaagaagctggtcctggtcttgaacaagattgacctggtccccaaggaggttgtggagaaatggctggattaccttcggaatgagttgccaaccgtggctttcaaggccagtacccagcatcaggtcaaaaacctgaatcgttgcagtgtgccagtagatcaggcctctgagtcactgctgaaaagcaaagcctgctttggagctgaaaacctcatgagggttctggggaactattgccgccttggtgaagtgcgcacccacattcgtgtgggtgttgtgggtcttcccaatgttgggaagagcagcctgatcaatagcctgaagcgcagccgcgcatgcagcgtgggagctgttcctggaattaccaaattcatgcaggaggtctacctggacaagttcatccggctcttggatgctccaggcattgtcccagggcccaactcagaggtgggcaccatcctgcgtaactgcgtccacgtgcagaagctggcagaccctgtgaccccagtggagaccatcctgcagcgctgcaacctggaggagatttccaactattatggcgtctctgggttccagaccactgagcactttctgacggcagtggcccaccgtttggggaagaagaagaagggaggcttatatagtcaggaacaggcggccaaagctgtcctagctgactgggtgagcgggaagatcagcttctatataccaccaccagccactcacactctgcccacccatctcagtgctgagatcgttaaggaaatgaccgaggtctttgacatcgaggatactgagcaggccaatgaagacaccatggaatgcttggccaccggagaatctgatgagctgttgggtgacacggacccacttgaaatggagatcaagttgctccattctccgatgacgaaaatagcagatgccattgaaaataaaaccaccgtgtataagattggagatctcactgggtattgcaccaatccgaaccgtcatcagatggggtgggctaaacgcaatgtggaccaccgccctaagagcaacagtatggtggatgtctgctcagtggaccgccgctcagtgctgcagaggatcatggagacggaccccctgcaacagggccaggctctggcatctgccctgaaaaataagaagaagatgcagaaacgtgcagataaaatcgccagcaagctgtctgattccatgatgtctgctctcgacctctctggcaatgctgatgatggtgttggtgactaatcgactgatctcacttcccttccgctccaagcaccagttccggtggtacgggggaataccagtgaaatagtttggttctccctgaagcatctgcatattgaaagaacgctttccccactgtgtgtcttctccccctcctccagtaaaaacagtcccggctgggtgctgtggctcacgtctgtaatcccagcactttgggaggccgaggtgggcggatcacctgaggtcgggagttcgagaccagcctggccaacatggtgaagccccgtctctactaaaaatacaaaaaaatttagccgtgcttggtggcacctgtaatcccagctacttgggaggctgaggcaggagaatcgcctgaacctgggagactaaggcaggagaatcgcctggacctgggaggcagaggttgcagtgagcccagacggcaccattgcactctagcctgggcaacaacacgaaactccgtccccaaaaaaaaaaaaaaaaaaatcccaaggggctgcagctgccaaacccaataccctctatttaacccctactctgttttacaagagaaataaaagaagtatcagcagagctcaggtgctaacacctgttgagggctgacctacaaaactctgcctacaaaactctcttagacaggtgaatatgccactagaagttaggttgctggtagacctgggggtccctgcgggagggtgatggtttctttaccaccccacaggagatttcagtggcaaggcatgcctgcagtgggctttgggccatgcatcttccaagtccataggtcttcacctgggtggcagtgagaaaaagtagaaagtaatgagcctcctgtgtctctggaaggttctagggatagggtagagggaagaagagaacaaacaagcctggcttgtgctgaagtgtggtaggcactaccctgtttgcgtgaagagaaaacaaagcacctgttagtagggaggctttagggggaagccccgtcttgggggcatttctgggcagattgtgaattggaggaatctctttaactgaagtactctggctggaccctgcccttgtgtgaccatgtctcctattgcaccagcatttgaattccatggctcaagagggttctggtaccatttattcacagactgtatcctcgagagagctgctatatatgggagtgtaccagccaactccttttccagtgtctgtaagtcacctcattaaagtataattagctgtctcctctgggagatcctaccccatcagacaagggcagtgagcccaagcagtgccagaggccctcagaaagggattagggtagatgattgcaactgaaacacaatcttctttctttgccagggtattttgggggttttgccccaaaatataccctgggcatagcattactgcagtcttggatgtctaccccaaacttccacaccatccttcgacccacagctgcacctttatttatttattttgctctgttgcccaggctggagtgcaatggcgtgatctcggctcactgcaacctctgcctcccgggttcaggtgatcctcctgccttagcctcccangtagctgggattacaggcacctgccaccacgcctggctagtttttgtatttttngtagagacgatgtttcaccatgttgaccaggctggtctcgaactcttgacctcaggtgatccgctcgcttcggcctcccaaagtgctgggattataggcgtgagccactgtgcccagcctcacagctgcatcttaaccttacctttgcctctgcctctcaagctggtacctcctaatttacatcctaagagtggaaccatgtgacaaggactggagtgccattggctgtggactgttcaggcagggaagtacaagaccactcttgtattcaggggcaaccaaaggagagaattacgtacttgttgagtacaaactgcaccaagccctggagacccattaccaccgttaaccctcaatacagctctgctagtaagggattcgtctccccaaatgaaaaaaaaaagtaatctcagaatgttggccgagcatggtggctcacacctgtagtcccagttatgcaggaggctgaggcaggagaatcgcttgatctcaggaggcggaggttgcagtgagtcgacatcacaccactgcactccagcctgggggacagagtgagacttcgtctcggaaaaaaaaaaaaaaagttgacaggatggccagacccaagtgggcgtattaagtggtggtgctaggattggaacccaagcgtgattaaaaccctatgcaggccctttcctctatattgtactgcctccttaacaaaggaagattgattaagcccctactttgtgccagtctctgttatcaagtccgttaaatgcatttaacgttaaattttttcttttttggtttaaaaaactctagtttcttaaactactagtttttagtgtcttgctaaaactatgtgctcttgaataggctacaacttatttcacactatctcattgaactctcctggtatgtgatagtgttataatgaaaaattgcataccaggacagctaagtctattttgcaaccatacagcgtttcataatttagcatttaaaatacagacagtccccgacttttggtggtttgatgtgggatttttggtggaaaagcagtatacattcagaatgcacctctacttatgatggggctacttcctggtaaacccattgtaatgtgcaaattacgggtttatcaggaggtgaccccatcggtaatggagaagtgctgggaggtaaatattagaaatggaagtatctaaatgagtaagaaacagcatgggagcataatttggccaaaatcaaacagaactaaagtagtcatgtcggtaagaatttgggactgcaggccagttacgatagctctcacctgtaatcccagcattttgggaggccgaggcaggcggatcacttgaggtcaggagttcaagaccagcctaaacaatatggcgaaacctcatctctaccaaaaaaatacaaagattagctgggcatggtgtctcatgcctgtagtcccagctacctatggggctgaggcaggaggatctcttgagcccaggaggtcgatgctgcattgagccgagattgtgccactgcactccagcgtgggcaacagagtgagactgtctcagggggaaaaaaaaagaggaaaacaaaaaagacgttgggagtgcagtttctctacctacagcatatctcaaaggttttttttaaaaaagtattttcttaactttttaccttcatttttcaaaacaattagggtacaatttacatatagtaaagttcactctttatagttttagttatgtgagtttgtacaaacatatacaggagtgaaccactaccacaatcgaaatatagttgcatcacccccctaaaactctccaggcccttttgtagtcaactcctacccccgaccctcagattctgctaaccactgatttgttttctgcccctatagttttgctttagtatgactgtcatatcaatagaatcatacaatgagtaggcttattttatgccttcaggttttaaaaattataaacatttacattacagtaaaattcactctggtatacagttctataaagctctgataaatgtgtagagttgtgtaaccaccaatgcaaccaaggtacagaacagtcctcttagcctctccctaccaaatttattcctgctactttgtagtcaaaaccagtcccctacacccaaaccctggcag

SEQ ID NO: 456670 - DNA, 4674 bp, Homo sapiens
  misc_feature (3456)..(3456): n is a, c, g, or t
  misc_feature (3510)..(3510): n is a, c, g, or t
gatccggaagtcggagcctagctgcgcgagagtttctgctcgctcaaccgagttgtcgtgttgccctcgcttctcagatccccgccggaagtgaagagagcaagcagatttgaacctatctgctttcaagctggtcatcatgatgaaacttagacacaaaaataaaaagccaggtgaaggttccaagggccacaagaagataagttggccctaccctcagcctgcaaagcaaaatgggaagaaagcaacctccaaagtgccctctgcacctcattttgttcaccccaatgatcatgccaatcgagaggctgaattaaagaagaagtgggttgaggagatgagggagaagcagcaagccgcccgggagcaagaaagacaaaaacgcaggaccattgagagctactgtcaggatgtcctaagacgccaggaggagtttgagcataaggaggaagttttgcaggaattaaatatgtttcctcagctggatgacgaggccacgaggaaggcttattacaaggagttccgtaaggtggtggaatactctgatgtgattctggaagtcctggatgccagagacccattaggctgccgctgcttccaaatggaggaggctgtcctgcgagcacaaggcaacaagaagctggtcctggtcttgaacaagattgacctggtccccaaggaggttgtggagaaatggctggattaccttcggaatgagttgccaaccgtggctttcaaggccagtacccagcatcaggtcaaaaacctgaatcgttgcagtgtgccagtagatcaggcctctgagtcactgctgaaaagcaaagcctgctttggagctgaaaacctcatgagggttctggggaactattgccgccttggtgaagtgcgcacccacattcgtgtgggtgttgtgggtcttcccaatgttgggaagagcagcctgatcaatagcctgaagcgcagccgcgcatgcagcgtgggagctgttcctggaattaccaaattcatgcaggaggtctacctggacaagttcatccggctcttggatgctccaggcattgtcccagggcccaactcagaggtgggcaccatcctgcgtaactgcgtccacgtgcagaagctggcagaccctgtgaccccagtggagaccatcctgcagcgctgcaacctggaggagatttccaactattatggcgtctctgggttccagaccactgagcactttctgacggcagtggcccaccgtttggggaagaagaagaagggaggcttatatagtcaggaacaggcggccaaagctgtcctagctgactgggtgagcgggaagatcagcttctatataccaccaccagccactcacactctgcccacccatctcagtgctgagatcgttaaggaaatgaccgaggtctttgacatcgaggatactgagcaggccaatgaagacaccatggaatgcttggccaccggagaatctgatgagctgttgggtgacacggacccacttgaaatggagatcaagttgctccattctccgatgacgaaaatagcagatgccattgaaaataaaaccaccgtgtataagattggagatctcactgggtattgcaccaatccgaaccgtcatcagatggggtgggctaaacgcaatgtggaccaccgccctaagagcaacagtatggtggatgtctgctcagtggaccgccgctcagtgctgcagaggatcatggagacggaccccctgcaacagggccaggctctggcatctgccctgaaaaataagaagaagatgcagaaacgtgcagataaaatcgccagcaagctgtctgattccatgatgtctgctctcgacctctctggcaatgctgatgatggtgttggtgactaatcgactgatctcacttcccttccgctccaagcaccagttccggtggtacgggggaataccagtgaaatagtttggttctccctgaagcatctgcatattgaaagaacgctttccccactgtgtgtcttctccccctcctccagtaaaaacagtcccggctgggtgctgtggctcacgtctgtaatcccagcactttgggaggccgaggtgggcggatcacctgaggtcgggagttcgagaccagcctggccaacatggtgaagccccgtctctactaaaaatacaaaaaaatttagccgtgcttggtggcacctgtaatcccagctacttgggaggctgaggcaggagaatcgcctgaacctgggagactaaggcaggagaatcgcctggacctgggaggcagaggttgcagtgagcccagacggcaccattgcactctagcctgggcaacaacacgaaactccgtccccaaaaaaaaaaaaaaaaaaatcccaaggggctgcagctgccaaacccaataccctctatttaacccctactctgttttacaagagaaataaaagaagtatcagcagagctcaggtgctaacacctgttgagggctgacctacaaaactctgcctacaaaactctcttagacaggtgaatatgccactagaagttaggttgctggtagacctgggggtccctgcgggagggtgatggtttctttaccaccccacaggagatttcagtggcaaggcatgcctgcagtgggctttgggccatgcatcttccaagtccataggtcttcacctgggtggcagtgagaaaaagtagaaagtaatgagcctcctgtgtctctggaaggttctagggatagggtagagggaagaagagaacaaacaagcctggcttgtgctgaagtgtggtaggcactaccctgtttgcgtgaagagaaaacaaagcacctgttagtagggaggctttagggggaagccccgtcttgggggcatttctgggcagattgtgaattggaggaatctctttaactgaagtactctggctggaccctgcccttgtgtgaccatgtctcctattgcaccagcatttgaattccatggctcaagagggttctggtaccatttattcacagactgtatcctcgagagagctgctatatatgggagtgtaccagccaactccttttccagtgtctgtaagtcacctcattaaagtataattagctgtctcctctgggagatcctaccccatcagacaagggcagtgagcccaagcagtgccagaggccctcagaaagggattagggtagatgattgcaactgaaacacaatcttctttctttgccagggtattttgggggttttgccccaaaatataccctgggcatagcattactgcagtcttggatgtctaccccaaacttccacaccatccttcgacccacagctgcacctttatttatttattttgctctgttgcccaggctggagtgcaatggcgtgatctcggctcactgcaacctctgcctcccgggttcaggtgatcctcctgccttagcctcccangtagctgggattacaggcacctgccaccacgcctggctagtttttgtatttttngtagagacgatgtttcaccatgttgaccaggctggtctcgaactcttgacctcaggtgatccgctcgcttcggcctcccaaagtgctgggattataggcgtgagccactgtgcccagcctcacagctgcatcttaaccttacctttgcctctgcctctcaagctggtacctcctaatttacatcctaagagtggaaccatgtgacaaggactggagtgccattggctgtggactgttcaggcagggaagtacaagaccactcttgtattcaggggcaaccaaaggagagaattacgtacttgttgagtacaaactgcaccaagccctggagacccattaccaccgttaaccctcaatacagctctgctagtaagggattcgtctccccaaatgaaaaaaaaaagtaatctcagaatgttggccgagcatggtggctcacacctgtagtcccacctcccgagtaacagggactacaggtgcccaccaccatgctgggctaatttttgtatttttggtagaggcgggggtttctccacactggccaggctggtcttgaacttctgacctcaagggatccacccgcctcggcctcccaaagtgctgggattataggcatgaaccaccgtgtccggccatatattttcgtcttttgaagactgttatatacatgaaattatatggtatgtagcattttgagagcgacttcttttgctatgagtaatacatttgagattcatccatatttctcagtatattaatagttcttatttctgagtcactccattgtgtggatttactactgtttgttccccagttgaaggatgtttaggatctttgcagttttggacaattacaagtaaagctgctataaacatttgtatgcaaattttgtgttttcatttatctatagtaaatacctagagttggattgctgggatatatggtaagcatatgtttgacattttaagaaacttctaaactgtttttcaaagtggctctaccatttcacattcccatcagtatgaaagtttcatttccacatcctctctagtacttgggggtgtcagtttagttttttaatttttaaattttttaatttttttaatacatttaaatagagatggggtctcactgtgttgaccaggatggtcttgaactgctggc

SEQ ID NO: 456671 - DNA, 4082 bp, Homo sapiens
  misc_feature (3456)..(3456): n is a, c, g, or t
  misc_feature (3510)..(3510): n is a, c, g, or t
gatccggaagtcggagcctagctgcgcgagagtttctgctcgctcaaccgagttgtcgtgttgccctcgcttctcagatccccgccggaagtgaagagagcaagcagatttgaacctatctgctttcaagctggtcatcatgatgaaacttagacacaaaaataaaaagccaggtgaaggttccaagggccacaagaagataagttggccctaccctcagcctgcaaagcaaaatgggaagaaagcaacctccaaagtgccctctgcacctcattttgttcaccccaatgatcatgccaatcgagaggctgaattaaagaagaagtgggttgaggagatgagggagaagcagcaagccgcccgggagcaagaaagacaaaaacgcaggaccattgagagctactgtcaggatgtcctaagacgccaggaggagtttgagcataaggaggaagttttgcaggaattaaatatgtttcctcagctggatgacgaggccacgaggaaggcttattacaaggagttccgtaaggtggtggaatactctgatgtgattctggaagtcctggatgccagagacccattaggctgccgctgcttccaaatggaggaggctgtcctgcgagcacaaggcaacaagaagctggtcctggtcttgaacaagattgacctggtccccaaggaggttgtggagaaatggctggattaccttcggaatgagttgccaaccgtggctttcaaggccagtacccagcatcaggtcaaaaacctgaatcgttgcagtgtgccagtagatcaggcctctgagtcactgctgaaaagcaaagcctgctttggagctgaaaacctcatgagggttctggggaactattgccgccttggtgaagtgcgcacccacattcgtgtgggtgttgtgggtcttcccaatgttgggaagagcagcctgatcaatagcctgaagcgcagccgcgcatgcagcgtgggagctgttcctggaattaccaaattcatgcaggaggtctacctggacaagttcatccggctcttggatgctccaggcattgtcccagggcccaactcagaggtgggcaccatcctgcgtaactgcgtccacgtgcagaagctggcagaccctgtgaccccagtggagaccatcctgcagcgctgcaacctggaggagatttccaactattatggcgtctctgggttccagaccactgagcactttctgacggcagtggcccaccgtttggggaagaagaagaagggaggcttatatagtcaggaacaggcggccaaagctgtcctagctgactgggtgagcgggaagatcagcttctatataccaccaccagccactcacactctgcccacccatctcagtgctgagatcgttaaggaaatgaccgaggtctttgacatcgaggatactgagcaggccaatgaagacaccatggaatgcttggccaccggagaatctgatgagctgttgggtgacacggacccacttgaaatggagatcaagttgctccattctccgatgacgaaaatagcagatgccattgaaaataaaaccaccgtgtataagattggagatctcactgggtattgcaccaatccgaaccgtcatcagatggggtgggctaaacgcaatgtggaccaccgccctaagagcaacagtatggtggatgtctgctcagtggaccgccgctcagtgctgcagaggatcatggagacggaccccctgcaacagggccaggctctggcatctgccctgaaaaataagaagaagatgcagaaacgtgcagataaaatcgccagcaagctgtctgattccatgatgtctgctctcgacctctctggcaatgctgatgatggtgttggtgactaatcgactgatctcacttcccttccgctccaagcaccagttccggtggtacgggggaataccagtgaaatagtttggttctccctgaagcatctgcatattgaaagaacgctttccccactgtgtgtcttctccccctcctccagtaaaaacagtcccggctgggtgctgtggctcacgtctgtaatcccagcactttgggaggccgaggtgggcggatcacctgaggtcgggagttcgagaccagcctggccaacatggtgaagccccgtctctactaaaaatacaaaaaaatttagccgtgcttggtggcacctgtaatcccagctacttgggaggctgaggcaggagaatcgcctgaacctgggagactaaggcaggagaatcgcctggacctgggaggcagaggttgcagtgagcccagacggcaccattgcactctagcctgggcaacaacacgaaactccgtccccaaaaaaaaaaaaaaaaaaatcccaaggggctgcagctgccaaacccaataccctctatttaacccctactctgttttacaagagaaataaaagaagtatcagcagagctcaggtgctaacacctgttgagggctgacctacaaaactctgcctacaaaactctcttagacaggtgaatatgccactagaagttaggttgctggtagacctgggggtccctgcgggagggtgatggtttctttaccaccccacaggagatttcagtggcaaggcatgcctgcagtgggctttgggccatgcatcttccaagtccataggtcttcacctgggtggcagtgagaaaaagtagaaagtaatgagcctcctgtgtctctggaaggttctagggatagggtagagggaagaagagaacaaacaagcctggcttgtgctgaagtgtggtaggcactaccctgtttgcgtgaagagaaaacaaagcacctgttagtagggaggctttagggggaagccccgtcttgggggcatttctgggcagattgtgaattggaggaatctctttaactgaagtactctggctggaccctgcccttgtgtgaccatgtctcctattgcaccagcatttgaattccatggctcaagagggttctggtaccatttattcacagactgtatcctcgagagagctgctatatatgggagtgtaccagccaactccttttccagtgtctgtaagtcacctcattaaagtataattagctgtctcctctgggagatcctaccccatcagacaagggcagtgagcccaagcagtgccagaggccctcagaaagggattagggtagatgattgcaactgaaacacaatcttctttctttgccagggtattttgggggttttgccccaaaatataccctgggcatagcattactgcagtcttggatgtctaccccaaacttccacaccatccttcgacccacagctgcacctttatttatttattttgctctgttgcccaggctggagtgcaatggcgtgatctcggctcactgcaacctctgcctcccgggttcaggtgatcctcctgccttagcctcccangtagctgggattacaggcacctgccaccacgcctggctagtttttgtatttttngtagagacgatgtttcaccatgttgaccaggctggtctcgaactcttgacctcaggtgatccgctcgcttcggcctcccaaagtgctgggattataggcgtgagccactgtgcccagcctcacagctgcatcttaaccttacctttgcctctgcctctcaagctggtacctcctaatttacatcctaagagtggaaccatgtgacaaggactggagtgccattggctgtggactgttcaggcagggaagtacaagaccactcttgtattcaggggcaaccaaaggagagaattacgtacttgttgagtacaaactgcaccaagccctggagacccattaccaccgttaaccctcaatacagctctgctagtaagggattcgtctccccaaatgaaaaaaaaaagtaatctcagcctcccgagtagctgggattatgggcgcccgccaccacgcccagctaatttttgtatttttagtagagatggggtttcactgttttggccaggctggtctcgaactcctgacctcatgatcctcctgcctcagcctcccaaagtgctgggattacaaga

SEQ ID NO: 456672 - DNA, 5663 bp, Homo sapiens
  misc_feature (3457)..(3457): n is a, c, g, or t
  misc_feature (3511)..(3511): n is a, c, g, or t
taacggctaggtacgagcctgggagtgaatcggccgaggctcgcccaacgagtttgcagtgtatgccctcgcactcagatccccgccggaagtgaagagagcaagcagatttgaacctatctgctttcaagctggtcatcatgatgaaacttagacacaaaaataaaaagccaggtgaaggttccaagggccacaagaagataagttggccctaccctcagcctgcaaagcaaaatgggaagaaagcaacctccaaagtgccctctgcacctcattttgttcaccccaatgatcatgccaatcgagaggctgaattaaagaagaagtgggttgaggagatgagggagaagcagcaagccgcccgggagcaagaaagacaaaaacgcaggaccattgagagctactgtcaggatgtcctaagacgccaggaggagtttgagcataaggaggaagttttgcaggaattaaatatgtttcctcagctggatgacgaggccacgaggaaggcttattacaaggagttccgtaaggtggtggaatactctgatgtgattctggaagtcctggatgccagagacccattaggctgccgctgcttccaaatggaggaggctgtcctgcgagcacaaggcaacaagaagctggtcctggtcttgaacaagattgacctggtccccaaggaggttgtggagaaatggctggattaccttcggaatgagttgccaaccgtggctttcaaggccagtacccagcatcaggtcaaaaacctgaatcgttgcagtgtgccagtagatcaggcctctgagtcactgctgaaaagcaaagcctgctttggagctgaaaacctcatgagggttctggggaactattgccgccttggtgaagtgcgcacccacattcgtgtgggtgttgtgggtcttcccaatgttgggaagagcagcctgatcaatagcctgaagcgcagccgcgcatgcagcgtgggagctgttcctggaattaccaaattcatgcaggaggtctacctggacaagttcatccggctcttggatgctccaggcattgtcccagggcccaactcagaggtgggcaccatcctgcgtaactgcgtccacgtgcagaagctggcagaccctgtgaccccagtggagaccatcctgcagcgctgcaacctggaggagatttccaactattatggcgtctctgggttccagaccactgagcactttctgacggcagtggcccaccgtttggggaagaagaagaagggaggcttatatagtcaggaacaggcggccaaagctgtcctagctgactgggtgagcgggaagatcagcttctatataccaccaccagccactcacactctgcccacccatctcagtgctgagatcgttaaggaaatgaccgaggtctttgacatcgaggatactgagcaggccaatgaagacaccatggaatgcttggccaccggagaatctgatgagctgttgggtgacacggacccacttgaaatggagatcaagttgctccattctccgatgacgaaaatagcagatgccattgaaaataaaaccaccgtgtataagattggagatctcactgggtattgcaccaatccgaaccgtcatcagatggggtgggctaaacgcaatgtggaccaccgccctaagagcaacagtatggtggatgtctgctcagtggaccgccgctcagtgctgcagaggatcatggagacggaccccctgcaacagggccaggctctggcatctgccctgaaaaataagaagaagatgcagaaacgtgcagataaaatcgccagcaagctgtctgattccatgatgtctgctctcgacctctctggcaatgctgatgatggtgttggtgactaatcgactgatctcacttcccttccgctccaagcaccagttccggtggtacgggggaataccagtgaaatagtttggttctccctgaagcatctgcatattgaaagaacgctttccccactgtgtgtcttctccccctcctccagtaaaaacagtcccggctgggtgctgtggctcacgtctgtaatcccagcactttgggaggccgaggtgggcggatcacctgaggtcgggagttcgagaccagcctggccaacatggtgaagccccgtctctactaaaaatacaaaaaaatttagccgtgcttggtggcacctgtaatcccagctacttgggaggctgaggcaggagaatcgcctgaacctgggagactaaggcaggagaatcgcctggacctgggaggcagaggttgcagtgagcccagacggcaccattgcactctagcctgggcaacaacacgaaactccgtccccaaaaaaaaaaaaaaaaaaatcccaaggggctgcagctgccaaacccaataccctctatttaacccctactctgttttacaagagaaataaaagaagtatcagcagagctcaggtgctaacacctgttgagggctgacctacaaaactctgcctacaaaactctcttagacaggtgaatatgccactagaagttaggttgctggtagacctgggggtccctgcgggagggtgatggtttctttaccaccccacaggagatttcagtggcaaggcatgcctgcagtgggctttgggccatgcatcttccaagtccataggtcttcacctgggtggcagtgagaaaaagtagaaagtaatgagcctcctgtgtctctggaaggttctagggatagggtagagggaagaagagaacaaacaagcctggcttgtgctgaagtgtggtaggcactaccctgtttgcgtgaagagaaaacaaagcacctgttagtagggaggctttagggggaagccccgtcttgggggcatttctgggcagattgtgaattggaggaatctctttaactgaagtactctggctggaccctgcccttgtgtgaccatgtctcctattgcaccagcatttgaattccatggctcaagagggttctggtaccatttattcacagactgtatcctcgagagagctgctatatatgggagtgtaccagccaactccttttccagtgtctgtaagtcacctcattaaagtataattagctgtctcctctgggagatcctaccccatcagacaagggcagtgagcccaagcagtgccagaggccctcagaaagggattagggtagatgattgcaactgaaacacaatcttctttctttgccagggtattttgggggttttgccccaaaatataccctgggcatagcattactgcagtcttggatgtctaccccaaacttccacaccatccttcgacccacagctgcacctttatttatttattttgctctgttgcccaggctggagtgcaatggcgtgatctcggctcactgcaacctctgcctcccgggttcaggtgatcctcctgccttagcctcccangtagctgggattacaggcacctgccaccacgcctggctagtttttgtatttttngtagagacgatgtttcaccatgttgaccaggctggtctcgaactcttgacctcaggtgatccgctcgcttcggcctcccaaagtgctgggattataggcgtgagccactgtgcccagcctcacagctgcatcttaaccttacctttgcctctgcctctcaagctggtacctcctaatttacatcctaagagtggaaccatgtgacaaggactggagtgccattggctgtggactgttcaggcagggaagtacaagaccactcttgtattcaggggcaaccaaaggagagaattacgtacttgttgagtacaaactgcaccaagccctggagacccattaccaccgttaaccctcaatacagctctgctagtaagggattcgtctccccaaatgaaaaaaaaaagtaatctcagaatgttggccgagcatggtggctcacacctgtagtcccagttatgcaggaggctgaggcaggagaatcgcttgatctcaggaggcggaggttgcagtgagtcgacatcacaccactgcactccagcctgggggacagagtgagacttcgtctcggaaaaaaaaaaaaaaagttgacaggatggccagacccaagtgggcgtattaagtggtggtgctaggattggaacccaagcgtgattaaaaccctatgcaggccctttcctctatattgtactgcctccttaacaaaggaagattgattaagcccctactttgtgccagtctctgttatcaagtccgttaaatgcatttaacgttaaattttttcttttttggtttaaaaaactctagtttcttaaactactagtttttagtgtcttgctaaaactatgtgctcttgaataggctacaacttatttcacactatctcattgaactctcctggtatgtgatagtgttataatgaaaaattgcataccaggacagctaagtctattttgcaaccatacagcgtttcataatttagcatttaaaatacagacagtccccgacttttggtggtttgatgtgggatttttggtggaaaagcagtatacattcagaatgcacctctacttatgatggggctacttcctggtaaacccattgtaatgtgcaaattacgggtttatcaggaggtgaccccatcggtaatggagaagtgctgggaggtaaatattagaaatggaagtatctaaatgagtaagaaacagcatgggagcataatttggccaaaatcaaacagaactaaagtagtcatgtcggtaagaatttgggactgcaggccagttacgatagctctcacctgtaatcccagcattttgggaggccgaggcaggcggatcacttgaggtcaggagttcaagaccagcctaaacaatatggcgaaacctcatctctaccaaaaaaatacaaagattagctgggcatggtgtctcatgcctgtagtcccagctacctatggggctgaggcaggaggatctcttgagcccaggaggtcgatgctgcattgagccgagattgtgccactgcactccagcgtgggcaacagagtgagactgtctcagggggaaaaaaaaagaggaaaacaaaaaagacgttgggagtgcagtttctctacctacagcatatctcaaaggttttttttaaaaaagtattttcttaactttttaccttcatttttcaaaacaattagggtacaatttacatatagtaaagttcactctttatagttttagttatgtgagtttgtacaaacatatacaggagtgaaccactaccacaatcgaaatatagttgcatcacccccctaaaactctccaggcccttttgtagtcaactcctacccccgaccctcagattctgctaaccactgatttgttttctgcccctatagttttgctttagtatgactgtcatatcaatagaatcatacaatgagtaggcttattttatgccttcaggttttaaaaattataaacatttacattacagtaaaattcactctggtatacagttctataaagctctgataaatgtgtagagttgtgtaaccaccaatgcaaccaaggtacagaacagtcctcttagcctctccctaccaaatttattcctgctactttgtagtcaaaaccagtcccctacacccaaaccctggcag

SEQ ID NO: 456673 - DNA, 5651 bp, Homo sapiens
  misc_feature (3445)..(3445): n is a, c, g, or t
  misc_feature (3499)..(3499): n is a, c, g, or t
aggtactctagagcgtccccgaagtcttgctccccatcaggtcgtagaagctgcactgagcctgacaagagttggtactcaaaaatgcagaatgaattagtttgaatgaggtgattaaggattaatgagtagtggttaaggaaacaaagaccattagtggatggggtaatattgctgtattactgatgggacgaagatgcgcccatcagcctgcaaagcaaaatgggaagaaagcaacctccaaagtgccctctgcacctcattttgttcaccccaatgatcatgccaatcgagaggctgaattaaagaagaagtgggttgaggagatgagggagaagcagcaagccgcccgggagcaagaaagacaaaaacgcaggaccattgagagctactgtcaggatgtcctaagacgccaggaggagtttgagcataaggaggaagttttgcaggaattaaatatgtttcctcagctggatgacgaggccacgaggaaggcttattacaaggagttccgtaaggtggtggaatactctgatgtgattctggaagtcctggatgccagagacccattaggctgccgctgcttccaaatggaggaggctgtcctgcgagcacaaggcaacaagaagctggtcctggtcttgaacaagattgacctggtccccaaggaggttgtggagaaatggctggattaccttcggaatgagttgccaaccgtggctttcaaggccagtacccagcatcaggtcaaaaacctgaatcgttgcagtgtgccagtagatcaggcctctgagtcactgctgaaaagcaaagcctgctttggagctgaaaacctcatgagggttctggggaactattgccgccttggtgaagtgcgcacccacattcgtgtgggtgttgtgggtcttcccaatgttgggaagagcagcctgatcaatagcctgaagcgcagccgcgcatgcagcgtgggagctgttcctggaattaccaaattcatgcaggaggtctacctggacaagttcatccggctcttggatgctccaggcattgtcccagggcccaactcagaggtgggcaccatcctgcgtaactgcgtccacgtgcagaagctggcagaccctgtgaccccagtggagaccatcctgcagcgctgcaacctggaggagatttccaactattatggcgtctctgggttccagaccactgagcactttctgacggcagtggcccaccgtttggggaagaagaagaagggaggcttatatagtcaggaacaggcggccaaagctgtcctagctgactgggtgagcgggaagatcagcttctatataccaccaccagccactcacactctgcccacccatctcagtgctgagatcgttaaggaaatgaccgaggtctttgacatcgaggatactgagcaggccaatgaagacaccatggaatgcttggccaccggagaatctgatgagctgttgggtgacacggacccacttgaaatggagatcaagttgctccattctccgatgacgaaaatagcagatgccattgaaaataaaaccaccgtgtataagattggagatctcactgggtattgcaccaatccgaaccgtcatcagatggggtgggctaaacgcaatgtggaccaccgccctaagagcaacagtatggtggatgtctgctcagtggaccgccgctcagtgctgcagaggatcatggagacggaccccctgcaacagggccaggctctggcatctgccctgaaaaataagaagaagatgcagaaacgtgcagataaaatcgccagcaagctgtctgattccatgatgtctgctctcgacctctctggcaatgctgatgatggtgttggtgactaatcgactgatctcacttcccttccgctccaagcaccagttccggtggtacgggggaataccagtgaaatagtttggttctccctgaagcatctgcatattgaaagaacgctttccccactgtgtgtcttctccccctcctccagtaaaaacagtcccggctgggtgctgtggctcacgtctgtaatcccagcactttgggaggccgaggtgggcggatcacctgaggtcgggagttcgagaccagcctggccaacatggtgaagccccgtctctactaaaaatacaaaaaaatttagccgtgcttggtggcacctgtaatcccagctacttgggaggctgaggcaggagaatcgcctgaacctgggagactaaggcaggagaatcgcctggacctgggaggcagaggttgcagtgagcccagacggcaccattgcactctagcctgggcaacaacacgaaactccgtccccaaaaaaaaaaaaaaaaaaatcccaaggggctgcagctgccaaacccaataccctctatttaacccctactctgttttacaagagaaataaaagaagtatcagcagagctcaggtgctaacacctgttgagggctgacctacaaaactctgcctacaaaactctcttagacaggtgaatatgccactagaagttaggttgctggtagacctgggggtccctgcgggagggtgatggtttctttaccaccccacaggagatttcagtggcaaggcatgcctgcagtgggctttgggccatgcatcttccaagtccataggtcttcacctgggtggcagtgagaaaaagtagaaagtaatgagcctcctgtgtctctggaaggttctagggatagggtagagggaagaagagaacaaacaagcctggcttgtgctgaagtgtggtaggcactaccctgtttgcgtgaagagaaaacaaagcacctgttagtagggaggctttagggggaagccccgtcttgggggcatttctgggcagattgtgaattggaggaatctctttaactgaagtactctggctggaccctgcccttgtgtgaccatgtctcctattgcaccagcatttgaattccatggctcaagagggttctggtaccatttattcacagactgtatcctcgagagagctgctatatatgggagtgtaccagccaactccttttccagtgtctgtaagtcacctcattaaagtataattagctgtctcctctgggagatcctaccccatcagacaagggcagtgagcccaagcagtgccagaggccctcagaaagggattagggtagatgattgcaactgaaacacaatcttctttctttgccagggtattttgggggttttgccccaaaatataccctgggcatagcattactgcagtcttggatgtctaccccaaacttccacaccatccttcgacccacagctgcacctttatttatttattttgctctgttgcccaggctggagtgcaatggcgtgatctcggctcactgcaacctctgcctcccgggttcaggtgatcctcctgccttagcctcccangtagctgggattacaggcacctgccaccacgcctggctagtttttgtatttttngtagagacgatgtttcaccatgttgaccaggctggtctcgaactcttgacctcaggtgatccgctcgcttcggcctcccaaagtgctgggattataggcgtgagccactgtgcccagcctcacagctgcatcttaaccttacctttgcctctgcctctcaagctggtacctcctaatttacatcctaagagtggaaccatgtgacaaggactggagtgccattggctgtggactgttcaggcagggaagtacaagaccactcttgtattcaggggcaaccaaaggagagaattacgtacttgttgagtacaaactgcaccaagccctggagacccattaccaccgttaaccctcaatacagctctgctagtaagggattcgtctccccaaatgaaaaaaaaaagtaatctcagaatgttggccgagcatggtggctcacacctgtagtcccagttatgcaggaggctgaggcaggagaatcgcttgatctcaggaggcggaggttgcagtgagtcgacatcacaccactgcactccagcctgggggacagagtgagacttcgtctcggaaaaaaaaaaaaaaagttgacaggatggccagacccaagtgggcgtattaagtggtggtgctaggattggaacccaagcgtgattaaaaccctatgcaggccctttcctctatattgtactgcctccttaacaaaggaagattgattaagcccctactttgtgccagtctctgttatcaagtccgttaaatgcatttaacgttaaattttttcttttttggtttaaaaaactctagtttcttaaactactagtttttagtgtcttgctaaaactatgtgctcttgaataggctacaacttatttcacactatctcattgaactctcctggtatgtgatagtgttataatgaaaaattgcataccaggacagctaagtctattttgcaaccatacagcgtttcataatttagcatttaaaatacagacagtccccgacttttggtggtttgatgtgggatttttggtggaaaagcagtatacattcagaatgcacctctacttatgatggggctacttcctggtaaacccattgtaatgtgcaaattacgggtttatcaggaggtgaccccatcggtaatggagaagtgctgggaggtaaatattagaaatggaagtatctaaatgagtaagaaacagcatgggagcataatttggccaaaatcaaacagaactaaagtagtcatgtcggtaagaatttgggactgcaggccagttacgatagctctcacctgtaatcccagcattttgggaggccgaggcaggcggatcacttgaggtcaggagttcaagaccagcctaaacaatatggcgaaacctcatctctaccaaaaaaatacaaagattagctgggcatggtgtctcatgcctgtagtcccagctacctatggggctgaggcaggaggatctcttgagcccaggaggtcgatgctgcattgagccgagattgtgccactgcactccagcgtgggcaacagagtgagactgtctcagggggaaaaaaaaagaggaaaacaaaaaagacgttgggagtgcagtttctctacctacagcatatctcaaaggttttttttaaaaaagtattttcttaactttttaccttcatttttcaaaacaattagggtacaatttacatatagtaaagttcactctttatagttttagttatgtgagtttgtacaaacatatacaggagtgaaccactaccacaatcgaaatatagttgcatcacccccctaaaactctccaggcccttttgtagtcaactcctacccccgaccctcagattctgctaaccactgatttgttttctgcccctatagttttgctttagtatgactgtcatatcaatagaatcatacaatgagtaggcttattttatgccttcaggttttaaaaattataaacatttacattacagtaaaattcactctggtatacagttctataaagctctgataaatgtgtagagttgtgtaaccaccaatgcaaccaaggtacagaacagtcctcttagcctctccctaccaaatttattcctgctactttgtagtcaaaaccagtcccctacacccaaaccctggcag

SEQ ID NO: 456674 - DNA, 5177 bp, Homo sapiens
  misc_feature (2971)..(2971): n is a, c, g, or t
  misc_feature (3025)..(3025): n is a, c, g, or t
cctatccttttcctgccctcatctcctggtcctctgccctgcaggtggtggaatactctgatgtgattctggaagtcctggatgccagagacccattaggctgccgctgcttccaaatggaggaggctgtcctgcgagcacaaggcaacaagaagctggtcctggtcttgaacaagattgacctggtccccaaggaggttgtggagaaatggctggattaccttcggaatgagttgccaaccgtggctttcaaggccagtacccagcatcaggtcaaaaacctgaatcgttgcagtgtgccagtagatcaggcctctgagtcactgctgaaaagcaaagcctgctttggagctgaaaacctcatgagggttctggggaactattgccgccttggtgaagtgcgcacccacattcgtgtgggtgttgtgggtcttcccaatgttgggaagagcagcctgatcaatagcctgaagcgcagccgcgcatgcagcgtgggagctgttcctggaattaccaaattcatgcaggaggtctacctggacaagttcatccggctcttggatgctccaggcattgtcccagggcccaactcagaggtgggcaccatcctgcgtaactgcgtccacgtgcagaagctggcagaccctgtgaccccagtggagaccatcctgcagcgctgcaacctggaggagatttccaactattatggcgtctctgggttccagaccactgagcactttctgacggcagtggcccaccgtttggggaagaagaagaagggaggcttatatagtcaggaacaggcggccaaagctgtcctagctgactgggtgagcgggaagatcagcttctatataccaccaccagccactcacactctgcccacccatctcagtgctgagatcgttaaggaaatgaccgaggtctttgacatcgaggatactgagcaggccaatgaagacaccatggaatgcttggccaccggagaatctgatgagctgttgggtgacacggacccacttgaaatggagatcaagttgctccattctccgatgacgaaaatagcagatgccattgaaaataaaaccaccgtgtataagattggagatctcactgggtattgcaccaatccgaaccgtcatcagatggggtgggctaaacgcaatgtggaccaccgccctaagagcaacagtatggtggatgtctgctcagtggaccgccgctcagtgctgcagaggatcatggagacggaccccctgcaacagggccaggctctggcatctgccctgaaaaataagaagaagatgcagaaacgtgcagataaaatcgccagcaagctgtctgattccatgatgtctgctctcgacctctctggcaatgctgatgatggtgttggtgactaatcgactgatctcacttcccttccgctccaagcaccagttccggtggtacgggggaataccagtgaaatagtttggttctccctgaagcatctgcatattgaaagaacgctttccccactgtgtgtcttctccccctcctccagtaaaaacagtcccggctgggtgctgtggctcacgtctgtaatcccagcactttgggaggccgaggtgggcggatcacctgaggtcgggagttcgagaccagcctggccaacatggtgaagccccgtctctactaaaaatacaaaaaaatttagccgtgcttggtggcacctgtaatcccagctacttgggaggctgaggcaggagaatcgcctgaacctgggagactaaggcaggagaatcgcctggacctgggaggcagaggttgcagtgagcccagacggcaccattgcactctagcctgggcaacaacacgaaactccgtccccaaaaaaaaaaaaaaaaaaatcccaaggggctgcagctgccaaacccaataccctctatttaacccctactctgttttacaagagaaataaaagaagtatcagcagagctcaggtgctaacacctgttgagggctgacctacaaaactctgcctacaaaactctcttagacaggtgaatatgccactagaagttaggttgctggtagacctgggggtccctgcgggagggtgatggtttctttaccaccccacaggagatttcagtggcaaggcatgcctgcagtgggctttgggccatgcatcttccaagtccataggtcttcacctgggtggcagtgagaaaaagtagaaagtaatgagcctcctgtgtctctggaaggttctagggatagggtagagggaagaagagaacaaacaagcctggcttgtgctgaagtgtggtaggcactaccctgtttgcgtgaagagaaaacaaagcacctgttagtagggaggctttagggggaagccccgtcttgggggcatttctgggcagattgtgaattggaggaatctctttaactgaagtactctggctggaccctgcccttgtgtgaccatgtctcctattgcaccagcatttgaattccatggctcaagagggttctggtaccatttattcacagactgtatcctcgagagagctgctatatatgggagtgtaccagccaactccttttccagtgtctgtaagtcacctcattaaagtataattagctgtctcctctgggagatcctaccccatcagacaagggcagtgagcccaagcagtgccagaggccctcagaaagggattagggtagatgattgcaactgaaacacaatcttctttctttgccagggtattttgggggttttgccccaaaatataccctgggcatagcattactgcagtcttggatgtctaccccaaacttccacaccatccttcgacccacagctgcacctttatttatttattttgctctgttgcccaggctggagtgcaatggcgtgatctcggctcactgcaacctctgcctcccgggttcaggtgatcctcctgccttagcctcccangtagctgggattacaggcacctgccaccacgcctggctagtttttgtatttttngtagagacgatgtttcaccatgttgaccaggctggtctcgaactcttgacctcaggtgatccgctcgcttcggcctcccaaagtgctgggattataggcgtgagccactgtgcccagcctcacagctgcatcttaaccttacctttgcctctgcctctcaagctggtacctcctaatttacatcctaagagtggaaccatgtgacaaggactggagtgccattggctgtggactgttcaggcagggaagtacaagaccactcttgtattcaggggcaaccaaaggagagaattacgtacttgttgagtacaaactgcaccaagccctggagacccattaccaccgttaaccctcaatacagctctgctagtaagggattcgtctccccaaatgaaaaaaaaaagtaatctcagaatgttggccgagcatggtggctcacacctgtagtcccagttatgcaggaggctgaggcaggagaatcgcttgatctcaggaggcggaggttgcagtgagtcgacatcacaccactgcactccagcctgggggacagagtgagacttcgtctcggaaaaaaaaaaaaaaagttgacaggatggccagacccaagtgggcgtattaagtggtggtgctaggattggaacccaagcgtgattaaaaccctatgcaggccctttcctctatattgtactgcctccttaacaaaggaagattgattaagcccctactttgtgccagtctctgttatcaagtccgttaaatgcatttaacgttaaattttttcttttttggtttaaaaaactctagtttcttaaactactagtttttagtgtcttgctaaaactatgtgctcttgaataggctacaacttatttcacactatctcattgaactctcctggtatgtgatagtgttataatgaaaaattgcataccaggacagctaagtctattttgcaaccatacagcgtttcataatttagcatttaaaatacagacagtccccgacttttggtggtttgatgtgggatttttggtggaaaagcagtatacattcagaatgcacctctacttatgatggggctacttcctggtaaacccattgtaatgtgcaaattacgggtttatcaggaggtgaccccatcggtaatggagaagtgctgggaggtaaatattagaaatggaagtatctaaatgagtaagaaacagcatgggagcataatttggccaaaatcaaacagaactaaagtagtcatgtcggtaagaatttgggactgcaggccagttacgatagctctcacctgtaatcccagcattttgggaggccgaggcaggcggatcacttgaggtcaggagttcaagaccagcctaaacaatatggcgaaacctcatctctaccaaaaaaatacaaagattagctgggcatggtgtctcatgcctgtagtcccagctacctatggggctgaggcaggaggatctcttgagcccaggaggtcgatgctgcattgagccgagattgtgccactgcactccagcgtgggcaacagagtgagactgtctcagggggaaaaaaaaagaggaaaacaaaaaagacgttgggagtgcagtttctctacctacagcatatctcaaaggttttttttaaaaaagtattttcttaactttttaccttcatttttcaaaacaattagggtacaatttacatatagtaaagttcactctttatagttttagttatgtgagtttgtacaaacatatacaggagtgaaccactaccacaatcgaaatatagttgcatcacccccctaaaactctccaggcccttttgtagtcaactcctacccccgaccctcagattctgctaaccactgatttgttttctgcccctatagttttgctttagtatgactgtcatatcaatagaatcatacaatgagtaggcttattttatgccttcaggttttaaaaattataaacatttacattacagtaaaattcactctggtatacagttctataaagctctgataaatgtgtagagttgtgtaaccaccaatgcaaccaaggtacagaacagtcctcttagcctctccctaccaaatttattcctgctactttgtagtcaaaaccagtcccctacacccaaaccctggcag

SEQ ID NO: 456675 - DNA, 2698 bp, Homo sapiens
ccccccgccccccccccccccccccaacataggcagtagaggccgggttaatcggcagagggtagtaagaaacttctctcctcttttctcacaatgtgcgctcacctagacggccgggcagttaggatcgtctattggatgtgaaaccagagatgcccgccaacctggaatagagaggaagagagcaagcagatttgaacctatctgctttcaagctggtcatcatgatgaaacttagacacaaaaataaaaagccaggtgaaggttccaagggccacaagaagataagttggccctaccctcagcctgcaaagcaaaatgggaagaaagcaacctccaaagtgccctctgcacctcattttgttcaccccaatgatcatgccaatcgagaggctgaattaaagaagaagtgggttgaggagatgagggagaagcagcaagccgcccgggagcaagaaagacaaaaacgcaggaccattgagagctactgtcaggatgtcctaagacgccaggaggagtttgagcataaggaggaagttttgcaggaattaaatatgtttcctcagctggatgacgaggccacgaggaaggcttattacaaggagttccgtaaggtggtggaatactctgatgtgattctggaagtcctggatgccagagacccattaggctgccgctgcttccaaatggaggaggctgtcctgcgagcacaaggcaacaagaagctggtcctggtcttgaacaagattgacctggtccccaaggaggttgtggagaaatggctggattaccttcggaatgagttgccaaccgtggctttcaaggccagtacccagcatcaggtcaaaaacctgaatcgttgcagtgtgccagtagatcaggcctctgagtcactgctgaaaagcaaagcctgctttggagctgaaaacctcatgagggttctggggaactattgccgccttggtgaagtgcgcacccacattcgtgtgggtgttgtgggtcttcccaatgttgggaagagcagcctgatcaatagcctgaagcgcagccgcgcatgcagcgtgggagctgttcctggaattaccaaattcatgcaggaggtctacctggacaagttcatccggctcttggatgctccaggcattgtcccagggcccaactcagaggtgggcaccatcctgcgtaactgcgtccacgtgcagaagctggcagaccctgtgaccccagtggagaccatcctgcagcgctgcaacctggaggagatttccaactattatggcgtctctgggttccagaccactgagcactttctgacggcagtggcccaccgtttggggaagaagaagaagggaggcttatatagtcaggaacaggcggccaaagctgtcctagctgactgggtgagcgggaagatcagcttctatataccaccaccagccactcacactctgcccacccatctcagtgctgagatcgttaaggaaatgaccgaggtctttgacatcgaggatactgagcaggccaatgaagacaccatggaatgcttggccaccggagaatctgatgagctgttgggtgacacggacccacttgaaatggagatcaagttgctccattctccgatgacgaaaatagcagatgccattgaaaataaaaccaccgtgtataagattggagatctcactgggtattgcaccaatccgaaccgtcatcagatggggtgggctaaacgcaatgtggaccaccgccctaagagcaacagtatggtggatgtctgctcagtggaccgccgctcagtgctgcagaggatcatggagacggaccccctgcaacagggccaggctctggcatctgccctgaaaaataagaagaagatgcagaaacgtgcagataaaatcgccagcaagctgtctgattccatgatgtctgctctcgacctctctggcaatgctgatgatggtgttggtgactaatcgactgatctcacttcccttccgctccaagcaccagttccggtggtacgggggaataccagtgaaatagtttggttctccctgaagcatctgcatattgaaagaacgctttccccactgtgtgtcttctccccctcctccagtaaaaacagtcccggctgctgggattataggcatgaaccaccgtgtccggccatatattttcgtcttttgaagactgttatatacatgaaattatatggtatgtagcattttgagagcgacttcttttgctatgagtaatacatttgagattcatccatatttctcagtatattaatagttcttatttctgagtcactccattgtgtggatttactactgtttgttccccagttgaaggatgtttaggatctttgcagttttggacaattacaagtaaagctgctataaacatttgtatgcaaattttgtgttttcatttatctatagtaaatacctagagttggattgctgggatatatggtaagcatatgtttgacattttaagaaacttctaaactgtttttcaaagtggctctaccatttcacattcccatcagtatgaaagtttcatttccacatcctctctagtacttgggggtgtcagtttagttttttaatttttaaattttttaatttttttaatacatttaaatagagatggggtctcactgtgttgaccaggatggtcttgaactgctggc

SEQ ID NO: 456676 - DNA, 2560 bp, Homo sapiens
  misc_feature (354)..(354): n is a, c, g, or t
  misc_feature (408)..(408): n is a, c, g, or t
gatgattgcaactgagggcctctggcactgcttgggctcactgcccttgtctgatggggtaggatctgccagaggccctcagaaagggattagggtagatgattgcaactgaaacacaatcttctttctttgccagggtattttgggggttttgccccaaaatataccctgggcatagcattactgcagtcttggatgtctaccccaaacttccacaccatccttcgacccacagctgcacctttatttatttattttgctctgttgcccaggctggagtgcaatggcgtgatctcggctcactgcaacctctgcctcccgggttcaggtgatcctcctgccttagcctcccangtagctgggattacaggcacctgccaccacgcctggctagtttttgtatttttngtagagacgatgtttcaccatgttgaccaggctggtctcgaactcttgacctcaggtgatccgctcgcttcggcctcccaaagtgctgggattataggcgtgagccactgtgcccagcctcacagctgcatcttaaccttacctttgcctctgcctctcaagctggtacctcctaatttacatcctaagagtggaaccatgtgacaaggactggagtgccattggctgtggactgttcaggcagggaagtacaagaccactcttgtattcaggggcaaccaaaggagagaattacgtacttgttgagtacaaactgcaccaagccctggagacccattaccaccgttaaccctcaatacagctctgctagtaagggattcgtctccccaaatgaaaaaaaaaagtaatctcagaatgttggccgagcatggtggctcacacctgtagtcccagttatgcaggaggctgaggcaggagaatcgcttgatctcaggaggcggaggttgcagtgagtcgacatcacaccactgcactccagcctgggggacagagtgagacttcgtctcggaaaaaaaaaaaaaaagttgacaggatggccagacccaagtgggcgtattaagtggtggtgctaggattggaacccaagcgtgattaaaaccctatgcaggccctttcctctatattgtactgcctccttaacaaaggaagattgattaagcccctactttgtgccagtctctgttatcaagtccgttaaatgcatttaacgttaaattttttcttttttggtttaaaaaactctagtttcttaaactactagtttttagtgtcttgctaaaactatgtgctcttgaataggctacaacttatttcacactatctcattgaactctcctggtatgtgatagtgttataatgaaaaattgcataccaggacagctaagtctattttgcaaccatacagcgtttcataatttagcatttaaaatacagacagtccccgacttttggtggtttgatgtgggatttttggtggaaaagcagtatacattcagaatgcacctctacttatgatggggctacttcctggtaaacccattgtaatgtgcaaattacgggtttatcaggaggtgaccccatcggtaatggagaagtgctgggaggtaaatattagaaatggaagtatctaaatgagtaagaaacagcatgggagcataatttggccaaaatcaaacagaactaaagtagtcatgtcggtaagaatttgggactgcaggccagttacgatagctctcacctgtaatcccagcattttgggaggccgaggcaggcggatcacttgaggtcaggagttcaagaccagcctaaacaatatggcgaaacctcatctctaccaaaaaaatacaaagattagctgggcatggtgtctcatgcctgtagtcccagctacctatggggctgaggcaggaggatctcttgagcccaggaggtcgatgctgcattgagccgagattgtgccactgcactccagcgtgggcaacagagtgagactgtctcagggggaaaaaaaaagaggaaaacaaaaaagacgttgggagtgcagtttctctacctacagcatatctcaaaggttttttttaaaaaagtattttcttaactttttaccttcatttttcaaaacaattagggtacaatttacatatagtaaagttcactctttatagttttagttatgtgagtttgtacaaacatatacaggagtgaaccactaccacaatcgaaatatagttgcatcacccccctaaaactctccaggcccttttgtagtcaactcctacccccgaccctcagattctgctaaccactgatttgttttctgcccctatagttttgctttagtatgactgtcatatcaatagaatcatacaatgagtaggcttattttatgccttcaggttttaaaaattataaacatttacattacagtaaaattcactctggtatacagttctataaagctctgataaatgtgtagagttgtgtaaccaccaatgcaaccaaggtacagaacagtcctcttagcctctccctaccaaatttattcctgctactttgtagtcaaaaccagtcccctacacccaaaccctggcag

SEQ ID NO: 456677 - DNA, 2416 bp, Homo sapiens
ccccccgccccccccccccccccccaacataggcagtagaggccgggttaatcggcagagggtagtaagaaacttctctcctcttttctcacaatgtgcgctcacctagacggccgggcagttaggatcgtctattggatgtgaaaccagagatgcccgccaacctggaatagagaggaagagagcaagcagatttgaacctatctgctttcaagctggtcatcatgatgaaacttagacacaaaaataaaaagccaggtgaaggttccaagggccacaagaagataagttggccctaccctcagcctgcaaagcaaaatgggaagaaagcaacctccaaaccaaagtgctgggattataggcgtgagccactgtgcccagcctcacagctgcatcttaaccttacctttgcctctgcctctcaagctggtacctcctaatttacatcctaagagtggaaccatgtgacaaggactggagtgccattggctgtggactgttcaggcagggaagtacaagaccactcttgtattcaggggcaaccaaaggagagaattacgtacttgttgagtacaaactgcaccaagccctggagacccattaccaccgttaaccctcaatacagctctgctagtaagggattcgtctccccaaatgaaaaaaaaaagtaatctcagaatgttggccgagcatggtggctcacacctgtagtcccagttatgcaggaggctgaggcaggagaatcgcttgatctcaggaggcggaggttgcagtgagtcgacatcacaccactgcactccagcctgggggacagagtgagacttcgtctcggaaaaaaaaaaaaaaagttgacaggatggccagacccaagtgggcgtattaagtggtggtgctaggattggaacccaagcgtgattaaaaccctatgcaggccctttcctctatattgtactgcctccttaacaaaggaagattgattaagcccctactttgtgccagtctctgttatcaagtccgttaaatgcatttaacgttaaattttttcttttttggtttaaaaaactctagtttcttaaactactagtttttagtgtcttgctaaaactatgtgctcttgaataggctacaacttatttcacactatctcattgaactctcctggtatgtgatagtgttataatgaaaaattgcataccaggacagctaagtctattttgcaaccatacagcgtttcataatttagcatttaaaatacagacagtccccgacttttggtggtttgatgtgggatttttggtggaaaagcagtatacattcagaatgcacctctacttatgatggggctacttcctggtaaacccattgtaatgtgcaaattacgggtttatcaggaggtgaccccatcggtaatggagaagtgctgggaggtaaatattagaaatggaagtatctaaatgagtaagaaacagcatgggagcataatttggccaaaatcaaacagaactaaagtagtcatgtcggtaagaatttgggactgcaggccagttacgatagctctcacctgtaatcccagcattttgggaggccgaggcaggcggatcacttgaggtcaggagttcaagaccagcctaaacaatatggcgaaacctcatctctaccaaaaaaatacaaagattagctgggcatggtgtctcatgcctgtagtcccagctacctatggggctgaggcaggaggatctcttgagcccaggaggtcgatgctgcattgagccgagattgtgccactgcactccagcgtgggcaacagagtgagactgtctcagggggaaaaaaaaagaggaaaacaaaaaagacgttgggagtgcagtttctctacctacagcatatctcaaaggttttttttaaaaaagtattttcttaactttttaccttcatttttcaaaacaattagggtacaatttacatatagtaaagttcactctttatagttttagttatgtgagtttgtacaaacatatacaggagtgaaccactaccacaatcgaaatatagttgcatcacccccctaaaactctccaggcccttttgtagtcaactcctacccccgaccctcagattctgctaaccactgatttgttttctgcccctatagttttgctttagtatgactgtcatatcaatagaatcatacaatgagtaggcttattttatgccttcaggttttaaaaattataaacatttacattacagtaaaattcactctggtatacagttctataaagctctgataaatgtgtagagttgtgtaaccaccaatgcaaccaaggtacagaacagtcctcttagcctctccctaccaaatttattcctgctactttgtagtcaaaaccagtcccctacacccaaaccctggcag

SEQ ID NO: 456678 - DNA, 2178 bp, Homo sapiens
aacagagcgagactccgtctcaaaaaaaagaagacacgcatgtgcccacatacactttgaccctcgaactcttgacctcaggtgatccgctcgcttcggcctcccaaagtgctgggattataggcgtgagccactgtgcccagcctcacagctgcatcttaaccttacctttgcctctgcctctcaagctggtacctcctaatttacatcctaagagtggaaccatgtgacaaggactggagtgccattggctgtggactgttcaggcagggaagtacaagaccactcttgtattcaggggcaaccaaaggagagaattacgtacttgttgagtacaaactgcaccaagccctggagacccattaccaccgttaaccctcaatacagctctgctagtaagggattcgtctccccaaatgaaaaaaaaaagtaatctcagaatgttggccgagcatggtggctcacacctgtagtcccagttatgcaggaggctgaggcaggagaatcgcttgatctcaggaggcggaggttgcagtgagtcgacatcacaccactgcactccagcctgggggacagagtgagacttcgtctcggaaaaaaaaaaaaaaagttgacaggatggccagacccaagtgggcgtattaagtggtggtgctaggattggaacccaagcgtgattaaaaccctatgcaggccctttcctctatattgtactgcctccttaacaaaggaagattgattaagcccctactttgtgccagtctctgttatcaagtccgttaaatgcatttaacgttaaattttttcttttttggtttaaaaaactctagtttcttaaactactagtttttagtgtcttgctaaaactatgtgctcttgaataggctacaacttatttcacactatctcattgaactctcctggtatgtgatagtgttataatgaaaaattgcataccaggacagctaagtctattttgcaaccatacagcgtttcataatttagcatttaaaatacagacagtccccgacttttggtggtttgatgtgggatttttggtggaaaagcagtatacattcagaatgcacctctacttatgatggggctacttcctggtaaacccattgtaatgtgcaaattacgggtttatcaggaggtgaccccatcggtaatggagaagtgctgggaggtaaatattagaaatggaagtatctaaatgagtaagaaacagcatgggagcataatttggccaaaatcaaacagaactaaagtagtcatgtcggtaagaatttgggactgcaggccagttacgatagctctcacctgtaatcccagcattttgggaggccgaggcaggcggatcacttgaggtcaggagttcaagaccagcctaaacaatatggcgaaacctcatctctaccaaaaaaatacaaagattagctgggcatggtgtctcatgcctgtagtcccagctacctatggggctgaggcaggaggatctcttgagcccaggaggtcgatgctgcattgagccgagattgtgccactgcactccagcgtgggcaacagagtgagactgtctcagggggaaaaaaaaagaggaaaacaaaaaagacgttgggagtgcagtttctctacctacagcatatctcaaaggttttttttaaaaaagtattttcttaactttttaccttcatttttcaaaacaattagggtacaatttacatatagtaaagttcactctttatagttttagttatgtgagtttgtacaaacatatacaggagtgaaccactaccacaatcgaaatatagttgcatcacccccctaaaactctccaggcccttttgtagtcaactcctacccccgaccctcagattctgctaaccactgatttgttttctgcccctatagttttgctttagtatgactgtcatatcaatagaatcatacaatgagtaggcttattttatgccttcaggttttaaaaattataaacatttacattacagtaaaattcactctggtatacagttctataaagctctgataaatgtgtagagttgtgtaaccaccaatgcaaccaaggtacagaacagtcctcttagcctctccctaccaaatttattcctgctactttgtagtcaaaaccagtcccctacacccaaaccctggcag

SEQ ID NO: 456679 - DNA, 816 bp, Homo sapiens
tttgaaacagagtctcactctttcactgaggctggagtgcagtggcgtgatcttggctcactgcaacctccacctcctgggttcaagcgattctcctgccttagcctcccgagtaacagggactacaggtgcccaccaccatgctgggctaatttttgtatttttggtagaggcgggggtttctccacactggccaggctggtcttgaacttctgacctcaagggatccacccgcctcggcctcccaaagtgctgggattataggcatgaaccaccgtgtccggccatatattttcgtcttttgaagactgttatatacatgaaattatatggtatgtagcattttgagagcgacttcttttgctatgagtaatacatttgagattcatccatatttctcagtatattaatagttcttatttctgagtcactccattgtgtggatttactactgtttgttccccagttgaaggatgtttaggatctttgcagttttggacaattacaagtaaagctgctataaacatttgtatgcaaattttgtgttttcatttatctatagtaaatacctagagttggattgctgggatatatggtaagcatatgtttgacattttaagaaacttctaaactgtttttcaaagtggctctaccatttcacattcccatcagtatgaaagtttcatttccacatcctctctagtacttgggggtgtcagtttagttttttaatttttaaattttttaatttttttaatacatttaaatagagatggggtctcactgtgttgaccaggatggtcttgaactgctggc

SEQ ID NO: 456680 - DNA, 975 bp, Homo sapiens
cttcttctcccattctgacaggaagagagcaagcagatttgaacctatctgctttcaagctggtcatcatgatgaaacttagacacaaaaataaaaagccaggtgaaggttccaagggccacaagaagataagttggccctaccctcagcctgcaaagcaaaatgggaagaaagcaacctccaaagtgccctctgcacctcattttgttcaccccaatgatcatgccaatcgagaggctgaattaaagaagaagtgggttgaggagatgagggagaagcagcaagccgcccgggagcaagaaagacaaaaacgcaggaccattgagagctactgtcaggatgtcctaagacgccaggaggagtttgagcataaggaggaagttttgcaggaattaaatatgtttcctcaggctgggattataggcatgaaccaccgtgtccggccatatattttcgtcttttgaagactgttatatacatgaaattatatggtatgtagcattttgagagcgacttcttttgctatgagtaatacatttgagattcatccatatttctcagtatattaatagttcttatttctgagtcactccattgtgtggatttactactgtttgttccccagttgaaggatgtttaggatctttgcagttttggacaattacaagtaaagctgctataaacatttgtatgcaaattttgtgttttcatttatctatagtaaatacctagagttggattgctgggatatatggtaagcatatgtttgacattttaagaaacttctaaactgtttttcaaagtggctctaccatttcacattcccatcagtatgaaagtttcatttccacatcctctctagtacttgggggtgtcagtttagttttttaatttttaaattttttaatttttttaatacatttaaatagagatggggtctcactgtgttgaccaggatggtcttgaactgctggc

SEQ ID NO: 456681 - DNA, 725 bp, Homo sapiens
ccccccgccccccccccccccccccaacataggcagtagaggccgggttaatcggcagagggtagtaagaaacttctctcctcttttctcacaatgtgcgctcacctagacggccgggcagttaggatcgtctattggatgtgaaaccagagatgcccgccaacctggaatagagaggtaaacagcaggatcccttccagggtagaagggaccggaagaggggcagggatcgcggcacacgtggagacgcgccgaattgccttttcgcggagtggagtttgccgggagaggggcattgccccatcccacctagaaaggtgtagacccgggacacactgtgtagagaggcacaaacttcacttgtgtggtgaagcgttgatcgtcctcaagatagtgaggcttcattctgcattcaccttgtatagacaggagtcgacccaccaaaggcatgggggacatccaccccaaccgtgtagagacatctccctccacccagctgagcagcgcagacttctcccgacttaaggcacttccttggcttggctctagacagccgtctcgaggcacctcctcaggacagacagaggctttgatgtatctgcccccataccagcatagaggagcttagaaacatttaatatacagagggagggcacctcctccccatacgcgtagactcagagccctcagtatcgctccccaactcacccgtctaggaaagtggt

SEQ ID NO: 456682 - DNA, 531 bp, Homo sapiens
tgcagtagaggccagctccaggcaaggggccagagagaggaggagaaagtctggtcctggggagggaatcccagtgcctgccatttacagagcagcatcttgggccagagcattacagacatctgccatgtctcacagcagcccagtgtgaagagggcttgtggaattcccattttccacatgaggaagctgaagctctgagtccagctcccagcaagtgaatgtcctactgcaaaacccatgcttttaattcttggtgatgtggcctctcagcaggagtgaaaaagttcctgcacctgactcccctgggaagcatccatgtatccttttcactgaggcctgaccagggggctggcaacagaggggagccagggccctgacagtggtgttggttgtgttaaaggcttggccaccggagaatctgatgagctgttgggtgacacggacccacttgaaatggagatcaagttgctccattctccgatgacgaaaatagcagatgccattgaaaataaaaccaccgtgtataag

SEQ ID NO: 456683 - DNA, 5560 bp, Homo sapiens
  misc_feature (3456)..(3456): n is a, c, g, or t
  misc_feature (3510)..(3510): n is a, c, g, or t
  misc_feature (5360)..(5360): n is a, c, g, or t
  misc_feature (5452)..(5452): n is a, c, g, or t
gatccggaagtcggagcctagctgcgcgagagtttctgctcgctcaaccgagttgtcgtgttgccctcgcttctcagatccccgccggaagtgaagagagcaagcagatttgaacctatctgctttcaagctggtcatcatgatgaaacttagacacaaaaataaaaagccaggtgaaggttccaagggccacaagaagataagttggccctaccctcagcctgcaaagcaaaatgggaagaaagcaacctccaaagtgccctctgcacctcattttgttcaccccaatgatcatgccaatcgagaggctgaattaaagaagaagtgggttgaggagatgagggagaagcagcaagccgcccgggagcaagaaagacaaaaacgcaggaccattgagagctactgtcaggatgtcctaagacgccaggaggagtttgagcataaggaggaagttttgcaggaattaaatatgtttcctcagctggatgacgaggccacgaggaaggcttattacaaggagttccgtaaggtggtggaatactctgatgtgattctggaagtcctggatgccagagacccattaggctgccgctgcttccaaatggaggaggctgtcctgcgagcacaaggcaacaagaagctggtcctggtcttgaacaagattgacctggtccccaaggaggttgtggagaaatggctggattaccttcggaatgagttgccaaccgtggctttcaaggccagtacccagcatcaggtcaaaaacctgaatcgttgcagtgtgccagtagatcaggcctctgagtcactgctgaaaagcaaagcctgctttggagctgaaaacctcatgagggttctggggaactattgccgccttggtgaagtgcgcacccacattcgtgtgggtgttgtgggtcttcccaatgttgggaagagcagcctgatcaatagcctgaagcgcagccgcgcatgcagcgtgggagctgttcctggaattaccaaattcatgcaggaggtctacctggacaagttcatccggctcttggatgctccaggcattgtcccagggcccaactcagaggtgggcaccatcctgcgtaactgcgtccacgtgcagaagctggcagaccctgtgaccccagtggagaccatcctgcagcgctgcaacctggaggagatttccaactattatggcgtctctgggttccagaccactgagcactttctgacggcagtggcccaccgtttggggaagaagaagaagggaggcttatatagtcaggaacaggcggccaaagctgtcctagctgactgggtgagcgggaagatcagcttctatataccaccaccagccactcacactctgcccacccatctcagtgctgagatcgttaaggaaatgaccgaggtctttgacatcgaggatactgagcaggccaatgaagacaccatggaatgcttggccaccggagaatctgatgagctgttgggtgacacggacccacttgaaatggagatcaagttgctccattctccgatgacgaaaatagcagatgccattgaaaataaaaccaccgtgtataagattggagatctcactgggtattgcaccaatccgaaccgtcatcagatggggtgggctaaacgcaatgtggaccaccgccctaagagcaacagtatggtggatgtctgctcagtggaccgccgctcagtgctgcagaggatcatggagacggaccccctgcaacagggccaggctctggcatctgccctgaaaaataagaagaagatgcagaaacgtgcagataaaatcgccagcaagctgtctgattccatgatgtctgctctcgacctctctggcaatgctgatgatggtgttggtgactaatcgactgatctcacttcccttccgctccaagcaccagttccggtggtacgggggaataccagtgaaatagtttggttctccctgaagcatctgcatattgaaagaacgctttccccactgtgtgtcttctccccctcctccagtaaaaacagtcccggctgggtgctgtggctcacgtctgtaatcccagcactttgggaggccgaggtgggcggatcacctgaggtcgggagttcgagaccagcctggccaacatggtgaagccccgtctctactaaaaatacaaaaaaatttagccgtgcttggtggcacctgtaatcccagctacttgggaggctgaggcaggagaatcgcctgaacctgggagactaaggcaggagaatcgcctggacctgggaggcagaggttgcagtgagcccagacggcaccattgcactctagcctgggcaacaacacgaaactccgtccccaaaaaaaaaaaaaaaaaaatcccaaggggctgcagctgccaaacccaataccctctatttaacccctactctgttttacaagagaaataaaagaagtatcagcagagctcaggtgctaacacctgttgagggctgacctacaaaactctgcctacaaaactctcttagacaggtgaatatgccactagaagttaggttgctggtagacctgggggtccctgcgggagggtgatggtttctttaccaccccacaggagatttcagtggcaaggcatgcctgcagtgggctttgggccatgcatcttccaagtccataggtcttcacctgggtggcagtgagaaaaagtagaaagtaatgagcctcctgtgtctctggaaggttctagggatagggtagagggaagaagagaacaaacaagcctggcttgtgctgaagtgtggtaggcactaccctgtttgcgtgaagagaaaacaaagcacctgttagtagggaggctttagggggaagccccgtcttgggggcatttctgggcagattgtgaattggaggaatctctttaactgaagtactctggctggaccctgcccttgtgtgaccatgtctcctattgcaccagcatttgaattccatggctcaagagggttctggtaccatttattcacagactgtatcctcgagagagctgctatatatgggagtgtaccagccaactccttttccagtgtctgtaagtcacctcattaaagtataattagctgtctcctctgggagatcctaccccatcagacaagggcagtgagcccaagcagtgccagaggccctcagaaagggattagggtagatgattgcaactgaaacacaatcttctttctttgccagggtattttgggggttttgccccaaaatataccctgggcatagcattactgcagtcttggatgtctaccccaaacttccacaccatccttcgacccacagctgcacctttatttatttattttgctctgttgcccaggctggagtgcaatggcgtgatctcggctcactgcaacctctgcctcccgggttcaggtgatcctcctgccttagcctcccangtagctgggattacaggcacctgccaccacgcctggctagtttttgtatttttngtagagacgatgtttcaccatgttgaccaggctggtctcgaactcttgacctcaggtgatccgctcgcttcggcctcccaaagtgctgggattataggcgtgagccactgtgcccagcctcacagctgcatcttaaccttacctttgcctctgcctctcaagctggtacctcctaatttacatcctaagagtggaaccatgtgacaaggactggagtgccattggctgtggactgttcaggcagggaagtacaagaccactcttgtattcaggggcaaccaaaggagagaattacgtacttgttgagtacaaactgcaccaagccctggagacccattaccaccgttaaccctcaatacagctctgctagtaagggattcgtctccccaaatgaaaaaaaaaagtaatctcagaatgttggccgagcatggtggctcacacctgtagtcccagttatgcaggaggctgaggcaggagaatcgcttgatctcaggaggcggaggttgcagtgagtcgacatcacaccactgcactccagcctgggggacagagtgagacttcgtctcggaaaaaaaaaaaaaaagttgacaggatggccagacccaagtgggcgtattaagtggtggtgctaggattggaacccaagcgtgattaaaaccctatgcaggccctttcctctatattgtactgcctccttaacaaaggaagattgattaagcccctactttgtgccagtctctgttatcaagtccgttaaatgcatttaacgttaaattttttcttttttggtttaaaaaactctagtttcttaaactactagtttttagtgtcttgctaaaactatgtgctcttgaataggctacaacttatttcacactatctcattgaactctcctggtatgtgatagtgttataatgaaaaattgcataccaggacagctaagtctattttgcaaccatacagcgtttcataatttagcatttaaaatacagacagtccccgacttttggtggtttgatgtgggatttttggtggaaaagcagtatacattcagaatgcacctctacttatgatggggctacttcctggtaaacccattgtaatgtgcaaattacgggtttatcaggaggtgaccccatcggtaatggagaagtgctgggaggtaaatattagaaatggaagtatctaaatgagtaagaaacagcatgggagcataatttggccaaaatcaaacagaactaaagtagtcatgtcggtaagaatttgggactgcaggccagttacgatagctctcacctgtaatcccagcattttgggaggccgaggcaggcggatcacttgaggtcaggagttcaagaccagcctaaacaatatggcgaaacctcatctctaccaaaaaaatacaaagattagctgggcatggtgtctcatgcctgtagtcccagctacctatggggctgaggcaggaggatctcttgagcccaggaggtcgatgctgcattgagccgagattgtgccactgcactccagcgtgggcaacagagtgagactgtctcagggggaaaaaaaaagaggaaaacaaaaaagacgttgggagtgcagtttctctacctacagcatatctcaaaggttttttttaaaaaagtattttcttaactttttaccttcatttttcaaaacaattagggtacaatttacatatagtaaagttcactctttatagttttagttatgtgagtttgtacaaacatatacaggagtgaaccactaccacaatcgaaatatagttgcatcacccccctaaaactctccaggcccttttgtagtcaactcctaatttacatcctangagtggaaccatgtgacaaggactggagtgccattggctgtggactgttcaggcagggaagtacaagaccactcttgtattcaggggcaacnaaaggagagaattacgtacttgttgagtacaaactgcaccaagccctggagacccattaccaccgttaaccctcaatacagctctgctagtaagggattcgtctcccc

SEQ ID NO: 456684 - DNA, 4985 bp, Homo sapiens
gatccggaagtcggagcctagctgcgcgagagtttctgctcgctcaaccgagttgtcgtgttgccctcgcttctcagatccccgccggaagtgaagagagcaagcagatttgaacctatctgctttcaagctggtcatcatgatgaaacttagacacaaaaataaaaagccaggtgaaggttccaagggccacaagaagataagttggccctaccctcagcctgcaaagcaaaatgggaagaaagcaacctccaaagtgccctctgcacctcattttgttcaccccaatgatcatgccaatcgagaggctgaattaaagaagaagtgggttgaggagatgagggagaagcagcaagccgcccgggagcaagaaagacaaaaacgcaggaccattgagagctactgtcaggatgtcctaagacgccaggaggagtttgagcataaggaggaagttttgcaggaattaaatatgtttcctcagctggatgacgaggccacgaggaaggcttattacaaggagttccgtaaggtggtggaatactctgatgtgattctggaagtcctggatgccagagacccattaggctgccgctgcttccaaatggaggaggctgtcctgcgagcacaaggcaacaagaagctggtcctggtcttgaacaagattgacctggtccccaaggaggttgtggagaaatggctggattaccttcggaatgagttgccaaccgtggctttcaaggccagtacccagcatcaggtcaaaaacctgaatcgttgcagtgtgccagtagatcaggcctctgagtcactgctgaaaagcaaagcctgctttggagctgaaaacctcatgagggttctggggaactattgccgccttggtgaagtgcgcacccacattcgtgtgggtgttgtgggtcttcccaatgttgggaagagcagcctgatcaatagcctgaagcgcagccgcgcatgcagcgtgggagctgttcctggaattaccaaattcatgcaggaggtctacctggacaagttcatccggctcttggatgctccaggcattgtcccagggcccaactcagaggtgggcaccatcctgcgtaactgcgtccacgtgcagaagctggcagaccctgtgaccccagtggagaccatcctgcagcgctgcaacctggaggagatttccaactattatggcgtctctgggttccagaccactgagcactttctgacggcagtggcccaccgtttggggaagaagaagaagggaggcttatatagtcaggaacaggcggccaaagctgtcctagctgactgggtgagcgggaagatcagcttctatataccaccaccagccactcacactctgcccacccatctcagtgctgagatcgttaaggaaatgaccgaggtctttgacatcgaggatactgagcaggccaatgaagacaccatggaatgcttggccaccggagaatctgatgagctgttgggtgacacggacccacttgaaatggagatcaagttgctccattctccgatgacgaaaatagcagatgccattgaaaataaaaccaccgtgtataagattggagatctcactgggtattgcaccaatccgaaccgtcatcagatggggtgggctaaacgcaatgtggaccaccgccctaagagcaacagtatggtggatgtctgctcagtggaccgccgctcagtgctgcagaggatcatggagacggaccccctgcaacagggccaggctctggcatctgccctgaaaaataagaagaagatgcagaaacgtgcagataaaatcgccagcaagctgtctgattccatgatgtctgctctcgacctctctggcaatgctgatgatggtgttggtgactaatcgactgatctcacttcccttccgctccaagcaccagttccggtggtacgggggaataccagtgaaatagtttggttctccctgaagcatctgcatattgaaagaacgctttccccactgtgtgtcttctccccctcctccagtaaaaacagtcccggctgggtgctgtggctcacgtctgtaatcccagcactttgggaggccgaggtgggcggatcacctgaggtcgggagttcgagaccagcctggccaacatggtgaagccccgtctctactaaaaatacaaaaaaatttagccgtgcttggtggcacctgtaatcccagctacttgggaggctgaggcaggagaatcgcctgaacctgggagactaaggcaggagaatcgcctggacctgggaggcagaggttgcagtgagcccagacggcaccattgcactctagcctgggcaacaacacgaaactccgtccccaaaaaaaaaaaaaaaaaaatcccaaggggctgcagctgccaaacccaataccctctatttaacccctactctgttttacaagagaaataaaagaagtatcagcagagctcaggtgctaacacctgttgagggctgacctacaaaactctgcctacaaaactctcttagacaggtgaatatgccactagaagttaggttgctggtagacctgggggtccctgcgggagggtgatggtttctttaccaccccacaggagatttcagtggcaaggcatgcctgcagtgggctttgggccatgcatcttccaagtccataggtcttcacctgggtggcagtgagaaaaagtagaaagtaatgagcctcctgtgtctctggaaggttctagggatagggtagagggaagaagagaacaaacaagcctggcttgtgctgaagtgtggtaggcactaccctgtttgcgtgaagagaaaacaaagcacctgttagtagggaggctttagggggaagccccgtcttgggggcatttctgggcagattgtgaattggaggaatctctttaactgaagtactctggctggaccctgcccttgtgtgaccatgtctcctattgcaccagcatttgaattccatggctcaagagggttctggtaccatttattcacagactgtatcctcgagagagctgctatatatgggagtgtaccagccaactccttttccagtgtctgtaagtcacctcattaaagtataattagctgtctcctctgggagatcctaccccatcagacaagggcagtgagcccaagcagtgccagaggccctcagaaagggattagggtagatgattgcaactgaaacacaatcttctttctttgccagggtattttgggggttttgccccaaaatataccctgggcatagcattactgcagtcttggatgtctaccccaaacttccacaccatccttcgacccacagctgcacctttatttatttattttgctcactccagcctgggggacagagtgagacttcgtctcggaaaaaaaaaaaaaaagttgacaggatggccagacccaagtgggcgtattaagtggtggtgctaggattggaacccaagcgtgattaaaaccctatgcaggccctttcctctatattgtactgcctccttaacaaaggaagattgattaagcccctactttgtgccagtctctgttatcaagtccgttaaatgcatttaacgttaaattttttcttttttggtttaaaaaactctagtttcttaaactactagtttttagtgtcttgctaaaactatgtgctcttgaataggctacaacttatttcacactatctcattgaactctcctggtatgtgatagtgttataatgaaaaattgcataccaggacagctaagtctattttgcaaccatacagcgtttcataatttagcatttaaaatacagacagtccccgacttttggtggtttgatgtgggatttttggtggaaaagcagtatacattcagaatgcacctctacttatgatggggctacttcctggtaaacccattgtaatgtgcaaattacgggtttatcaggaggtgaccccatcggtaatggagaagtgctgggaggtaaatattagaaatggaagtatctaaatgagtaagaaacagcatgggagcataatttggccaaaatcaaacagaactaaagtagtcatgtcggtaagaatttgggactgcaggccagttacgatagctctcacctgtaatcccagcattttgggaggccgaggcaggcggatcacttgaggtcaggagttcaagaccagcctaaacaatatggcgaaacctcatctctaccaaaaaaatacaaagattagctgggcatggtgtctcatgcctgtagtcccagctacctatggggctgaggcaggaggatctcttgagcccaggaggtcgatgctgcattgagccgagattgtgccactgcactccagcgtgggcaacagagtgagactgtctcagggggaaaaaaaaagaggaaaacaaaaaagacgttgggagtgcagtttctctacctacagcatatctcaaaggttttttttaaaaaagtattttcttaactttttaccttcatttttcaaaacaattagggtacaatttacatatagtaaagttcactctttatagttttagttatgtgagtttgtacaaacatatacaggagtgaaccactaccacaatcgaaatatagttgcatcacccccctaaaactctccaggcccttttgtagtcaactcctacccccgaccctcagattctgctaaccactgatttgttttctgcccctatagttttgctttagtatgactgtcatatcaatagaatcatacaatgagtaggcttattttatgccttcaggttttaaaaattataaacatttacattacagtaaaattcactctggtatacagttctataaagctctgataaatgtgtagagttgtgtaaccaccaatgcaaccaaggtacagaacagtcctcttagcctctccctaccaaatttattcctgctactttgtagtcaaaaccagtcccctacacccaaaccctggcag

SEQ ID NO: 456685 - DNA, 4393 bp, Homo sapiens
  misc_feature (3456)..(3456): n is a, c, g, or t
  misc_feature (3510)..(3510): n is a, c, g, or t
gatccggaagtcggagcctagctgcgcgagagtttctgctcgctcaaccgagttgtcgtgttgccctcgcttctcagatccccgccggaagtgaagagagcaagcagatttgaacctatctgctttcaagctggtcatcatgatgaaacttagacacaaaaataaaaagccaggtgaaggttccaagggccacaagaagataagttggccctaccctcagcctgcaaagcaaaatgggaagaaagcaacctccaaagtgccctctgcacctcattttgttcaccccaatgatcatgccaatcgagaggctgaattaaagaagaagtgggttgaggagatgagggagaagcagcaagccgcccgggagcaagaaagacaaaaacgcaggaccattgagagctactgtcaggatgtcctaagacgccaggaggagtttgagcataaggaggaagttttgcaggaattaaatatgtttcctcagctggatgacgaggccacgaggaaggcttattacaaggagttccgtaaggtggtggaatactctgatgtgattctggaagtcctggatgccagagacccattaggctgccgctgcttccaaatggaggaggctgtcctgcgagcacaaggcaacaagaagctggtcctggtcttgaacaagattgacctggtccccaaggaggttgtggagaaatggctggattaccttcggaatgagttgccaaccgtggctttcaaggccagtacccagcatcaggtcaaaaacctgaatcgttgcagtgtgccagtagatcaggcctctgagtcactgctgaaaagcaaagcctgctttggagctgaaaacctcatgagggttctggggaactattgccgccttggtgaagtgcgcacccacattcgtgtgggtgttgtgggtcttcccaatgttgggaagagcagcctgatcaatagcctgaagcgcagccgcgcatgcagcgtgggagctgttcctggaattaccaaattcatgcaggaggtctacctggacaagttcatccggctcttggatgctccaggcattgtcccagggcccaactcagaggtgggcaccatcctgcgtaactgcgtccacgtgcagaagctggcagaccctgtgaccccagtggagaccatcctgcagcgctgcaacctggaggagatttccaactattatggcgtctctgggttccagaccactgagcactttctgacggcagtggcccaccgtttggggaagaagaagaagggaggcttatatagtcaggaacaggcggccaaagctgtcctagctgactgggtgagcgggaagatcagcttctatataccaccaccagccactcacactctgcccacccatctcagtgctgagatcgttaaggaaatgaccgaggtctttgacatcgaggatactgagcaggccaatgaagacaccatggaatgcttggccaccggagaatctgatgagctgttgggtgacacggacccacttgaaatggagatcaagttgctccattctccgatgacgaaaatagcagatgccattgaaaataaaaccaccgtgtataagattggagatctcactgggtattgcaccaatccgaaccgtcatcagatggggtgggctaaacgcaatgtggaccaccgccctaagagcaacagtatggtggatgtctgctcagtggaccgccgctcagtgctgcagaggatcatggagacggaccccctgcaacagggccaggctctggcatctgccctgaaaaataagaagaagatgcagaaacgtgcagataaaatcgccagcaagctgtctgattccatgatgtctgctctcgacctctctggcaatgctgatgatggtgttggtgactaatcgactgatctcacttcccttccgctccaagcaccagttccggtggtacgggggaataccagtgaaatagtttggttctccctgaagcatctgcatattgaaagaacgctttccccactgtgtgtcttctccccctcctccagtaaaaacagtcccggctgggtgctgtggctcacgtctgtaatcccagcactttgggaggccgaggtgggcggatcacctgaggtcgggagttcgagaccagcctggccaacatggtgaagccccgtctctactaaaaatacaaaaaaatttagccgtgcttggtggcacctgtaatcccagctacttgggaggctgaggcaggagaatcgcctgaacctgggagactaaggcaggagaatcgcctggacctgggaggcagaggttgcagtgagcccagacggcaccattgcactctagcctgggcaacaacacgaaactccgtccccaaaaaaaaaaaaaaaaaaatcccaaggggctgcagctgccaaacccaataccctctatttaacccctactctgttttacaagagaaataaaagaagtatcagcagagctcaggtgctaacacctgttgagggctgacctacaaaactctgcctacaaaactctcttagacaggtgaatatgccactagaagttaggttgctggtagacctgggggtccctgcgggagggtgatggtttctttaccaccccacaggagatttcagtggcaaggcatgcctgcagtgggctttgggccatgcatcttccaagtccataggtcttcacctgggtggcagtgagaaaaagtagaaagtaatgagcctcctgtgtctctggaaggttctagggatagggtagagggaagaagagaacaaacaagcctggcttgtgctgaagtgtggtaggcactaccctgtttgcgtgaagagaaaacaaagcacctgttagtagggaggctttagggggaagccccgtcttgggggcatttctgggcagattgtgaattggaggaatctctttaactgaagtactctggctggaccctgcccttgtgtgaccatgtctcctattgcaccagcatttgaattccatggctcaagagggttctggtaccatttattcacagactgtatcctcgagagagctgctatatatgggagtgtaccagccaactccttttccagtgtctgtaagtcacctcattaaagtataattagctgtctcctctgggagatcctaccccatcagacaagggcagtgagcccaagcagtgccagaggccctcagaaagggattagggtagatgattgcaactgaaacacaatcttctttctttgccagggtattttgggggttttgccccaaaatataccctgggcatagcattactgcagtcttggatgtctaccccaaacttccacaccatccttcgacccacagctgcacctttatttatttattttgctctgttgcccaggctggagtgcaatggcgtgatctcggctcactgcaacctctgcctcccgggttcaggtgatcctcctgccttagcctcccangtagctgggattacaggcacctgccaccacgcctggctagtttttgtatttttngtagagacgatgtttcaccatgttgaccaggctggtctcgaactcttgacctcaggtgatccgctcgcttcggcctcccaaagtgctgggattataggcgtgagccactgtgcccagcctcacagctgcatcttaaccttacctttgcctctgcctctcaagctggtacctcctaatttacatcctaagagtggaaccatgtgacaaggactggagtgccattggctgtggactgttcaggcagggaagtacaagaccactcttgtattcaggggcaaccaaaggagagaattacgtacttgttgagtacaaactgcaccaagccctggagacccattaccaccgttaaccctcaatacagctctgctagtaagggattcgtctccccaaatgaaaaaaaaaagtaatctcagaatgttggccgagcatggtggctcacacctgtagtcccacctcccgagtaacagggactacaggtgcccaccaccatgctgggctaatttttgtatttttggtagaggcgggggtttctccacactggccaggctggtcttgaacttctgacctcaagggatccacccgcctcggcctcccaaagtgctgggattataggcatgaaccaccgtgtccggccatatattttcgtcttttgaagactgttatatacatgaaattatatggtatgtagcattttgagagcgacttcttttgctatgagtaatacatttgagattcatccatatttctcagtatattaatagttcttatttctgagtcactccattgtgtggatttactactgtttgttccccagttgaaggatgtttaggatctttgcagttttggacaattacaagtaaagctgctataaacatttgtatgc

SEQ ID NO: 456686 - DNA, 5774 bp, Homo sapiens
  misc_feature (3568)..(3568): n is a, c, g, or t
  misc_feature (3622)..(3622): n is a, c, g, or t
gatccggaagtcggagcctagctgcgcgagagtttctgctcgctcaaccgagttgtcgtgttgccctcgcttctcagatccccgccggaagttaagaaacttctctcctcttttctcacaatgtgcgctcacctagacggccgggcagttaggatcgtctattggatgtgaaaccagagatgcccgccaacctggaatagagaggaagagagcaagcagatttgaacctatctgctttcaagctggtcatcatgatgaaacttagacacaaaaataaaaagccaggtgaaggttccaagggccacaagaagataagttggccctaccctcagcctgcaaagcaaaatgggaagaaagcaacctccaaagtgccctctgcacctcattttgttcaccccaatgatcatgccaatcgagaggctgaattaaagaagaagtgggttgaggagatgagggagaagcagcaagccgcccgggagcaagaaagacaaaaacgcaggaccattgagagctactgtcaggatgtcctaagacgccaggaggagtttgagcataaggaggaagttttgcaggaattaaatatgtttcctcagctggatgacgaggccacgaggaaggcttattacaaggagttccgtaaggtggtggaatactctgatgtgattctggaagtcctggatgccagagacccattaggctgccgctgcttccaaatggaggaggctgtcctgcgagcacaaggcaacaagaagctggtcctggtcttgaacaagattgacctggtccccaaggaggttgtggagaaatggctggattaccttcggaatgagttgccaaccgtggctttcaaggccagtacccagcatcaggtcaaaaacctgaatcgttgcagtgtgccagtagatcaggcctctgagtcactgctgaaaagcaaagcctgctttggagctgaaaacctcatgagggttctggggaactattgccgccttggtgaagtgcgcacccacattcgtgtgggtgttgtgggtcttcccaatgttgggaagagcagcctgatcaatagcctgaagcgcagccgcgcatgcagcgtgggagctgttcctggaattaccaaattcatgcaggaggtctacctggacaagttcatccggctcttggatgctccaggcattgtcccagggcccaactcagaggtgggcaccatcctgcgtaactgcgtccacgtgcagaagctggcagaccctgtgaccccagtggagaccatcctgcagcgctgcaacctggaggagatttccaactattatggcgtctctgggttccagaccactgagcactttctgacggcagtggcccaccgtttggggaagaagaagaagggaggcttatatagtcaggaacaggcggccaaagctgtcctagctgactgggtgagcgggaagatcagcttctatataccaccaccagccactcacactctgcccacccatctcagtgctgagatcgttaaggaaatgaccgaggtctttgacatcgaggatactgagcaggccaatgaagacaccatggaatgcttggccaccggagaatctgatgagctgttgggtgacacggacccacttgaaatggagatcaagttgctccattctccgatgacgaaaatagcagatgccattgaaaataaaaccaccgtgtataagattggagatctcactgggtattgcaccaatccgaaccgtcatcagatggggtgggctaaacgcaatgtggaccaccgccctaagagcaacagtatggtggatgtctgctcagtggaccgccgctcagtgctgcagaggatcatggagacggaccccctgcaacagggccaggctctggcatctgccctgaaaaataagaagaagatgcagaaacgtgcagataaaatcgccagcaagctgtctgattccatgatgtctgctctcgacctctctggcaatgctgatgatggtgttggtgactaatcgactgatctcacttcccttccgctccaagcaccagttccggtggtacgggggaataccagtgaaatagtttggttctccctgaagcatctgcatattgaaagaacgctttccccactgtgtgtcttctccccctcctccagtaaaaacagtcccggctgggtgctgtggctcacgtctgtaatcccagcactttgggaggccgaggtgggcggatcacctgaggtcgggagttcgagaccagcctggccaacatggtgaagccccgtctctactaaaaatacaaaaaaatttagccgtgcttggtggcacctgtaatcccagctacttgggaggctgaggcaggagaatcgcctgaacctgggagactaaggcaggagaatcgcctggacctgggaggcagaggttgcagtgagcccagacggcaccattgcactctagcctgggcaacaacacgaaactccgtccccaaaaaaaaaaaaaaaaaaatcccaaggggctgcagctgccaaacccaataccctctatttaacccctactctgttttacaagagaaataaaagaagtatcagcagagctcaggtgctaacacctgttgagggctgacctacaaaactctgcctacaaaactctcttagacaggtgaatatgccactagaagttaggttgctggtagacctgggggtccctgcgggagggtgatggtttctttaccaccccacaggagatttcagtggcaaggcatgcctgcagtgggctttgggccatgcatcttccaagtccataggtcttcacctgggtggcagtgagaaaaagtagaaagtaatgagcctcctgtgtctctggaaggttctagggatagggtagagggaagaagagaacaaacaagcctggcttgtgctgaagtgtggtaggcactaccctgtttgcgtgaagagaaaacaaagcacctgttagtagggaggctttagggggaagccccgtcttgggggcatttctgggcagattgtgaattggaggaatctctttaactgaagtactctggctggaccctgcccttgtgtgaccatgtctcctattgcaccagcatttgaattccatggctcaagagggttctggtaccatttattcacagactgtatcctcgagagagctgctatatatgggagtgtaccagccaactccttttccagtgtctgtaagtcacctcattaaagtataattagctgtctcctctgggagatcctaccccatcagacaagggcagtgagcccaagcagtgccagaggccctcagaaagggattagggtagatgattgcaactgaaacacaatcttctttctttgccagggtattttgggggttttgccccaaaatataccctgggcatagcattactgcagtcttggatgtctaccccaaacttccacaccatccttcgacccacagctgcacctttatttatttattttgctctgttgcccaggctggagtgcaatggcgtgatctcggctcactgcaacctctgcctcccgggttcaggtgatcctcctgccttagcctcccangtagctgggattacaggcacctgccaccacgcctggctagtttttgtatttttngtagagacgatgtttcaccatgttgaccaggctggtctcgaactcttgacctcaggtgatccgctcgcttcggcctcccaaagtgctgggattataggcgtgagccactgtgcccagcctcacagctgcatcttaaccttacctttgcctctgcctctcaagctggtacctcctaatttacatcctaagagtggaaccatgtgacaaggactggagtgccattggctgtggactgttcaggcagggaagtacaagaccactcttgtattcaggggcaaccaaaggagagaattacgtacttgttgagtacaaactgcaccaagccctggagacccattaccaccgttaaccctcaatacagctctgctagtaagggattcgtctccccaaatgaaaaaaaaaagtaatctcagaatgttggccgagcatggtggctcacacctgtagtcccagttatgcaggaggctgaggcaggagaatcgcttgatctcaggaggcggaggttgcagtgagtcgacatcacaccactgcactccagcctgggggacagagtgagacttcgtctcggaaaaaaaaaaaaaaagttgacaggatggccagacccaagtgggcgtattaagtggtggtgctaggattggaacccaagcgtgattaaaaccctatgcaggccctttcctctatattgtactgcctccttaacaaaggaagattgattaagcccctactttgtgccagtctctgttatcaagtccgttaaatgcatttaacgttaaattttttcttttttggtttaaaaaactctagtttcttaaactactagtttttagtgtcttgctaaaactatgtgctcttgaataggctacaacttatttcacactatctcattgaactctcctggtatgtgatagtgttataatgaaaaattgcataccaggacagctaagtctattttgcaaccatacagcgtttcataatttagcatttaaaatacagacagtccccgacttttggtggtttgatgtgggatttttggtggaaaagcagtatacattcagaatgcacctctacttatgatggggctacttcctggtaaacccattgtaatgtgcaaattacgggtttatcaggaggtgaccccatcggtaatggagaagtgctgggaggtaaatattagaaatggaagtatctaaatgagtaagaaacagcatgggagcataatttggccaaaatcaaacagaactaaagtagtcatgtcggtaagaatttgggactgcaggccagttacgatagctctcacctgtaatcccagcattttgggaggccgaggcaggcggatcacttgaggtcaggagttcaagaccagcctaaacaatatggcgaaacctcatctctaccaaaaaaatacaaagattagctgggcatggtgtctcatgcctgtagtcccagctacctatggggctgaggcaggaggatctcttgagcccaggaggtcgatgctgcattgagccgagattgtgccactgcactccagcgtgggcaacagagtgagactgtctcagggggaaaaaaaaagaggaaaacaaaaaagacgttgggagtgcagtttctctacctacagcatatctcaaaggttttttttaaaaaagtattttcttaactttttaccttcatttttcaaaacaattagggtacaatttacatatagtaaagttcactctttatagttttagttatgtgagtttgtacaaacatatacaggagtgaaccactaccacaatcgaaatatagttgcatcacccccctaaaactctccaggcccttttgtagtcaactcctacccccgaccctcagattctgctaaccactgatttgttttctgcccctatagttttgctttagtatgactgtcatatcaatagaatcatacaatgagtaggcttattttatgccttcaggttttaaaaattataaacatttacattacagtaaaattcactctggtatacagttctataaagctctgataaatgtgtagagttgtgtaaccaccaatgcaaccaaggtacagaacagtcctcttagcctctccctaccaaatttattcctgctactttgtagtcaaaaccagtcccctacacccaaaccctggcag

SEQ ID NO: 456687 - DNA, 2939 bp, Homo sapiens
ccccccgccccccccccccccccccaacataggcagtagaggccgggttaatcggcagagggtagtaagaaacttctctcctcttttctcacaatgtgcgctcacctagacggccgggcagttaggatcgtctattggatgtgaaaccagagatgcccgccaacctggaatagagaggaagagagcaagcagatttgaacctatctgctttcaagctggtcatcatgatgaaacttagacacaaaaataaaaagccaggtgaaggttccaagggccacaagaagataagttggccctaccctcagcctgcaaagcaaaatgggaagaaagcaacctccaaagtgccctctgcacctcattttgttcaccccaatgatcatgccaatcgagaggctgaattaaagaagaagtgggttgaggagatgagggagaagcagcaagccgcccgggagcaagaaagacaaaaacgcaggaccattgagagctactgtcaggatgtcctaagacgccaggaggagtttgagcataaggaggaagttttgcaggaattaaatatgtttcctcagctggatgacgaggccacgaggaaggcttattacaaggagttccgtaaggtggtggaatactctgatgtgattctggaagtcctggatgccagagacccattaggctgccgctgcttccaaatggaggaggctgtcctgcgagcacaaggcaacaagaagctggtcctggtcttgaacaagattgacctggtccccaaggaggttgtggagaaatggctggattaccttcggaatgagttgccaaccgtggctttcaaggccagtacccagcatcaggtcaaaaacctgaatcgttgcagtgtgccagtagatcaggcctctgagtcactgctgaaaagcaaagcctgctttggagctgaaaacctcatgagggttctggggaactattgccgccttggtgaagtgcgcacccacattcgtgtgggtgttgtgggtcttcccaatgttgggaagagcagcctgatcaatagcctgaagcgcagccgcgcatgcagcgtgggagctgttcctggaattaccaaattcatgcaggaggtctacctggacaagttcatccggctcttggatgctccaggcattgtcccagggcccaactcagaggtgggcaccatcctgcgtaactgcgtccacgtgcagaagctggcagaccctgtgaccccagtggagaccatcctgcagcgctgcaacctggaggagatttccaactattatggcgtctctgggttccagaccactgagcactttctgacggcagtggcccaccgtttggggaagaagaagaagggaggcttatatagtcaggaacaggcggccaaagctgtcctagctgactgggtgagcgggaagatcagcttctatataccaccaccagccactcacactctgcccacccatctcagtgctgagatcgttaaggaaatgaccgaggtctttgacatcgaggatactgagcaggccaatgaagacaccatggaatgcttggccaccggagaatctgatgagctgttgggtgacacggacccacttgaaatggagatcaagttgctccattctccgatgacgaaaatagcagatgccattgaaaataaaaccaccgtgtataagattggagatctcactgggtattgcaccaatccgaaccgtcatcagatggggtgggctaaacgcaatgtggaccaccgccctaagagcaacagtatggtggatgtctgctcagtggaccgccgctcagtgctgcagaggatcatggagacggaccccctgcaacagggccaggctctggcatctgccctgaaaaataagaagaagatgcagaaacgtgcagataaaatcgccagcaagctgtctgattccatgatgtctgctctcgacctctctggcaatgctgatgatggtgttggtgactaatcgactgatctcacttcccttccgctccaagcaccagttccggtggtacgggggaataccagtgaaatagtttggttctccctgaagcatctgcatattgaaagaacgctttccccactgtgtgtcttctccccctcctccagtaaaaacagtcccggctccaaagtgctgggattataggcgtgagccactgtgcccagcctcacagctgcatcttaaccttacctttgcctctgcctctcaagctggtacctcctaatttacatcctaagagtggaaccatgtgacaaggactggagtgccattggctgtggactgttcaggcagggaagtacaagaccactcttgtattcaggggcaaccaaaggagagaattacgtacttgttgagtacaaactgcaccaagccctggagacccattaccaccgttaaccctcaatacagctctgctagtaagggattcgtctccccaaatgaaaaaaaaaagtaatctcagaatgttggccgagcatggtggctcacacctgtagtcccacctcccgagtaacagggactacaggtgcccaccaccatgctgggctaatttttgtatttttggtagaggcgggggtttctccacactggccaggctggtcttgaacttctgacctcaagggatccacccgcctcggcctcccaaagtgctgggattataggcatgaaccaccgtgtccggccatatattttcgtcttttgaagactgttatatacatgaaattatatggtatgtagcattttgagagcgacttcttttgctatgagtaatacatttgagattcatccatatttctcagtatattaatagttcttatttctgagtcactccattgtgtggatttactactgtttgttccccagttgaaggatgtttaggatctttgcagttttggacaattacaagtaaagctgctataaacatttgtatgc

SEQ ID NO: 456688 - DNA, 5591 bp, Homo sapiens
  misc_feature (3385)..(3385): n is a, c, g, or t
  misc_feature (3439)..(3439): n is a, c, g, or t
cttcttctcccattctgacaggaagagagcaagcagatttgaacctatctgctttcaagctggtcatcatgatgaaacttagacacaaaaataaaaagccaggtgaaggttccaagggccacaagaagataagttggccctaccctcagcctgcaaagcaaaatgggaagaaagcaacctccaaagtgccctctgcacctcattttgttcaccccaatgatcatgccaatcgagaggctgaattaaagaagaagtgggttgaggagatgagggagaagcagcaagccgcccgggagcaagaaagacaaaaacgcaggaccattgagagctactgtcaggatgtcctaagacgccaggaggagtttgagcataaggaggaagttttgcaggaattaaatatgtttcctcagctggatgacgaggccacgaggaaggcttattacaaggagttccgtaaggtggtggaatactctgatgtgattctggaagtcctggatgccagagacccattaggctgccgctgcttccaaatggaggaggctgtcctgcgagcacaaggcaacaagaagctggtcctggtcttgaacaagattgacctggtccccaaggaggttgtggagaaatggctggattaccttcggaatgagttgccaaccgtggctttcaaggccagtacccagcatcaggtcaaaaacctgaatcgttgcagtgtgccagtagatcaggcctctgagtcactgctgaaaagcaaagcctgctttggagctgaaaacctcatgagggttctggggaactattgccgccttggtgaagtgcgcacccacattcgtgtgggtgttgtgggtcttcccaatgttgggaagagcagcctgatcaatagcctgaagcgcagccgcgcatgcagcgtgggagctgttcctggaattaccaaattcatgcaggaggtctacctggacaagttcatccggctcttggatgctccaggcattgtcccagggcccaactcagaggtgggcaccatcctgcgtaactgcgtccacgtgcagaagctggcagaccctgtgaccccagtggagaccatcctgcagcgctgcaacctggaggagatttccaactattatggcgtctctgggttccagaccactgagcactttctgacggcagtggcccaccgtttggggaagaagaagaagggaggcttatatagtcaggaacaggcggccaaagctgtcctagctgactgggtgagcgggaagatcagcttctatataccaccaccagccactcacactctgcccacccatctcagtgctgagatcgttaaggaaatgaccgaggtctttgacatcgaggatactgagcaggccaatgaagacaccatggaatgcttggccaccggagaatctgatgagctgttgggtgacacggacccacttgaaatggagatcaagttgctccattctccgatgacgaaaatagcagatgccattgaaaataaaaccaccgtgtataagattggagatctcactgggtattgcaccaatccgaaccgtcatcagatggggtgggctaaacgcaatgtggaccaccgccctaagagcaacagtatggtggatgtctgctcagtggaccgccgctcagtgctgcagaggatcatggagacggaccccctgcaacagggccaggctctggcatctgccctgaaaaataagaagaagatgcagaaacgtgcagataaaatcgccagcaagctgtctgattccatgatgtctgctctcgacctctctggcaatgctgatgatggtgttggtgactaatcgactgatctcacttcccttccgctccaagcaccagttccggtggtacgggggaataccagtgaaatagtttggttctccctgaagcatctgcatattgaaagaacgctttccccactgtgtgtcttctccccctcctccagtaaaaacagtcccggctgggtgctgtggctcacgtctgtaatcccagcactttgggaggccgaggtgggcggatcacctgaggtcgggagttcgagaccagcctggccaacatggtgaagccccgtctctactaaaaatacaaaaaaatttagccgtgcttggtggcacctgtaatcccagctacttgggaggctgaggcaggagaatcgcctgaacctgggagactaaggcaggagaatcgcctggacctgggaggcagaggttgcagtgagcccagacggcaccattgcactctagcctgggcaacaacacgaaactccgtccccaaaaaaaaaaaaaaaaaaatcccaaggggctgcagctgccaaacccaataccctctatttaacccctactctgttttacaagagaaataaaagaagtatcagcagagctcaggtgctaacacctgttgagggctgacctacaaaactctgcctacaaaactctcttagacaggtgaatatgccactagaagttaggttgctggtagacctgggggtccctgcgggagggtgatggtttctttaccaccccacaggagatttcagtggcaaggcatgcctgcagtgggctttgggccatgcatcttccaagtccataggtcttcacctgggtggcagtgagaaaaagtagaaagtaatgagcctcctgtgtctctggaaggttctagggatagggtagagggaagaagagaacaaacaagcctggcttgtgctgaagtgtggtaggcactaccctgtttgcgtgaagagaaaacaaagcacctgttagtagggaggctttagggggaagccccgtcttgggggcatttctgggcagattgtgaattggaggaatctctttaactgaagtactctggctggaccctgcccttgtgtgaccatgtctcctattgcaccagcatttgaattccatggctcaagagggttctggtaccatttattcacagactgtatcctcgagagagctgctatatatgggagtgtaccagccaactccttttccagtgtctgtaagtcacctcattaaagtataattagctgtctcctctgggagatcctaccccatcagacaagggcagtgagcccaagcagtgccagaggccctcagaaagggattagggtagatgattgcaactgaaacacaatcttctttctttgccagggtattttgggggttttgccccaaaatataccctgggcatagcattactgcagtcttggatgtctaccccaaacttccacaccatccttcgacccacagctgcacctttatttatttattttgctctgttgcccaggctggagtgcaatggcgtgatctcggctcactgcaacctctgcctcccgggttcaggtgatcctcctgccttagcctcccangtagctgggattacaggcacctgccaccacgcctggctagtttttgtatttttngtagagacgatgtttcaccatgttgaccaggctggtctcgaactcttgacctcaggtgatccgctcgcttcggcctcccaaagtgctgggattataggcgtgagccactgtgcccagcctcacagctgcatcttaaccttacctttgcctctgcctctcaagctggtacctcctaatttacatcctaagagtggaaccatgtgacaaggactggagtgccattggctgtggactgttcaggcagggaagtacaagaccactcttgtattcaggggcaaccaaaggagagaattacgtacttgttgagtacaaactgcaccaagccctggagacccattaccaccgttaaccctcaatacagctctgctagtaagggattcgtctccccaaatgaaaaaaaaaagtaatctcagaatgttggccgagcatggtggctcacacctgtagtcccagttatgcaggaggctgaggcaggagaatcgcttgatctcaggaggcggaggttgcagtgagtcgacatcacaccactgcactccagcctgggggacagagtgagacttcgtctcggaaaaaaaaaaaaaaagttgacaggatggccagacccaagtgggcgtattaagtggtggtgctaggattggaacccaagcgtgattaaaaccctatgcaggccctttcctctatattgtactgcctccttaacaaaggaagattgattaagcccctactttgtgccagtctctgttatcaagtccgttaaatgcatttaacgttaaattttttcttttttggtttaaaaaactctagtttcttaaactactagtttttagtgtcttgctaaaactatgtgctcttgaataggctacaacttatttcacactatctcattgaactctcctggtatgtgatagtgttataatgaaaaattgcataccaggacagctaagtctattttgcaaccatacagcgtttcataatttagcatttaaaatacagacagtccccgacttttggtggtttgatgtgggatttttggtggaaaagcagtatacattcagaatgcacctctacttatgatggggctacttcctggtaaacccattgtaatgtgcaaattacgggtttatcaggaggtgaccccatcggtaatggagaagtgctgggaggtaaatattagaaatggaagtatctaaatgagtaagaaacagcatgggagcataatttggccaaaatcaaacagaactaaagtagtcatgtcggtaagaatttgggactgcaggccagttacgatagctctcacctgtaatcccagcattttgggaggccgaggcaggcggatcacttgaggtcaggagttcaagaccagcctaaacaatatggcgaaacctcatctctaccaaaaaaatacaaagattagctgggcatggtgtctcatgcctgtagtcccagctacctatggggctgaggcaggaggatctcttgagcccaggaggtcgatgctgcattgagccgagattgtgccactgcactccagcgtgggcaacagagtgagactgtctcagggggaaaaaaaaagaggaaaacaaaaaagacgttgggagtgcagtttctctacctacagcatatctcaaaggttttttttaaaaaagtattttcttaactttttaccttcatttttcaaaacaattagggtacaatttacatatagtaaagttcactctttatagttttagttatgtgagtttgtacaaacatatacaggagtgaaccactaccacaatcgaaatatagttgcatcacccccctaaaactctccaggcccttttgtagtcaactcctacccccgaccctcagattctgctaaccactgatttgttttctgcccctatagttttgctttagtatgactgtcatatcaatagaatcatacaatgagtaggcttattttatgccttcaggttttaaaaattataaacatttacattacagtaaaattcactctggtatacagttctataaagctctgataaatgtgtagagttgtgtaaccaccaatgcaaccaaggtacagaacagtcctcttagcctctccctaccaaatttattcctgctactttgtagtcaaaaccagtcccctacacccaaaccctggcag

SEQ ID NO: 456689 - DNA, 4182 bp, Homo sapiens
ccccccgccccccccccccccccccaacataggcagtagaggccgggttaatcggcagagggtagtaagaaacttctctcctcttttctcacaatgtgcgctcacctagacggccgggcagttaggatcgtctattggatgtgaaaccagagatgcccgccaacctggaatagagaggaagagagcaagcagatttgaacctatctgctttcaagctggtcatcatgatgaaacttagacacaaaaataaaaagccaggtgaaggttccaagggccacaagaagataagttggccctaccctcagcctgcaaagcaaaatgggaagaaagcaacctccaaagtgccctctgcacctcattttgttcaccccaatgatcatgccaatcgagaggctgaattaaagaagaagtgggttgaggagatgagggagaagcagcaagccgcccgggagcaagaaagacaaaaacgcaggaccattgagagctactgtcaggatgtcctaagacgccaggaggagtttgagcataaggaggaagttttgcaggaattaaatatgtttcctcagctggatgacgaggccacgaggaaggcttattacaaggagttccgtaaggtggtggaatactctgatgtgattctggaagtcctggatgccagagacccattaggctgccgctgcttccaaatggaggaggctgtcctgcgagcacaaggcaacaagaagctggtcctggtcttgaacaagattgacctggtccccaaggaggttgtggagaaatggctggattaccttcggaatgagttgccaaccgtggctttcaaggccagtacccagcatcaggtcaaaaacctgaatcgttgcagtgtgccagtagatcaggcctctgagtcactgctgaaaagcaaagcctgctttggagctgaaaacctcatgagggttctggggaactattgccgccttggtgaagtgcgcacccacattcgtgtgggtgttgtgggtcttcccaatgttgggaagagcagcctgatcaatagcctgaagcgcagccgcgcatgcagcgtgggagctgttcctggaattaccaaattcatgcaggaggtctacctggacaagttcatccggctcttggatgctccaggcattgtcccagggcccaactcagaggtgggcaccatcctgcgtaactgcgtccacgtgcagaagctggcagaccctgtgaccccagtggagaccatcctgcagcgctgcaacctggaggagatttccaactattatggcgtctctgggttccagaccactgagcactttctgacggcagtggcccaccgtttggggaagaagaagaagggaggcttatatagtcaggaacaggcggccaaagctgtcctagctgactgggtgagcgggaagatcagcttctatataccaccaccagccactcacactctgcccacccatctcagtgctgagatcgttaaggaaatgaccgaggtctttgacatcgaggatactgagcaggccaatgaagacaccatggaatgcttggccaccggagaatctgatgagctgttgggtgacacggacccacttgaaatggagatcaagttgctccattctccgatgacgaaaatagcagatgccattgaaaataaaaccaccgtgtataagattggagatctcactgggtattgcaccaatccgaaccgtcatcagatggggtgggctaaacgcaatgtggaccaccgccctaagagcaacagtatggtggatgtctgctcagtggaccgccgctcagtgctgcagaggatcatggagacggaccccctgcaacagggccaggctctggcatctgccctgaaaaataagaagaagatgcagaaacgtgcagataaaatcgccagcaagctgtctgattccatgatgtctgctctcgacctctctggcaatgctgatgatggtgttggtgactaatcgactgatctcacttcccttccgctccaagcaccagttccggtggtacgggggaataccagtgaaatagtttggttctccctgaagcatctgcatattgaaagaacgctttccccactgtgtgtcttctccccccaaagtgctgggattataggcgtgagccactgtgcccagcctcacagctgcatcttaaccttacctttgcctctgcctctcaagctggtacctcctaatttacatcctaagagtggaaccatgtgacaaggactggagtgccattggctgtggactgttcaggcagggaagtacaagaccactcttgtattcaggggcaaccaaaggagagaattacgtacttgttgagtacaaactgcaccaagccctggagacccattaccaccgttaaccctcaatacagctctgctagtaagggattcgtctccccaaatgaaaaaaaaaagtaatctcagaatgttggccgagcatggtggctcacacctgtagtcccagttatgcaggaggctgaggcaggagaatcgcttgatctcaggaggcggaggttgcagtgagtcgacatcacaccactgcactccagcctgggggacagagtgagacttcgtctcggaaaaaaaaaaaaaaagttgacaggatggccagacccaagtgggcgtattaagtggtggtgctaggattggaacccaagcgtgattaaaaccctatgcaggccctttcctctatattgtactgcctccttaacaaaggaagattgattaagcccctactttgtgccagtctctgttatcaagtccgttaaatgcatttaacgttaaattttttcttttttggtttaaaaaactctagtttcttaaactactagtttttagtgtcttgctaaaactatgtgctcttgaataggctacaacttatttcacactatctcattgaactctcctggtatgtgatagtgttataatgaaaaattgcataccaggacagctaagtctattttgcaaccatacagcgtttcataatttagcatttaaaatacagacagtccccgacttttggtggtttgatgtgggatttttggtggaaaagcagtatacattcagaatgcacctctacttatgatggggctacttcctggtaaacccattgtaatgtgcaaattacgggtttatcaggaggtgaccccatcggtaatggagaagtgctgggaggtaaatattagaaatggaagtatctaaatgagtaagaaacagcatgggagcataatttggccaaaatcaaacagaactaaagtagtcatgtcggtaagaatttgggactgcaggccagttacgatagctctcacctgtaatcccagcattttgggaggccgaggcaggcggatcacttgaggtcaggagttcaagaccagcctaaacaatatggcgaaacctcatctctaccaaaaaaatacaaagattagctgggcatggtgtctcatgcctgtagtcccagctacctatggggctgaggcaggaggatctcttgagcccaggaggtcgatgctgcattgagccgagattgtgccactgcactccagcgtgggcaacagagtgagactgtctcagggggaaaaaaaaagaggaaaacaaaaaagacgttgggagtgcagtttctctacctacagcatatctcaaaggttttttttaaaaaagtattttcttaactttttaccttcatttttcaaaacaattagggtacaatttacatatagtaaagttcactctttatagttttagttatgtgagtttgtacaaacatatacaggagtgaaccactaccacaatcgaaatatagttgcatcacccccctaaaactctccaggcccttttgtagtcaactcctacccccgaccctcagattctgctaaccactgatttgttttctgcccctatagttttgctttagtatgactgtcatatcaatagaatcatacaatgagtaggcttattttatgccttcaggttttaaaaattataaacatttacattacagtaaaattcactctggtatacagttctataaagctctgataaatgtgtagagttgtgtaaccaccaatgcaaccaaggtacagaacagtcctcttagcctctccctaccaaatttattcctgctactttgtagtcaaaaccagtcccctacacccaaaccctggcag

SEQ ID NO: 456690 - DNA, 1929 bp, Homo sapiens
  misc_feature (1892)..(1893): n is a, c, g, or t
  misc_feature (1919)..(1919): n is a, c, g, or t
  misc_feature (1922)..(1922): n is a, c, g, or t
ccccccgccccccccccccccccccaacataggcagtagaggccgggttaatcggcagagggtagtaagaaacttctctcctcttttctcacaatgtgcgctcacctagacggccgggcagttaggatcgtctattggatgtgaaaccagagatgcccgccaacctggaatagagaggaagagagcaagcagatttgaacctatctgctttcaagctggtcatcatgatgaaacttagacacaaaaataaaaagccaggtgaaggttccaagggccacaagaagataagttggccctaccctcagcctgcaaagcaaaatgggaagaaagcaacctccaaagtgccctctgcacctcattttgttcaccccaatgatcatgccaatcgagaggctgaattaaagaagaagtgggttgaggagatgagggagaagcagcaagccgcccgggagcaagaaagacaaaaacgcaggaccattgagagctactgtcaggatgtcctaagacgccaggaggagtttgagcataaggaggaagttttgcaggaattaaatatgtttcctcagctggatgacgaggccacgaggaaggcttattacaaggagttccgtaaggtggtggaatactctgatgtgattctggaagtcctggatgccagagacccattaggctgccgctgcttccaaatggaggaggctgtcctgcgagcacaaggcaacaagaagctggtcctggtcttgaacaagattgacctggtccccaaggaggttgtggagaaatggctggattaccttcggaatgagttgccaaccgtggctttcaaggccagtacccagcatcaggtcaaaaacctgaatcgttgcagtgtgccagtagatcaggcctctgagtcactgctgaaaagcaaagcctgctttggagctgaaaacctcatgagggttctggggaactattgccgccttggtgaagtgcgcacccacattcgtgtgggtgttgtgggtcttcccaatgttgggaagagcagcctgatcaatagcctgaagcgcagccgcgcatgcagcgtgggagctgttcctggaattaccaaattcatgcaggaggtctacctggacaagttcatccggctcttggatgctccaggcattgtcccagggcccaactcagaggtgggcaccatcctgcgtaactgcgtccacgtgcagaagctggcagaccctgtgaccccagtggagaccatcctgcagcgctgcaacctggaggagatttccaactattatggcgtctctgggttccagaccactgagcactttctgacggcagtggcccaccgtttggggaagaagaagaagggaggcttatatagtcaggaacaggcggccaaagctgtcctagctgactgggtgagcgggaagatcagcttctatataccaccaccagccactcacactctgcccacccatctcagtgctgagatcgttaaggaaatgaccgaggtctttgacatcgaggatactgagcaggccaatgaagacaccatggaatgcttggccaccggagaatctgatgagctgttgggtgacacggacccacttgaaatggagatcaagttgctccattctccgatgacgaaaatagcagatgccattgaaaataaaaccaccgtgtataagattggagatctcactgggtattgcaccaatccgaaccgtcatcagatggggtgggctaaacgcaatgtggaccaccgccctaagagcaacagtatggtggatgtctgctcagtggaccgccgctcagtgctgcagaggatcatggagacggaccccctgcaacagggccaggctctggcatctgccctgaaaaataagaagaagatgcagaaacgtgcagannaatcccagcaagctgtggtgcagaantangatccgg

SEQ ID NO: 456691 - DNA, 7834 bp, Homo sapiens
ataatcagtggatgaaaggattttctcagacccttttttccgtgcttctggaggattaatccactacagtctgcaatttcagtggaaactgcaaggcacacgatgtggcaggagccgggagcgacttccgaattgttgtggacccttcctgtagcataggggagttttcacacttgcctccactcctccccttccccccaactccctccttctgatctcttctttttaatctgttcccattttccgagttaagttctatttccaaaactgttctctggagctataagtggattgccagaaatgagagattaggagctgggagaagaggaagcgccttgtgttgtgtctcctggaggctgccgacatgaagtgctttttcccggtgctgagctgtctggctgtgctgggtgtggtgtcagcacagcggcaggtcaccgttcaggaaggacccttgtaccgcacggagggctcccacatcactatctggtgcaatgtgagtggctaccagggaccttctgagcagaatttccagtggtccatttacctgccttcgtcgccagagcgagaggtgcagatcgtcagcaccatggactcttccttcccctatgccatctacacccagcgcgtccgcggagggaagatcttcatagaaagagtccaggggaactcaaccctattgcacatcacagatcttcaggcccgggatgccggggagtatgaatgccacacacccagcactgataagcaatactttgggagttacagtgcaaagatgaacctagtggtgatcccagactccctgcagaccactgccatgccccagactctgcacagagtggagcaggacccgctggagctcacttgtgaggtggcctcagagaccattcagcacagccacctgtctgtggcctggctccggcagaaagttggcgagaagcccgtggaggtcatctccctgagccgagatttcatgcttcactccagcagcgaatatgcccagaggcagagcctgggggaggtgcggctggacaagctggggaggaccaccttccgcctcaccatcttccacctgcagccttctgaccagggcgaattctactgcgaggccgccgagtggatccaggatccggatgggtcgtggtatgctatgacccgaaagcgttccgagggagccgtggtcaacgtccagccaactgacaaagaattcactgttcggctggagacagagaagcggctgcacacggtgggcgagccggtggagttcagatgcatcctggaggctcagaatgttcccgaccgttactttgctgtctcctgggccttcaacagctcgctcatcgccaccatgggtcctaacgctgtgcctgtcctcaacagcgaatttgctcaccgggaagccaggggacagcttaaggtggccaaagagagcgacagtgtctttgtgctgaagatctaccacctccgccaggaagatagcgggaaatacaactgccgggtgactgagcgagagaaaaccgtgaccggggaattcattgataaggagagcaagcgtcccaagaacatccccatcatagtcctccccctcacagataactgggtagttaaagtcccccagcaccaccagctcctgtcccaaggccacttggagagcagcatctccgtggaggtggccagcaatgccagcgtcatccttgagggcgaggacctgcgcttctcctgcagtgtccgcacggcaggcaggccgcagggtcgcttctctgtcatctggcagcttgtggacaggcagaaccgccgcagcaatatcatgtggctagaccgggatggcaccgtgcagccaggctcgtcctactgggagcgcagcagctttgggggcgtccagatggagcaggtgcagcccaactcgttcagcctgggcatcttcaacagcaggaaggaggacgagggccagtatgaatgccatgtgactgaatgggtgcgggcagtggatggcgagtggcagattgttggggagcgccgggccagcactcccatctccatcacagctcttgaaatgggcttcgcagtcacagccatctcccggacaccgggggtgacctacagcgactcctttgacttgcagtgtatcatcaaaccccactaccctgcctgggtccccgtgtcggtgacatggcggttccagccggtgggcacggtggagttccatgacttggtgaccttcacccgggacggaggggtccagtggggggacaggtcctccagcttccgaacccgaactgccatcgagaaggctgagtccagcaacaacgtccgcctaagcatcagccgagccagtgacacggaagcaggcaagtaccagtgtgtggcagagctgtggcggaagaactacaacaacacctggacgcgactggcggagaggacctccaacctgctggagatcagggtgctgcagccagtgacaaagctgcaggtgagcaaatcgaagaggaccctcaccctggtggaaaacaagcccattcagttgaactgctcagtcaagtctcagactagccagaactcccactttgcggtgctctggtatgtccacaagccctcggatgccgatggcaagcttatcctgaagaccacccacaactccgcctttgaatacggtacttacgccgaggaggagggcctgagagccaggctccagtttgagaggcatgtgtcggggggcctgttcagcctcaccgtccagagagccgaggtcagcgacagcggcagctactactgccacgtggaggagtggctgctgagccccaactacgcctggtacaagctggcagaggaggtttctgggcgcacagaagtcactgtgaaacagccagacagccgcctgaggctcagccaagcccaggggaacctgtcggttctggagacccggcaggtacagctggagtgtgtggttctcaaccgcaccagcataacctcccagctcatggtggaatggtttgtatggaagcccaaccaccctgagcgggagactgtggcccgcttgagccgtgacgccaccttccactatggagagcaggcagccaagaacaatctgaaggggcggctgcatttggagagtccttcccccggcgtgtaccgtctcttcatccagaacgtggctgtgcaggacagcgggacctacagctgccatgtggaggagtggctgcccagccccagtggcatgtggtataagcgggcagaggacaccgctgggcagacagctctgacagtcatgcgaccagatgcttccctgcaggtggacacagtggtccccaatgccacggtctctgagaaggcagctttccagctggactgtagcatcgtgtcccgctccagccaggactcccgcttcgctgtggcctggtattccctgaggactaaagctggggggaaaaggagcagccctggcctggaagaacaggaagaggaaagggaggaggaggaggaggaggacgacgacgacgacgacgacccaacagagcggacggccctgctgagcgtgggcccagatgctgtctttggcccagagggcagtccttgggagggcaggcttcgcttccagaggctctccccggtgctctaccggctcacagtgctgcaggcaagcccccaagatacaggcaattactcctgccatgtggaggagtggctgcccagccctcagaaggaatggtaccggctgacggaggaggagtcagcccccatcggcatccgtgttctagatacaagtcccaccctccagtccatcatctgctccaacgacgcactcttctacttcgtcttcttctaccctttccccatctttggcattcttatcatcaccatccttctggtgcgtttcaagagccggaactccagcaagaactctgatgggaagaatggggtgcctctgctgtggatcaaagagccacacctcaactactcccctacttgcctggagccccctgttctcagtatccatccaggggccatagactaagcgggtgatgccccagcggatgttggccacggaggagctgaggctctccctttctctgtgattggacagttgacagcacccaaactctggggtgcatgtgtgtggaaagttgtcagacttgaaaagtgttccaagttcccagtcagtcacagagacagactgcctctcggtggcagtcttggttggttagctatttgcgcgcaaatgttgtgatcctgccattatagatttcttgtttctgtttttagtaatgtagtgagtagctccaggtgccacatctactcacagatttatctagtattctcagatagatgttacagggcttcttattctttgtaatgtactctttttaaatccctttagtttaccctttttggattccttaatgtggacgaatttctcttacgtacaactgacagcaaaaggaagggcgaactttctagtgacaaggaatctcttccaagactttgtttttgcacatttgaaaatgccacccatggatcaaaatatacccaaacgttttttactttcttaacaagacttaagaattgtgtgtagtgtgggcaaaatttgtatgttgtcttttccctcagctggagttattggaaccactttgtagtcaagacgaaagcactgaattttgcttcaaagaactgtgtatgtacaagagaaatcctgcataaccccattaggagtagatggtgcccggcctatctgtcagggaggcaaaaaaggcttcatcccatccttgccaaaaaataagaaaactgtcttggagaatgggtcagaagccccaaacggcacacactttccaaattaaagtgggcaggggctgcttttagcagctgctgacctgcagatttgtcaaagccagtgactagagaaggaagggagaaaggctggctgttggcttgctctgagctgcaaggatggtctctaactgattaactgtgagcaggtgggcctgtgtcttcaggtgctttgccaaactcttaaaagaaagtgtccagtgaacttggaagtgggcccctgagctgagcacagggccaaagcagccatggcagacacctgacggagggcacggggctggctgacactaagtttggtgggacagtgaggggtgggaggggggtttccagggcctggtgttggagagtgcagagaaatatctacctccctggaggtgtgaagactaggtttttcttcttccttccaattagattttccttaattatagtgatgtcttccttattcatttttctctccctgcctctcactgccataagaatatcagcctgggggcagtccagacgcagccctttgtcatcctttctgtttgcctagtctcagcagactgtgatcacaaggcattgtctgtgggatttttcctttccctttcttgatctctcttgtggttctaggttgtttggttgttcattgttatggtggctttttattttaacgccccttgagccccatgatggctggtgtcaccctgttcttttacactgttgggccaggtgctgcttgtccttcttagggcatcatcaattgcaaatatttccttttgctccctttatgaagatgttcttatacccttgctttcccatatttttctggccaagcatgccatctcctttactctgggaacttacatcctgaatcccaagagggggtcacagtttggaaaaagtcatcagggattctggaactaagtctgataaaagattccagtgaagccctgttctgagaacgagcagactgcaggggaggccatgggattccccaggccagtgtctgtgctgatccttcaagggtctgcaggtatgcaggtggcctgggctgctcggcagatactttgctgattcccagctgaggggagcatggtggcgattgctcagccattttctgacagacacacagacctgccttttctcccccaagtataccgtaccctcctgtgagacagtgtgtgcaggcaccaccaccttaatcctgctgttgcctgacatgctgattctcatttattatgctgcatcaacacattagaggtacaggagcggctcagtcatgaaaaaagaaggtcttttgccccatttctttatttcagagatgtgggctttcagtgggaatttgctgactcctactttataggctgagtcaatgagggaagatgactggcgtttcctctgtctaaatgggaggttgccagagcgctggctgggactaggatgtgtaactaagatttcagtttgaaatcttagatttcagttcacggcgataaagaagtaggtgctgcacacaaatatgtaaagcaattgtaggaaatttgaaaggaaaaaaagaaaccgaagccagtattttaataattgctttttctgtgtattttgtattgggctgggggatagcatcaaaggttgaactttttgagctttctatgaaaaaccccaggaccttctttctttggccatttctatggaaatgcgatgtcagatggatggtaatggtgccctccagtggctgtgagacctcattgcgcattgtctactggagctttagtcttctgagacggaggaaaactgctgaatactctggattcatctatgtctacaatgttgcatttatgaaaaactacactgtgctaggcgcattctaggacatgaatatgaccacaccctctttcaccgggtgtttctgtagcaagttttcatattcttttcaaacaatggtttctctgcgttaattattgaggaaaaaaaaagatggggtaagaaaactacccatgcatgatgtagagagctgttgatttgtttctgtttttttaaaggaaaactatttgtaagatgttgcactaaaacattttatatacacttcagagacctgtagtaaattatgttgaaaataaaaaaaaaaaaaaaaaaaaaaaaaaaaaaacaaaaaaaaaaacaaacaaaaaaacaaaaaaagaaaaaacacaaaaaaaaaaaaaaacaaaaaaaaacgaaaaaaaaaaaaaaacacaaaaacaagggcggggggcggagagaaaggagagggggggaggagacggaagagagaaggagaggggggaggagagagggggaccggcagggggagggagataaaaggagagggcggggggcagacagaaagacgaagaggaaggaggggagagagagagaggcgagaaagatagaggaggcggaagaccgcaaaggaaaagggaggagggtgaactggaggagagaaggaacgaaagacacagaaagcagaagcgagacgggacagaggggccagagggaggaggatgggaatggagacaagagcgaaggaggggaaggaggggcaggtggaggtgaagtggatggaatgatgagagagagggagagcaggaagggggggcagggaagaggaagagcaacgagagcacagaagacaaaggaaagagccagaagaggaaaacaacggaaggagggggggggaaggcgaaagagaagagagaggagagaacagaaggaggcggggaaagggagaggccgaaagcaaggagaagaggaagagagaaggcgaagagggaaagaaaagaagaggaaggaaggagagaaagaaaagagaaaaacggggaagggcggaaacaaagagggagaggaaaactagcagagacgacaaagaaggaggagcggaacgaggagggagggaaggacagcaagagagaaacaaaggggaacgcacggagataagcgaggagatagacaggggcagaaagagaggagaagcgaaggaagagagacaaggaagcaaagagagaagaagaggtgcgtgtca

SEQ ID NO: 456692 - DNA, 7774 bp, Homo sapiens
ataatcagtggatgaaaggattttctcagacccttttttccgtgcttctggaggattaatccactacagtctgcaatttcagtggaaactgcaaggcacacgatgtggcaggagccgggagcgacttccgaattgttgtggacccttcctgtagcataggggagttttcacacttgcctccactcctccccttccccccaactccctccttctgatctcttctttttaatctgttcccattttccgagttaagttctatttccaaaactgttctctggagctataagtggattgccagaaatgagagattaggagctgggagaagaggaagcgccttgtgttgtgtctcctggaggctgccgacatgaagtgctttttcccggtgctgagctgtctggctgtgctgggtgtggtgtcagcacagcggcaggtcaccgttcaggaaggacccttgtaccgcacggagggctcccacatcactatctggtgcaatgtgagtggctaccagggaccttctgagcagaatttccagtggtccatttacctgccttcgtcgccagagcgagaggtgcagatcgtcagcaccatggactcttccttcccctatgccatctacacccagcgcgtccgcggagggaagatcttcatagaaagagtccaggggaactcaaccctattgcacatcacagatcttcaggcccgggatgccggggagtatgaatgccacacacccagcactgataagcaatactttgggagttacagtgcaaagatgaacctagtggtgatcccagactccctgcagaccactgccatgccccagactctgcacagagtggagcaggacccgctggagctcacttgtgaggtggcctcagagaccattcagcacagccacctgtctgtggcctggctccggcagaaagttggcgagaagcccgtggaggtcatctccctgagccgagatttcatgcttcactccagcagcgaatatgcccagaggcagagcctgggggaggtgcggctggacaagctggggaggaccaccttccgcctcaccatcttccacctgcagccttctgaccagggcgaattctactgcgaggccgccgagtggatccaggatccggatgggtcgtggtatgctatgacccgaaagcgttccgagggagccgtggtcaacgtccagccaactgacaaagaattcactgttcggctggagacagagaagcggctgcacacggtgggcgagccggtggagttcagatgcatcctggaggctcagaatgttcccgaccgttactttgctgtctcctgggccttcaacagctcgctcatcgccaccatgggtcctaacgctgtgcctgtcctcaacagcgaatttgctcaccgggaagccaggggacagcttaaggtggccaaagagagcgacagtgtctttgtgctgaagatctaccacctccgccaggaagatagcgggaaatacaactgccgggtgactgagcgagagaaaaccgtgaccggggaattcattgataaggagagcaagcgtcccaagaacatccccatcatagtcctccccctcaagagcagcatctccgtggaggtggccagcaatgccagcgtcatccttgagggcgaggacctgcgcttctcctgcagtgtccgcacggcaggcaggccgcagggtcgcttctctgtcatctggcagcttgtggacaggcagaaccgccgcagcaatatcatgtggctagaccgggatggcaccgtgcagccaggctcgtcctactgggagcgcagcagctttgggggcgtccagatggagcaggtgcagcccaactcgttcagcctgggcatcttcaacagcaggaaggaggacgagggccagtatgaatgccatgtgactgaatgggtgcgggcagtggatggcgagtggcagattgttggggagcgccgggccagcactcccatctccatcacagctcttgaaatgggcttcgcagtcacagccatctcccggacaccgggggtgacctacagcgactcctttgacttgcagtgtatcatcaaaccccactaccctgcctgggtccccgtgtcggtgacatggcggttccagccggtgggcacggtggagttccatgacttggtgaccttcacccgggacggaggggtccagtggggggacaggtcctccagcttccgaacccgaactgccatcgagaaggctgagtccagcaacaacgtccgcctaagcatcagccgagccagtgacacggaagcaggcaagtaccagtgtgtggcagagctgtggcggaagaactacaacaacacctggacgcgactggcggagaggacctccaacctgctggagatcagggtgctgcagccagtgacaaagctgcaggtgagcaaatcgaagaggaccctcaccctggtggaaaacaagcccattcagttgaactgctcagtcaagtctcagactagccagaactcccactttgcggtgctctggtatgtccacaagccctcggatgccgatggcaagcttatcctgaagaccacccacaactccgcctttgaatacggtacttacgccgaggaggagggcctgagagccaggctccagtttgagaggcatgtgtcggggggcctgttcagcctcaccgtccagagagccgaggtcagcgacagcggcagctactactgccacgtggaggagtggctgctgagccccaactacgcctggtacaagctggcagaggaggtttctgggcgcacagaagtcactgtgaaacagccagacagccgcctgaggctcagccaagcccaggggaacctgtcggttctggagacccggcaggtacagctggagtgtgtggttctcaaccgcaccagcataacctcccagctcatggtggaatggtttgtatggaagcccaaccaccctgagcgggagactgtggcccgcttgagccgtgacgccaccttccactatggagagcaggcagccaagaacaatctgaaggggcggctgcatttggagagtccttcccccggcgtgtaccgtctcttcatccagaacgtggctgtgcaggacagcgggacctacagctgccatgtggaggagtggctgcccagccccagtggcatgtggtataagcgggcagaggacaccgctgggcagacagctctgacagtcatgcgaccagatgcttccctgcaggtggacacagtggtccccaatgccacggtctctgagaaggcagctttccagctggactgtagcatcgtgtcccgctccagccaggactcccgcttcgctgtggcctggtattccctgaggactaaagctggggggaaaaggagcagccctggcctggaagaacaggaagaggaaagggaggaggaggaggaggaggacgacgacgacgacgacgacccaacagagcggacggccctgctgagcgtgggcccagatgctgtctttggcccagagggcagtccttgggagggcaggcttcgcttccagaggctctccccggtgctctaccggctcacagtgctgcaggcaagcccccaagatacaggcaattactcctgccatgtggaggagtggctgcccagccctcagaaggaatggtaccggctgacggaggaggagtcagcccccatcggcatccgtgttctagatacaagtcccaccctccagtccatcatctgctccaacgacgcactcttctacttcgtcttcttctaccctttccccatctttggcattcttatcatcaccatccttctggtgcgtttcaagagccggaactccagcaagaactctgatgggaagaatggggtgcctctgctgtggatcaaagagccacacctcaactactcccctacttgcctggagccccctgttctcagtatccatccaggggccatagactaagcgggtgatgccccagcggatgttggccacggaggagctgaggctctccctttctctgtgattggacagttgacagcacccaaactctggggtgcatgtgtgtggaaagttgtcagacttgaaaagtgttccaagttcccagtcagtcacagagacagactgcctctcggtggcagtcttggttggttagctatttgcgcgcaaatgttgtgatcctgccattatagatttcttgtttctgtttttagtaatgtagtgagtagctccaggtgccacatctactcacagatttatctagtattctcagatagatgttacagggcttcttattctttgtaatgtactctttttaaatccctttagtttaccctttttggattccttaatgtggacgaatttctcttacgtacaactgacagcaaaaggaagggcgaactttctagtgacaaggaatctcttccaagactttgtttttgcacatttgaaaatgccacccatggatcaaaatatacccaaacgttttttactttcttaacaagacttaagaattgtgtgtagtgtgggcaaaatttgtatgttgtcttttccctcagctggagttattggaaccactttgtagtcaagacgaaagcactgaattttgcttcaaagaactgtgtatgtacaagagaaatcctgcataaccccattaggagtagatggtgcccggcctatctgtcagggaggcaaaaaaggcttcatcccatccttgccaaaaaataagaaaactgtcttggagaatgggtcagaagccccaaacggcacacactttccaaattaaagtgggcaggggctgcttttagcagctgctgacctgcagatttgtcaaagccagtgactagagaaggaagggagaaaggctggctgttggcttgctctgagctgcaaggatggtctctaactgattaactgtgagcaggtgggcctgtgtcttcaggtgctttgccaaactcttaaaagaaagtgtccagtgaacttggaagtgggcccctgagctgagcacagggccaaagcagccatggcagacacctgacggagggcacggggctggctgacactaagtttggtgggacagtgaggggtgggaggggggtttccagggcctggtgttggagagtgcagagaaatatctacctccctggaggtgtgaagactaggtttttcttcttccttccaattagattttccttaattatagtgatgtcttccttattcatttttctctccctgcctctcactgccataagaatatcagcctgggggcagtccagacgcagccctttgtcatcctttctgtttgcctagtctcagcagactgtgatcacaaggcattgtctgtgggatttttcctttccctttcttgatctctcttgtggttctaggttgtttggttgttcattgttatggtggctttttattttaacgccccttgagccccatgatggctggtgtcaccctgttcttttacactgttgggccaggtgctgcttgtccttcttagggcatcatcaattgcaaatatttccttttgctccctttatgaagatgttcttatacccttgctttcccatatttttctggccaagcatgccatctcctttactctgggaacttacatcctgaatcccaagagggggtcacagtttggaaaaagtcatcagggattctggaactaagtctgataaaagattccagtgaagccctgttctgagaacgagcagactgcaggggaggccatgggattccccaggccagtgtctgtgctgatccttcaagggtctgcaggtatgcaggtggcctgggctgctcggcagatactttgctgattcccagctgaggggagcatggtggcgattgctcagccattttctgacagacacacagacctgccttttctcccccaagtataccgtaccctcctgtgagacagtgtgtgcaggcaccaccaccttaatcctgctgttgcctgacatgctgattctcatttattatgctgcatcaacacattagaggtacaggagcggctcagtcatgaaaaaagaaggtcttttgccccatttctttatttcagagatgtgggctttcagtgggaatttgctgactcctactttataggctgagtcaatgagggaagatgactggcgtttcctctgtctaaatgggaggttgccagagcgctggctgggactaggatgtgtaactaagatttcagtttgaaatcttagatttcagttcacggcgataaagaagtaggtgctgcacacaaatatgtaaagcaattgtaggaaatttgaaaggaaaaaaagaaaccgaagccagtattttaataattgctttttctgtgtattttgtattgggctgggggatagcatcaaaggttgaactttttgagctttctatgaaaaaccccaggaccttctttctttggccatttctatggaaatgcgatgtcagatggatggtaatggtgccctccagtggctgtgagacctcattgcgcattgtctactggagctttagtcttctgagacggaggaaaactgctgaatactctggattcatctatgtctacaatgttgcatttatgaaaaactacactgtgctaggcgcattctaggacatgaatatgaccacaccctctttcaccgggtgtttctgtagcaagttttcatattcttttcaaacaatggtttctctgcgttaattattgaggaaaaaaaaagatggggtaagaaaactacccatgcatgatgtagagagctgttgatttgtttctgtttttttaaaggaaaactatttgtaagatgttgcactaaaacattttatatacacttcagagacctgtagtaaattatgttgaaaataaaaaaaaaaaaaaaaaaaaaaaaaaaaaaacaaaaaaaaaaacaaacaaaaaaacaaaaaaagaaaaaacacaaaaaaaaaaaaaaacaaaaaaaaacgaaaaaaaaaaaaaaacacaaaaacaagggcggggggcggagagaaaggagagggggggaggagacggaagagagaaggagaggggggaggagagagggggaccggcagggggagggagataaaaggagagggcggggggcagacagaaagacgaagaggaaggaggggagagagagagaggcgagaaagatagaggaggcggaagaccgcaaaggaaaagggaggagggtgaactggaggagagaaggaacgaaagacacagaaagcagaagcgagacgggacagaggggccagagggaggaggatgggaatggagacaagagcgaaggaggggaaggaggggcaggtggaggtgaagtggatggaatgatgagagagagggagagcaggaagggggggcagggaagaggaagagcaacgagagcacagaagacaaaggaaagagccagaagaggaaaacaacggaaggagggggggggaaggcgaaagagaagagagaggagagaacagaaggaggcggggaaagggagaggccgaaagcaaggagaagaggaagagagaaggcgaagagggaaagaaaagaagaggaaggaaggagagaaagaaaagagaaaaacggggaagggcggaaacaaagagggagaggaaaactagcagagacgacaaagaaggaggagcggaacgaggagggagggaaggacagcaagagagaaacaaaggggaacgcacggagataagcgaggagatagacaggggcagaaagagaggagaagcgaaggaagagagacaaggaagcaaagagagaagaagaggtgcgtgtca

SEQ ID NO: 456693 - DNA, 6971 bp, Homo sapiens
agagtctggggcatggcagtggtctgcacagagtggagcaggacccgctggagctcacttgtgaggtggcctcagagaccattcagcacagccacctgtctgtggcctggctccggcagaaagttggcgagaagcccgtggaggtcatctccctgagccgagatttcatgcttcactccagcagcgaatatgcccagaggcagagcctgggggaggtgcggctggacaagctggggaggaccaccttccgcctcaccatcttccacctgcagccttctgaccagggcgaattctactgcgaggccgccgagtggatccaggatccggatgggtcgtggtatgctatgacccgaaagcgttccgagggagccgtggtcaacgtccagccaactgacaaagaattcactgttcggctggagacagagaagcggctgcacacggtgggcgagccggtggagttcagatgcatcctggaggctcagaatgttcccgaccgttactttgctgtctcctgggccttcaacagctcgctcatcgccaccatgggtcctaacgctgtgcctgtcctcaacagcgaatttgctcaccgggaagccaggggacagcttaaggtggccaaagagagcgacagtgtctttgtgctgaagatctaccacctccgccaggaagatagcgggaaatacaactgccgggtgactgagcgagagaaaaccgtgaccggggaattcattgataaggagagcaagcgtcccaagaacatccccatcatagtcctccccctcaagagcagcatctccgtggaggtggccagcaatgccagcgtcatccttgagggcgaggacctgcgcttctcctgcagtgtccgcacggcaggcaggccgcagggtcgcttctctgtcatctggcagcttgtggacaggcagaaccgccgcagcaatatcatgtggctagaccgggatggcaccgtgcagccaggctcgtcctactgggagcgcagcagctttgggggcgtccagatggagcaggtgcagcccaactcgttcagcctgggcatcttcaacagcaggaaggaggacgagggccagtatgaatgccatgtgactgaatgggtgcgggcagtggatggcgagtggcagattgttggggagcgccgggccagcactcccatctccatcacagctcttgaaatgggcttcgcagtcacagccatctcccggacaccgggggtgacctacagcgactcctttgacttgcagtgtatcatcaaaccccactaccctgcctgggtccccgtgtcggtgacatggcggttccagccggtgggcacggtggagttccatgacttggtgaccttcacccgggacggaggggtccagtggggggacaggtcctccagcttccgaacccgaactgccatcgagaaggctgagtccagcaacaacgtccgcctaagcatcagccgagccagtgacacggaagcaggcaagtaccagtgtgtggcagagctgtggcggaagaactacaacaacacctggacgcgactggcggagaggacctccaacctgctggagatcagggtgctgcagccagtgacaaagctgcaggtgagcaaatcgaagaggaccctcaccctggtggaaaacaagcccattcagttgaactgctcagtcaagtctcagactagccagaactcccactttgcggtgctctggtatgtccacaagccctcggatgccgatggcaagcttatcctgaagaccacccacaactccgcctttgaatacggtacttacgccgaggaggagggcctgagagccaggctccagtttgagaggcatgtgtcggggggcctgttcagcctcaccgtccagagagccgaggtcagcgacagcggcagctactactgccacgtggaggagtggctgctgagccccaactacgcctggtacaagctggcagaggaggtttctgggcgcacagaagtcactgtgaaacagccagacagccgcctgaggctcagccaagcccaggggaacctgtcggttctggagacccggcaggtacagctggagtgtgtggttctcaaccgcaccagcataacctcccagctcatggtggaatggtttgtatggaagcccaaccaccctgagcgggagactgtggcccgcttgagccgtgacgccaccttccactatggagagcaggcagccaagaacaatctgaaggggcggctgcatttggagagtccttcccccggcgtgtaccgtctcttcatccagaacgtggctgtgcaggacagcgggacctacagctgccatgtggaggagtggctgcccagccccagtggcatgtggtataagcgggcagaggacaccgctgggcagacagctctgacagtcatgcgaccagatgcttccctgcaggtggacacagtggtccccaatgccacggtctctgagaaggcagctttccagctggactgtagcatcgtgtcccgctccagccaggactcccgcttcgctgtggcctggtattccctgaggactaaagctggggggaaaaggagcagccctggcctggaagaacaggaagaggaaagggaggaggaggaggaggaggacgacgacgacgacgacgacccaacagagcggacggccctgctgagcgtgggcccagatgctgtctttggcccagagggcagtccttgggagggcaggcttcgcttccagaggctctccccggtgctctaccggctcacagtgctgcaggcaagcccccaagatacaggcaattactcctgccatgtggaggagtggctgcccagccctcagaaggaatggtaccggctgacggaggaggagtcagcccccatcggcatccgtgttctagatacaagtcccaccctccagtccatcatctgctccaacgacgcactcttctacttcgtcttcttctaccctttccccatctttggcattcttatcatcaccatccttctggtgcgtttcaagagccggaactccagcaagaactctgatgggaagaatggggtgcctctgctgtggatcaaagagccacacctcaactactcccctacttgcctggagccccctgttctcagtatccatccaggggccatagactaagcgggtgatgccccagcggatgttggccacggaggagctgaggctctccctttctctgtgattggacagttgacagcacccaaactctggggtgcatgtgtgtggaaagttgtcagacttgaaaagtgttccaagttcccagtcagtcacagagacagactgcctctcggtggcagtcttggttggttagctatttgcgcgcaaatgttgtgatcctgccattatagatttcttgtttctgtttttagtaatgtagtgagtagctccaggtgccacatctactcacagatttatctagtattctcagatagatgttacagggcttcttattctttgtaatgtactctttttaaatccctttagtttaccctttttggattccttaatgtggacgaatttctcttacgtacaactgacagcaaaaggaagggcgaactttctagtgacaaggaatctcttccaagactttgtttttgcacatttgaaaatgccacccatggatcaaaatatacccaaacgttttttactttcttaacaagacttaagaattgtgtgtagtgtgggcaaaatttgtatgttgtcttttccctcagctggagttattggaaccactttgtagtcaagacgaaagcactgaattttgcttcaaagaactgtgtatgtacaagagaaatcctgcataaccccattaggagtagatggtgcccggcctatctgtcagggaggcaaaaaaggcttcatcccatccttgccaaaaaataagaaaactgtcttggagaatgggtcagaagccccaaacggcacacactttccaaattaaagtgggcaggggctgcttttagcagctgctgacctgcagatttgtcaaagccagtgactagagaaggaagggagaaaggctggctgttggcttgctctgagctgcaaggatggtctctaactgattaactgtgagcaggtgggcctgtgtcttcaggtgctttgccaaactcttaaaagaaagtgtccagtgaacttggaagtgggcccctgagctgagcacagggccaaagcagccatggcagacacctgacggagggcacggggctggctgacactaagtttggtgggacagtgaggggtgggaggggggtttccagggcctggtgttggagagtgcagagaaatatctacctccctggaggtgtgaagactaggtttttcttcttccttccaattagattttccttaattatagtgatgtcttccttattcatttttctctccctgcctctcactgccataagaatatcagcctgggggcagtccagacgcagccctttgtcatcctttctgtttgcctagtctcagcagactgtgatcacaaggcattgtctgtgggatttttcctttccctttcttgatctctcttgtggttctaggttgtttggttgttcattgttatggtggctttttattttaacgccccttgagccccatgatggctggtgtcaccctgttcttttacactgttgggccaggtgctgcttgtccttcttagggcatcatcaattgcaaatatttccttttgctccctttatgaagatgttcttatacccttgctttcccatatttttctggccaagcatgccatctcctttactctgggaacttacatcctgaatcccaagagggggtcacagtttggaaaaagtcatcagggattctggaactaagtctgataaaagattccagtgaagccctgttctgagaacgagcagactgcaggggaggccatgggattccccaggccagtgtctgtgctgatccttcaagggtctgcaggtatgcaggtggcctgggctgctcggcagatactttgctgattcccagctgaggggagcatggtggcgattgctcagccattttctgacagacacacagacctgccttttctcccccaagtataccgtaccctcctgtgagacagtgtgtgcaggcaccaccaccttaatcctgctgttgcctgacatgctgattctcatttattatgctgcatcaacacattagaggtacaggagcggctcagtcatgaaaaaagaaggtcttttgccccatttctttatttcagagatgtgggctttcagtgggaatttgctgactcctactttataggctgagtcaatgagggaagatgactggcgtttcctctgtctaaatgggaggttgccagagcgctggctgggactaggatgtgtaactaagatttcagtttgaaatcttagatttcagttcacggcgataaagaagtaggtgctgcacacaaatatgtaaagcaattgtaggaaatttgaaaggaaaaaaagaaaccgaagccagtattttaataattgctttttctgtgtattttgtattgggctgggggatagcatcaaaggttgaactttttgagctttctatgaaaaaccccaggaccttctttctttggccatttctatggaaatgcgatgtcagatggatggtaatggtgccctccagtggctgtgagacctcattgcgcattgtctactggagctttagtcttctgagacggaggaaaactgctgaatactctggattcatctatgtctacaatgttgcatttatgaaaaactacactgtgctaggcgcattctaggacatgaatatgaccacaccctctttcaccgggtgtttctgtagcaagttttcatattcttttcaaacaatggtttctctgcgttaattattgaggaaaaaaaaagatggggtaagaaaactacccatgcatgatgtagagagctgttgatttgtttctgtttttttaaaggaaaactatttgtaagatgttgcactaaaacattttatatacacttcagagacctgtagtaaattatgttgaaaataaaaaaaaaaaaaaaaaaaaaaaaaaaaaaacaaaaaaaaaaacaaacaaaaaaacaaaaaaagaaaaaacacaaaaaaaaaaaaaaacaaaaaaaaacgaaaaaaaaaaaaaaacacaaaaacaagggcggggggcggagagaaaggagagggggggaggagacggaagagagaaggagaggggggaggagagagggggaccggcagggggagggagataaaaggagagggcggggggcagacagaaagacgaagaggaaggaggggagagagagagaggcgagaaagatagaggaggcggaagaccgcaaaggaaaagggaggagggtgaactggaggagagaaggaacgaaagacacagaaagcagaagcgagacgggacagaggggccagagggaggaggatgggaatggagacaagagcgaaggaggggaaggaggggcaggtggaggtgaagtggatggaatgatgagagagagggagagcaggaagggggggcagggaagaggaagagcaacgagagcacagaagacaaaggaaagagccagaagaggaaaacaacggaaggagggggggggaaggcgaaagagaagagagaggagagaacagaaggaggcggggaaagggagaggccgaaagcaaggagaagaggaagagagaaggcgaagagggaaagaaaagaagaggaaggaaggagagaaagaaaagagaaaaacggggaagggcggaaacaaagagggagaggaaaactagcagagacgacaaagaaggaggagcggaacgaggagggagggaaggacagcaagagagaaacaaaggggaacgcacggagataagcgaggagatagacaggggcagaaagagaggagaagcgaaggaagagagacaaggaagcaaagagagaagaagaggtgcgtgtca

SEQ ID NO: 456694 - DNA, 5049 bp, Homo sapiens
ataatcagtggatgaaaggattttctcagacccttttttccgtgcttctggaggattaatccactacagtctgcaatttcagtggaaactgcaaggcacacgatgtggcaggagccgggagcgacttccgaattgttgtggacccttcctgtagcataggggagttttcacacttgcctccactcctccccttccccccaactccctccttctgatctcttctttttaatctgttcccattttccgagttaagttctatttccaaaactgttctctggagctataagtggattgccagaaatgagagattaggagctgggagaagaggaagcgccttgtgttgtgtctcctggaggctgccgacatgaagtgctttttcccggtgctgagctgtctggctgtgctgggtgtggtgtcagcacagcggcaggtcaccgttcaggaaggacccttgtaccgcacggagggctcccacatcactatctggtgcaatgtgagtggctaccagggaccttctgagcagaatttccagtggtccatttacctgccttcgtcgccagagcgagaggtgcagatcgtcagcaccatggactcttccttcccctatgccatctacacccagcgcgtccgcggagggaagatcttcatagaaagagtccaggggaactcaaccctattgcacatcacagatcttcaggcccgggatgccggggagtatgaatgccacacacccagcactgataagcaatactttgggagttacagtgcaaagatgaacctagtggtgatcccagactccctgcagaccactgccatgccccagactctgcacagagtggagcaggacccgctggagctcacttgtgaggtggcctcagagaccattcagcacagccacctgtctgtggcctggctccggcagaaagttggcgagaagcccgtggaggtcatctccctgagccgagatttcatgcttcactccagcagcgaatatgcccagaggcagagcctgggggaggtgcggctggacaagctggggaggaccaccttccgcctcaccatcttccacctgcagccttctgaccagggcgaattctactgcgaggccgccgagtggatccaggatccggatgggtcgtggtatgctatgacccgaaagcgttccgagggagccgtggtcaacgtccagccaactgacaaagaattcactgttcggctggagacagagaagcggctgcacacggtgggcgagccggtggagttcagatgcatcctggaggctcagaatgttcccgaccgttactttgctgtctcctgggccttcaacagctcgctcatcgccaccatgggtcctaacgctgtgcctgtcctcaacagcgaatttgctcaccgggaagccaggggacagcttaaggtggccaaagagagcgacagtgtctttgtgctgaagatctaccacctccgccaggaagatagcgggaaatacaactgccgggtgactgagcgagagaaaaccgtgaccggggaattcattgataaggagagcaagcgtcccaagaacatccccatcatagtcctccccctcacagataactgggtagttaaagtcccccagcaccaccagctcctgtcccaaggccacttggagagcagcatctccgtggaggtggccagcaatgccagcgtcatccttgagggcgaggacctgcgcttctcctgcagtgtccgcacggcaggcaggccgcagggtcgcttctctgtcatctggcagcttgtggacaggcagaaccgccgcagcaatatcatgtggctagaccgggatggcaccgtgcagccaggctcgtcctactgggagcgcagcagctttgggggcgtccagatggagcaggtgcagcccaactcgttcagcctgggcatcttcaacagcaggaaggaggacgagggccagtatgaatgccatgtgactgaatgggtgcgggcagtggatggcgagtggcagattgttggggagcgccgggccagcactcccatctccatcacagctcttgaaatgggcttcgcagtcacagccatctcccggacaccgggggtgacctacagcgactcctttgacttgcagtgtatcatcaaaccccactaccctgcctgggtccccgtgtcggtgacatggcggttccagccggtgggcacggtggagttccatgacttggtgaccttcacccgggacggaggggtccagtggggggacaggtcctccagcttccgaacccgaactgccatcgagaaggctgagtccagcaacaacgtccgcctaagcatcagccgagccagtgacacggaagcaggcaagtaccagtgtgtggcagagctgtggcggaagaactacaacaacacctggacgcgactggcggagaggacctccaacctgctggagatcagggtgctgcagccagtgacaaagctgcaggtgagcaaatcgaagaggaccctcaccctggtggaaaacaagcccattcagttgaactgctcagtcaagtctcagactagccagaactcccactttgcggtgctctggtatgtccacaagccctcggatgccgatggcaagcttatcctgaagaccacccacaactccgcctttgaatacggtacttacgccgaggaggagggcctgagagccaggctccagtttgagaggcatgtgtcggggggcctgttcagcctcaccgtccagagagccgaggtcagcgacagcggcagctactactgccacgtggaggagtggctgctgagccccaactacgcctggtacaagctggcagaggaggtttctgggcgcacagaagtcactgtgaaacagccagacagccgcctgaggctcagccaagcccaggggaacctgtcggttctggagacccggcaggtacagctggagtgtgtggttctcaaccgcaccagcataacctcccagctcatggtggaatggtttgtatggaagcccaaccaccctgagcgggagactgtggcccgcttgagccgtgacgccaccttccactatggagagcaggcagccaagaacaatctgaaggggcggctgcatttggagagtccttcccccggcgtgtaccgtctcttcatccagaacgtggctgtgcaggacagcgggacctacagctgccatgtggaggagtggctgcccagccccagtggcatgtggtataagcgggcagaggacaccgctgggcagacagctctgacagtcatgcgaccagatgcttccctgcaggtggacacagtggtccccaatgccacggtctctgagaaggcagctttccagctggactgtagcatcgtgtcccgctccagccaggactcccgcttcgctgtggcctggtattccctgaggactaaagctggggggaaaaggagcagccctggcctggaagaacaggaagaggaaagggaggaggaggaggaggaggacgacgacgacgacgacgacccaacagagcggacggccctgctgagcgtgggcccagatgctgtctttggcccagagggcagtccttgggagggcaggcttcgcttccagaggctctccccggtgctctaccggctcacagtgctgcaggcaagcccccaagatacaggcaattactcctgccatgtggaggagtggctgcccagccctcagaaggaatggtaccggctgacggaggaggagtcagcccccatcggcatccgtgttctagatacaagtcccaccctccagtccatcatctgctccaacgacgcactcttctacttcgtcttcttctaccctttccccatctttggcattcttatcatcaccatccttctggtgcgtttcaagagccggaactccagcaagaactctgatgggaagaatggggtgcctctgctgtggatcaaagagccacacctcaactactcccctacttgcctggagccccctgttctcagtatccatccaggggccatagactaagcgggtgatgccccagcggatgttggccacggaggagctgaggctctccctttctctgtgattggacagttgacagcacccaaactctggggtgcatgtgtgtggaaagttgtcagacttgaaaagtgttccaagttcccagtcagtcacagagacagactgcctctcggtggcagtcttggttggttagctatttgcgcgcaaatgttgtgatcctgccattatagatttcttgtttctgtttttagtaatgtagtgagtagctccaggtgccacatctactcacagatttatctagtattctcagatagatgttacagggcttcttattctttgtaatgtactctttttaaatccctttagtttaccctttttggattccttaatgtggacgaatttctcttacgtacaactgacagcaaaaggaagggcgaactttctagtgacaaggaatctcttccaagactttgtttttgcacatttgaaaatgccacccatggatcaaaatatacccaaacgttttttactttcttaacaagacttaagaattgtgtgtagtgtgggcaaaatttgtatgttgtcttttccctcagctggagttattggaaccactttgtagtcaagacgaaagcactgaattttgcttcaaagaactgtgtatgtacaagagaaatcctgcataaccccattaggagtagatggtgcccggcctatctgtcagggaggcaaaaaaggcttcatcccatccttgccaaaaaataagaaaactgtcttggagaatgggtcagaagccccaaacggcacacactttccaaattaaagtgggcaggggctgcttttagcagctgctgacctgcagatttgtcaaagccagtgactagagaaggaagggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaa

SEQ ID NO: 456695 - DNA, 7114 bp, Homo sapiens
ataatcagtggatgaaaggattttctcagacccttttttccgtgcttctggaggattaatccactacagtctgcaatttcagtggaaactgcaaggcacacgatgtggcaggagccgggagcgacttccgaattgttgtggacccttcctgtagcataggggagttttcacacttgcctccactcctccccttccccccaactccctccttctgatctcttctttttaatctgttcccattttccgagttaagttctatttccaaaactgttctctggagctataagtggattgccagaaatgagagattaggagctgggagaagaggaagcgccttgtgttgtgtctcctggaggctgccgacatgaagtgctttttcccggtgctgagctgtctggctgtgctgggtgtggtgtcagcacagcggcaggtcaccgttcaggaaggacccttgtaccgcacggagggctcccacatcactatctggtgcaatgtgagtggctaccagggaccttctgagcagaatttccagtggtccatttacctgccttcgtcgccagagcgagaggtgcagatcgtcagcaccatggactcttccttcccctatgccatctacacccagcgcgtccgcggagggaagatcttcatagaaagagtccaggggaactcaaccctattgcacatcacagatcttcaggcccgggatgccggggagtatgaatgccacacacccagcactgataagcaatactttgggagttacagtgcaaagatgaacctagtggtgatcccagactccctgcagaccactgccatgccccagactctgcacagagtggagcaggacccgctggagctcacttgtgaggtggcctcagagaccattcagcacagccacctgtctgtggcctggctccggcagaaagttggcgagaagcccgtggaggtcatctccctgagccgagatttcatgcttcactccagcagcgaatatgcccagaggcagagcctgggggaggtgcggctggacaagctggggaggaccaccttccgcctcaccatcttccacctgcagccttctgaccagggcgaattctactgcgaggccgccgagtggatccaggatccggatgggtcgtggtatgctatgacccgaaagcgttccgagggagccgtggtcaacgtccagccaactgacaaagaattcactgttcggctggagacagagaagcggctgcacacggtgggcgagccggtggagttcagatgcatcctggaggctcagaatgttcccgaccgttactttgctgtctcctgggccttcaacagctcgctcatcgccaccatgggtcctaacgctgtgcctgtcctcaacagcgaatttgctcaccgggaagccaggggacagcttaaggtggccaaagagagcgacagtgtctttgtgctgaagatctaccacctccgccaggaagatagcgggaaatacaactgccgggtgactgagcgagagaaaaccgtgaccggggaattcattgataaggagagcaagcgtcccaagaacatccccatcatagtcctccccctcacagataactgggtagttaaagtcccccagcaccaccagctcctgtcccaaggccacttggagagcagcatctccgtggaggtggccagcaatgccagcgtcatccttgagggcgaggacctgcgcttctcctgcagtgtccgcacggcaggcaggccgcagggtcgcttctctgtcatctggcagcttgtggacaggcagaaccgccgcagcaatatcatgtggctagaccgggatggcaccgtgcagccaggctcgtcctactgggagcgcagcagctttgggggcgtccagatggagcaggtgcagcccaactcgttcagcctgggcatcttcaacagcaggaaggaggacgagggccagtatgaatgccatgtgactgaatgggtgcgggcagtggatggcgagtggcagattgttggggagcgccgggccagcactcccatctccatcacagctcttgaaatgggcttcgcagtcacagccatctcccggacaccgggggtgacctacagcgactcctttgacttgcagtgtatcatcaaaccccactaccctgcctgggtccccgtgtcggtgacatggcggttccagccggtgggcacggtggagttccatgacttggtgaccttcacccgggacggaggggtccagtggggggacaggtcctccagcttccgaacccgaactgccatcgagaaggctgagtccagcaacaacgtccgcctaagcatcagccgagccagtgacacggaagcaggcaagtaccagtgtgtggcagagctgtggcggaagaactacaacaacacctggacgcgactggcggagaggacctccaacctgctggagatcagggtgctgcagccagtgacaaagctgcaggtgagcaaatcgaagaggaccctcaccctggtggaaaacaagcccattcagttgaactgctcagtcaagtctcagactagccagaactcccactttgcggtgctctggtatgtccacaagccctcggatgccgatggcaagcttatcctgaagaccacccacaactccgcctttgaatacggtacttacgccgaggaggagggcctgagagccaggctccagtttgagaggcatgtgtcggggggcctgttcagcctcaccgtccagagagccgaggtcagcgacagcggcagctactactgccacgtggaggagtggctgctgagccccaactacgcctggtacaagctggcagaggaggtttctgggcgcacagaagtcactgtgaaacagccagacagccgcctgaggctcagccaagcccaggggaacctgtcggttctggagacccggcaggtacagctggagtgtgtggttctcaaccgcaccagcataacctcccagctcatggtggaatggtttgtatggaagcccaaccaccctgagcgggagactgtggcccgcttgagccgtgacgccaccttccactatggagagcaggcagccaagaacaatctgaaggggcggctgcatttggagagtccttcccccggcgtgtaccgtctcttcatccagaacgtggctgtgcaggacagcgggacctacagctgccatgtggaggagtggctgcccagccccagtggcatgtggtataagcgggcagaggacaccgctgggcagacagctctgacagtcatgcgaccagatgcttccctgcaggtggacacagtggtccccaatgccacggtctctgagaaggcagctttccagctggactgtagcatcgtgtcccgctccagccaggactcccgcttcgctgtggcctggtattccctgaggactaaagctggggggaaaaggagcagccctggcctggaagaacaggaagaggaaagggaggaggaggaggaggaggacgacgacgacgacgacgacccaacagagcggacggccctgctgagcgtgggcccagatgctgtctttggcccagagggcagtccttgggagggcaggcttcgcttccagaggctctccccggtgctctaccggctcacagtgctgcaggcaagcccccaagatacaggcaattactcctgccatgtggaggagtggctgcccagccctcagaaggaatggtaccggctgacggaggaggagtcagcccccatcggcatccgtgttctagatacaagtcccaccctccagtccatcatctgctccaacgacgcactcttctacttcgtcttcttctaccctttccccatctttggcattcttatcatcaccatccttctggtgcgtttcaagagccggaactccagcaagaactctgatgggaagaatggggtgcctctgctgtggatcaaagagccacacctcaactactcccctacttgcctggagccccctgttctcagtatccatccaggggccatagactaagcgggtgatgccccagcggatgttggccacggaggagctgaggctctccctttctctgtgattggacagttgacagcacccaaactctggggtgcatgtgtgtggaaagttgtcagacttgaaaagtgttccaagttcccagtcagtcacagagacagactgcctctcggtggcagtcttggttggttagctatttgcgcgcaaatgttgtgatcctgccattatagatttcttgtttctgtttttagtaatgtagtgagtagctccaggtgccacatctactcacagatttatctagtattctcagatagatgttacagggcttcttattctttgtaatgtactctttttaaatccctttagtttaccctttttggattccttaatgtggacgaatttctcttacgtacaactgacagcaaaaggaagggcgaactttctagtgacaaggaatctcttccaagactttgtttttgcacatttgaaaatgccacccatggatcaaaatatacccaaacgttttttactttcttaacaagacttaagaattgtgtgtagtgtgggcaaaatttgtatgttgtcttttccctcagctggagttattggaaccactttgtagtcaagacgaaagcactgaattttgcttcaaagaactgtgtatgtacaagagaaatcctgcataaccccattaggagtagatggtgcccggcctatctgtcagggaggcaaaaaaggcttcatcccatccttgccaaaaaataagaaaactgtcttggagaatgggtcagaagccccaaacggcacacactttccaaattaaagtgggcaggggctgcttttagcagctgctgacctgcagatttgtcaaagccagtgactagagaaggaagggagaaaggctggctgttggcttgctctgagctgcaaggatggtctctaactgattaactgtgagcaggtgggcctgtgtcttcaggtgctttgccaaactcttaaaagaaagtgtccagtgaacttggaagtgggcccctgagctgagcacagggccaaagcagccatggcagacacctgacggagggcacggggctggctgacactaagtttggtgggacagtgaggggtgggaggggggtttccagggcctggtgttggagagtgcagagaaatatctacctccctggaggtgtgaagactaggtttttcttcttccttccaattagattttccttaattatagtgatgtcttccttattcatttttctctccctgcctctcactgccataagaatatcagcctgggggcagtccagacgcagccctttgtcatcctttctgtttgcctagtctcagcagactgtgatcacaaggcattgtctgtgggatttttcctttccctttcttgatctctcttgtggttctaggttgtttggttgttcattgttatggtggctttttattttaacgccccttgagccccatgatggctggtgtcaccctgttcttttacactgttgggccaggtgctgcttgtccttcttagggcatcatcaattgcaaatatttccttttgctccctttatgaagatgttcttatacccttgctttcccatatttttctggccaagcatgccatctcctttactctgggaacttacatcctgaatcccaagagggggtcacagtttggaaaaagtcatcagggattctggaactaagtctgataaaagattccagtgaagccctgttctgagaacgagcagactgcaggggaggccatgggattccccaggccagtgtctgtgctgatccttcaagggtctgcaggtatgcaggtggcctgggctgctcggcagatactttgctgattcccagctgaggggagcatggtggcgattgctcagccattttctgacagacacacagacctgccttttctcccccaagtataccgtaccctcctgtgagacagtgtgtgcaggcaccaccaccttaatcctgctgttgcctgacatgctgattctcatttattatgctgcatcaacacattagaggtacaggagcggctcagtcatgaaaaaagaaggtcttttgccccatttctttatttcagagatgtgggctttcagtgggaatttgctgactcctactttataggctgagtcaatgagggaagatgactggcgtttcctctgtctaaatgggaggttgccagagcgctggctgggactaggatgtgtaactaagatttcagtttgaaatcttagatttcagttcacggcgataaagaagtaggtgctgcacacaaatatgtaaagcaattgtaggaaatttgaaaggaaaaaaagaaaccgaagccagtattttaataattgctttttctgtgtattttgtattgggctgggggatagcatcaaaggttgaactttttgagctttctatgaaaaaccccaggaccttctttctttggccatttctatggaaatgcgatgtcagatggatggtaatggtgccctccagtggctgtgagacctcattgcgcattgtctactggagctttagtcttctgagacggaggaaaactgctgaatactctggattcatctatgtctacaatgttgcatttatgaaaaactacactgtgctaggcgcattctaggacatgaatatgaccacaccctctttcaccgggtgtttctgtagcaagttttcatattcttttcaaacaatggtttctctgcgttaattattgaggaaaaaaaaagatggggtaagaaaactacccatgcatgatgtagagagctgttgatttgtttctgtttttttaaaggaaaactatttgtaagatgttgcactaaaacattttatatacacttcagagacctgtagtaaattatgttgaaaatacggctgtttacatttactgcagtcttctatccttctttccccttactaaccagcccccttcctctgtggaactgtgctgtgggagcctacagttctgcccttggcattggcctgctaggctcaaggtctgtgaattgcagtctttattattacaccccataaccttcaaatgataaaaacacctcttcctcaagacacttc

SEQ ID NO: 456696 - DNA, 7145 bp, Homo sapiens
ataatcagtggatgaaaggattttctcagacccttttttccgtgcttctggaggattaatccactacagtctgcaatttcagtggaaactgcaaggcacacgatgtggcaggagccgggagcgacttccgaattgttgtggacccttcctgtagcataggggagttttcacacttgcctccactcctccccttccccccaactccctccttctgatctcttctttttaatctgttcccattttccgagttaagttctatttccaaaactgttctctggagctataagtggattgccagaaatgagagattaggagctgggagaagaggaagcgccttgtgttgtgtctcctggaggctgccgacatgaagtgctttttcccggtgctgagctgtctggctgtgctgggtgtggtgtcagcacagcggcaggtcaccgttcaggaaggacccttgtaccgcacggagggctcccacatcactatctggtgcaatgtgagtggctaccagggaccttctgagcagaatttccagtggtccatttacctgccttcgtcgccagagcgagaggtgcagatcgtcagcaccatggactcttccttcccctatgccatctacacccagcgcgtccgcggagggaagatcttcatagaaagagtccaggggaactcaaccctattgcacatcacagatcttcaggcccgggatgccggggagtatgaatgccacacacccagcactgataagcaatactttgggagttacagtgcaaagatgaacctagtggtgatcccagactccctgcagaccactgccatgccccagactctgcacagagtggagcaggacccgctggagctcacttgtgaggtggcctcagagaccattcagcacagccacctgtctgtggcctggctccggcagaaagttggcgagaagcccgtggaggtcatctccctgagccgagatttcatgcttcactccagcagcgaatatgcccagaggcagagcctgggggaggtgcggctggacaagctggggaggaccaccttccgcctcaccatcttccacctgcagccttctgaccagggcgaattctactgcgaggccgccgagtggatccaggatccggatgggtcgtggtatgctatgacccgaaagcgttccgagggagccgtggtcaacgtccagccaactgacaaagaattcactgttcggctggagacagagaagcggctgcacacggtgggcgagccggtggagttcagatgcatcctggaggctcagaatgttcccgaccgttactttgctgtctcctgggccttcaacagctcgctcatcgccaccatgggtcctaacgctgtgcctgtcctcaacagcgaatttgctcaccgggaagccaggggacagcttaaggtggccaaagagagcgacagtgtctttgtgctgaagatctaccacctccgccaggaagatagcgggaaatacaactgccgggtgactgagcgagagaaaaccgtgaccggggaattcattgataaggagagcaagcgtcccaagaacatccccatcatagtcctccccctcacagataactgggtagttaaagtcccccagcaccaccagctcctgtcccaaggccacttggagagcagcatctccgtggaggtggccagcaatgccagcgtcatccttgagggcgaggacctgcgcttctcctgcagtgtccgcacggcaggcaggccgcagggtcgcttctctgtcatctggcagcttgtggacaggcagaaccgccgcagcaatatcatgtggctagaccgggatggcaccgtgcagccaggctcgtcctactgggagcgcagcagctttgggggcgtccagatggagcaggtgcagcccaactcgttcagcctgggcatcttcaacagcaggaaggaggacgagggccagtatgaatgccatgtgactgaatgggtgcgggcagtggatggcgagtggcagattgttggggagcgccgggccagcactcccatctccatcacagctcttgaaatgggcttcgcagtcacagccatctcccggacaccgggggtgacctacagcgactcctttgacttgcagtgtatcatcaaaccccactaccctgcctgggtccccgtgtcggtgacatggcggttccagccggtgggcacggtggagttccatgacttggtgaccttcacccgggacggaggggtccagtggggggacaggtcctccagcttccgaacccgaactgccatcgagaaggctgagtccagcaacaacgtccgcctaagcatcagccgagccagtgacacggaagcaggcaagtaccagtgtgtggcagagctgtggcggaagaactacaacaacacctggacgcgactggcggagaggacctccaacctgctggagatcagggtgctgcagccagtgacaaagctgcaggtgagcaaatcgaagaggaccctcaccctggtggaaaacaagcccattcagttgaactgctcagtcaagtctcagactagccagaactcccactttgcggtgctctggtatgtccacaagccctcggatgccgatggcaagcttatcctgaagaccacccacaactccgcctttgaatacggtacttacgccgaggaggagggcctgagagccaggctccagtttgagaggcatgtgtcggggggcctgttcagcctcaccgtccagagagccgaggtcagcgacagcggcagctactactgccacgtggaggagtggctgctgagccccaactacgcctggtacaagctggcagaggaggtttctgggcgcacagaagtcactgtgaaacagccagacagccgcctgaggctcagccaagcccaggggaacctgtcggttctggagacccggcaggtacagctggagtgtgtggttctcaaccgcaccagcataacctcccagctcatggtggaatggtttgtatggaagcccaaccaccctgagcgggagactgtggcccgcttgagccgtgacgccaccttccactatggagagcaggcagccaagaacaatctgaaggggcggctgcatttggagagtccttcccccggcgtgtaccgtctcttcatccagaacgtggctgtgcaggacagcgggacctacagctgccatgtggaggagtggctgcccagccccagtggcatgtggtataagcgggcagaggacaccgctgggcagacagctctgacagtcatgcgaccagatgcttccctgcaggtggacacagtggtccccaatgccacggtctctgagaaggcagctttccagctggactgtagcatcgtgtcccgctccagccaggactcccgcttcgctgtggcctggtattccctgaggactaaagctggggggaaaaggagcagccctggcctggaagaacaggaagaggaaagggaggaggaggaggaggaggacgacgacgacgacgacgacccaacagagcggacggccctgctgagcgtgggcccagatgctgtctttggcccagagggcagtccttgggagggcaggcttcgcttccagaggctctccccggtgctctaccggctcacagtgctgcaggcaagcccccaagatacaggcaattactcctgccatgtggaggagtggctgcccagccctcagaaggaatggtaccggctgacggaggaggagtcagcccccatcggcatccgtgttctagatacaagtcccaccctccagtccatcatctgctccaacgacgcactcttctacttcgtcttcttctaccctttccccatctttggcattcttatcatcaccatccttctggtgcgtttcaagagccggaactccagcaagaactctgatgggaagaatggggtgcctctgctgtggatcaaagagccacacctcaactactcccctacttgcctggagccccctgttctcagtatccatccaggggccatagactaagcgggtgatgccccagcggatgttggccacggaggagctgaggctctccctttctctgtgattggacagttgacagcacccaaactctggggtgcatgtgtgtggaaagttgtcagacttgaaaagtgttccaagttcccagtcagtcacagagacagactgcctctcggtggcagtcttggttggttagctatttgcgcgcaaatgttgtgatcctgccattatagatttcttgtttctgtttttagtaatgtagtgagtagctccaggtgccacatctactcacagatttatctagtattctcagatagatgttacagggcttcttattctttgtaatgtactctttttaaatccctttagtttaccctttttggattccttaatgtggacgaatttctcttacgtacaactgacagcaaaaggaagggcgaactttctagtgacaaggaatctcttccaagactttgtttttgcacatttgaaaatgccacccatggatcaaaatatacccaaacgttttttactttcttaacaagacttaagaattgtgtgtagtgtgggcaaaatttgtatgttgtcttttccctcagctggagttattggaaccactttgtagtcaagacgaaagcactgaattttgcttcaaagaactgtgtatgtacaagagaaatcctgcataaccccattaggagtagatggtgcccggcctatctgtcagggaggcaaaaaaggcttcatcccatccttgccaaaaaataagaaaactgtcttggagaatgggtcagaagccccaaacggcacacactttccaaattaaagtgggcaggggctgcttttagcagctgctgacctgcagatttgtcaaagccagtgactagagaaggaagggagaaaggctggctgttggcttgctctgagctgcaaggatggtctctaactgattaactgtgagcaggtgggcctgtgtcttcaggtgctttgccaaactcttaaaagaaagtgtccagtgaacttggaagtgggcccctgagctgagcacagggccaaagcagccatggcagacacctgacggagggcacggggctggctgacactaagtttggtgggacagtgaggggtgggaggggggtttccagggcctggtgttggagagtgcagagaaatatctacctccctggaggtgtgaagactaggtttttcttcttccttccaattagattttccttaattatagtgatgtcttccttattcatttttctctccctgcctctcactgccataagaatatcagcctgggggcagtccagacgcagccctttgtcatcctttctgtttgcctagtctcagcagactgtgatcacaaggcattgtctgtgggatttttcctttccctttcttgatctctcttgtggttctaggttgtttggttgttcattgttatggtggctttttattttaacgccccttgagccccatgatggctggtgtcaccctgttcttttacactgttgggccaggtgctgcttgtccttcttagggcatcatcaattgcaaatatttccttttgctccctttatgaagatgttcttatacccttgctttcccatatttttctggccaagcatgccatctcctttactctgggaacttacatcctgaatcccaagagggggtcacagtttggaaaaagtcatcagggattctggaactaagtctgataaaagattccagtgaagccctgttctgagaacgagcagactgcaggggaggccatgggattccccaggccagtgtctgtgctgatccttcaagggtctgcaggtatgcaggtggcctgggctgctcggcagatactttgctgattcccagctgaggggagcatggtggcgattgctcagccattttctgacagacacacagacctgccttttctcccccaagtataccgtaccctcctgtgagacagtgtgtgcaggcaccaccaccttaatcctgctgttgcctgacatgctgattctcatttattatgctgcatcaacacattagaggtacaggagcggctcagtcatgaaaaaagaaggtcttttgccccatttctttatttcagagatgtgggctttcagtgggaatttgctgactcctactttataggctgagtcaatgagggaagatgactggcgtttcctctgtctaaatgggaggttgccagagcgctggctgggactaggatgtgtaactaagatttcagtttgaaatcttagatttcagttcacggcgataaagaagtaggtgctgcacacaaatatgtaaagcaattgtaggaaatttgaaaggaaaaaaagaaaccgaagccagtattttaataattgctttttctgtgtattttgtattgggctgggggatagcatcaaaggttgaactttttgagctttctatgaaaaaccccaggaccttctttctttggccatttctatggaaatgcgatgtcagatggatggtaatggtgccctccagtggctgtgagacctcattgcgcattgtctactggagctttagtcttctgagacggaggaaaactgctgaatactctggattcatctatgtctacaatgttgcatttatgaaaaactacactgtgctaggcgcattctaggacatgaatatgaccacaccctctttcaccgggtgtttctgtagcaagttttcatattcttttcaaacaatggtttctctgcgttaattattgaggaaaaaaaaagatggggtaagaaaactacccatgcatgatgtagagagctgttgatttgtttctgtttttttaaaggaaaactatttgtaagatgttgcactaaaacattttatatacacttcagaaaaacaacaagagatactaccaaacaaacaacacttgttcggggcccgttggggcctcaaaaagtgtttctaaacaccattcctgttgggggcgcgggcgcgcatattgtgtatctgcaacctttggccatacgcttggtcccaagagcgaccccgggcatagaacaactgcgtggttttctcccaattagaaaacccgccgggacacccaggtcgtttgaagaaatccaagaggttcaaagggcctaaggggtttacg

SEQ ID NO: 456697 - DNA, 7246 bp, Homo sapiens
gtgaactgattaccacattcaagtacagttaacacacactgatcacggtatctagttaccatttggtgtgataacatttgagagctactctgtaagcaaatttcaagtatacaatacagtatggttaaccatagttgccatgtgctacattagacccccagaacttgacaacaatcacatcatgaacaatcacatcatgaacaatcacatcatgaacaatcacatcatggtgattgtggcaaagatgaacctagtggtgatcccagactccctgcagaccactgccatgccccagactctgcacagagtggagcaggacccgctggagctcacttgtgaggtggcctcagagaccattcagcacagccacctgtctgtggcctggctccggcagaaagttggcgagaagcccgtggaggtcatctccctgagccgagatttcatgcttcactccagcagcgaatatgcccagaggcagagcctgggggaggtgcggctggacaagctggggaggaccaccttccgcctcaccatcttccacctgcagccttctgaccagggcgaattctactgcgaggccgccgagtggatccaggatccggatgggtcgtggtatgctatgacccgaaagcgttccgagggagccgtggtcaacgtccagccaactgacaaagaattcactgttcggctggagacagagaagcggctgcacacggtgggcgagccggtggagttcagatgcatcctggaggctcagaatgttcccgaccgttactttgctgtctcctgggccttcaacagctcgctcatcgccaccatgggtcctaacgctgtgcctgtcctcaacagcgaatttgctcaccgggaagccaggggacagcttaaggtggccaaagagagcgacagtgtctttgtgctgaagatctaccacctccgccaggaagatagcgggaaatacaactgccgggtgactgagcgagagaaaaccgtgaccggggaattcattgataaggagagcaagcgtcccaagaacatccccatcatagtcctccccctcaagagcagcatctccgtggaggtggccagcaatgccagcgtcatccttgagggcgaggacctgcgcttctcctgcagtgtccgcacggcaggcaggccgcagggtcgcttctctgtcatctggcagcttgtggacaggcagaaccgccgcagcaatatcatgtggctagaccgggatggcaccgtgcagccaggctcgtcctactgggagcgcagcagctttgggggcgtccagatggagcaggtgcagcccaactcgttcagcctgggcatcttcaacagcaggaaggaggacgagggccagtatgaatgccatgtgactgaatgggtgcgggcagtggatggcgagtggcagattgttggggagcgccgggccagcactcccatctccatcacagctcttgaaatgggcttcgcagtcacagccatctcccggacaccgggggtgacctacagcgactcctttgacttgcagtgtatcatcaaaccccactaccctgcctgggtccccgtgtcggtgacatggcggttccagccggtgggcacggtggagttccatgacttggtgaccttcacccgggacggaggggtccagtggggggacaggtcctccagcttccgaacccgaactgccatcgagaaggctgagtccagcaacaacgtccgcctaagcatcagccgagccagtgacacggaagcaggcaagtaccagtgtgtggcagagctgtggcggaagaactacaacaacacctggacgcgactggcggagaggacctccaacctgctggagatcagggtgctgcagccagtgacaaagctgcaggtgagcaaatcgaagaggaccctcaccctggtggaaaacaagcccattcagttgaactgctcagtcaagtctcagactagccagaactcccactttgcggtgctctggtatgtccacaagccctcggatgccgatggcaagcttatcctgaagaccacccacaactccgcctttgaatacggtacttacgccgaggaggagggcctgagagccaggctccagtttgagaggcatgtgtcggggggcctgttcagcctcaccgtccagagagccgaggtcagcgacagcggcagctactactgccacgtggaggagtggctgctgagccccaactacgcctggtacaagctggcagaggaggtttctgggcgcacagaagtcactgtgaaacagccagacagccgcctgaggctcagccaagcccaggggaacctgtcggttctggagacccggcaggtacagctggagtgtgtggttctcaaccgcaccagcataacctcccagctcatggtggaatggtttgtatggaagcccaaccaccctgagcgggagactgtggcccgcttgagccgtgacgccaccttccactatggagagcaggcagccaagaacaatctgaaggggcggctgcatttggagagtccttcccccggcgtgtaccgtctcttcatccagaacgtggctgtgcaggacagcgggacctacagctgccatgtggaggagtggctgcccagccccagtggcatgtggtataagcgggcagaggacaccgctgggcagacagctctgacagtcatgcgaccagatgcttccctgcaggtggacacagtggtccccaatgccacggtctctgagaaggcagctttccagctggactgtagcatcgtgtcccgctccagccaggactcccgcttcgctgtggcctggtattccctgaggactaaagctggggggaaaaggagcagccctggcctggaagaacaggaagaggaaagggaggaggaggaggaggaggacgacgacgacgacgacgacccaacagagcggacggccctgctgagcgtgggcccagatgctgtctttggcccagagggcagtccttgggagggcaggcttcgcttccagaggctctccccggtgctctaccggctcacagtgctgcaggcaagcccccaagatacaggcaattactcctgccatgtggaggagtggctgcccagccctcagaaggaatggtaccggctgacggaggaggagtcagcccccatcggcatccgtgttctagatacaagtcccaccctccagtccatcatctgctccaacgacgcactcttctacttcgtcttcttctaccctttccccatctttggcattcttatcatcaccatccttctggtgcgtttcaagagccggaactccagcaagaactctgatgggaagaatggggtgcctctgctgtggatcaaagagccacacctcaactactcccctacttgcctggagccccctgttctcagtatccatccaggggccatagactaagcgggtgatgccccagcggatgttggccacggaggagctgaggctctccctttctctgtgattggacagttgacagcacccaaactctggggtgcatgtgtgtggaaagttgtcagacttgaaaagtgttccaagttcccagtcagtcacagagacagactgcctctcggtggcagtcttggttggttagctatttgcgcgcaaatgttgtgatcctgccattatagatttcttgtttctgtttttagtaatgtagtgagtagctccaggtgccacatctactcacagatttatctagtattctcagatagatgttacagggcttcttattctttgtaatgtactctttttaaatccctttagtttaccctttttggattccttaatgtggacgaatttctcttacgtacaactgacagcaaaaggaagggcgaactttctagtgacaaggaatctcttccaagactttgtttttgcacatttgaaaatgccacccatggatcaaaatatacccaaacgttttttactttcttaacaagacttaagaattgtgtgtagtgtgggcaaaatttgtatgttgtcttttccctcagctggagttattggaaccactttgtagtcaagacgaaagcactgaattttgcttcaaagaactgtgtatgtacaagagaaatcctgcataaccccattaggagtagatggtgcccggcctatctgtcagggaggcaaaaaaggcttcatcccatccttgccaaaaaataagaaaactgtcttggagaatgggtcagaagccccaaacggcacacactttccaaattaaagtgggcaggggctgcttttagcagctgctgacctgcagatttgtcaaagccagtgactagagaaggaagggagaaaggctggctgttggcttgctctgagctgcaaggatggtctctaactgattaactgtgagcaggtgggcctgtgtcttcaggtgctttgccaaactcttaaaagaaagtgtccagtgaacttggaagtgggcccctgagctgagcacagggccaaagcagccatggcagacacctgacggagggcacggggctggctgacactaagtttggtgggacagtgaggggtgggaggggggtttccagggcctggtgttggagagtgcagagaaatatctacctccctggaggtgtgaagactaggtttttcttcttccttccaattagattttccttaattatagtgatgtcttccttattcatttttctctccctgcctctcactgccataagaatatcagcctgggggcagtccagacgcagccctttgtcatcctttctgtttgcctagtctcagcagactgtgatcacaaggcattgtctgtgggatttttcctttccctttcttgatctctcttgtggttctaggttgtttggttgttcattgttatggtggctttttattttaacgccccttgagccccatgatggctggtgtcaccctgttcttttacactgttgggccaggtgctgcttgtccttcttagggcatcatcaattgcaaatatttccttttgctccctttatgaagatgttcttatacccttgctttcccatatttttctggccaagcatgccatctcctttactctgggaacttacatcctgaatcccaagagggggtcacagtttggaaaaagtcatcagggattctggaactaagtctgataaaagattccagtgaagccctgttctgagaacgagcagactgcaggggaggccatgggattccccaggccagtgtctgtgctgatccttcaagggtctgcaggtatgcaggtggcctgggctgctcggcagatactttgctgattcccagctgaggggagcatggtggcgattgctcagccattttctgacagacacacagacctgccttttctcccccaagtataccgtaccctcctgtgagacagtgtgtgcaggcaccaccaccttaatcctgctgttgcctgacatgctgattctcatttattatgctgcatcaacacattagaggtacaggagcggctcagtcatgaaaaaagaaggtcttttgccccatttctttatttcagagatgtgggctttcagtgggaatttgctgactcctactttataggctgagtcaatgagggaagatgactggcgtttcctctgtctaaatgggaggttgccagagcgctggctgggactaggatgtgtaactaagatttcagtttgaaatcttagatttcagttcacggcgataaagaagtaggtgctgcacacaaatatgtaaagcaattgtaggaaatttgaaaggaaaaaaagaaaccgaagccagtattttaataattgctttttctgtgtattttgtattgggctgggggatagcatcaaaggttgaactttttgagctttctatgaaaaaccccaggaccttctttctttggccatttctatggaaatgcgatgtcagatggatggtaatggtgccctccagtggctgtgagacctcattgcgcattgtctactggagctttagtcttctgagacggaggaaaactgctgaatactctggattcatctatgtctacaatgttgcatttatgaaaaactacactgtgctaggcgcattctaggacatgaatatgaccacaccctctttcaccgggtgtttctgtagcaagttttcatattcttttcaaacaatggtttctctgcgttaattattgaggaaaaaaaaagatggggtaagaaaactacccatgcatgatgtagagagctgttgatttgtttctgtttttttaaaggaaaactatttgtaagatgttgcactaaaacattttatatacacttcagagacctgtagtaaattatgttgaaaataaaaaaaaaaaaaaaaaaaaaaaaaaaaaaacaaaaaaaaaaacaaacaaaaaaacaaaaaaagaaaaaacacaaaaaaaaaaaaaaacaaaaaaaaacgaaaaaaaaaaaaaaacacaaaaacaagggcggggggcggagagaaaggagagggggggaggagacggaagagagaaggagaggggggaggagagagggggaccggcagggggagggagataaaaggagagggcggggggcagacagaaagacgaagaggaaggaggggagagagagagaggcgagaaagatagaggaggcggaagaccgcaaaggaaaagggaggagggtgaactggaggagagaaggaacgaaagacacagaaagcagaagcgagacgggacagaggggccagagggaggaggatgggaatggagacaagagcgaaggaggggaaggaggggcaggtggaggtgaagtggatggaatgatgagagagagggagagcaggaagggggggcagggaagaggaagagcaacgagagcacagaagacaaaggaaagagccagaagaggaaaacaacggaaggagggggggggaaggcgaaagagaagagagaggagagaacagaaggaggcggggaaagggagaggccgaaagcaaggagaagaggaagagagaaggcgaagagggaaagaaaagaagaggaaggaaggagagaaagaaaagagaaaaacggggaagggcggaaacaaagagggagaggaaaactagcagagacgacaaagaaggaggagcggaacgaggagggagggaaggacagcaagagagaaacaaaggggaacgcacggagataagcgaggagatagacaggggcagaaagagaggagaagcgaaggaagagagacaaggaagcaaagagagaagaagaggtgcgtgtca

SEQ ID NO: 456698 - DNA, 3329 bp, Homo sapiens
ataatcagtggatgaaaggattttctcagacccttttttccgtgcttctggaggattaatccactacagtctgcaatttcagtggaaactgcaaggcacacgatgtggcaggagccgggagcgacttccgaattgttgtggacccttcctgtagcataggggagttttcacacttgcctccactcctccccttccccccaactccctccttctgatctcttctttttaatctgttcccattttccgagttaagttctatttccaaaactgttctctggagctataagtggattgccagaaatgagagattaggagctgggagaagaggaagcgccttgtgttgtgtctcctggaggctgccgacatgaagtgctttttcccggtgctgagctgtctggctgtgctgggtgtggtgtcagcacagcggcaggtcaccgttcaggaaggacccttgtaccgcacggagggctcccacatcactatctggtgcaatgtgagtggctaccagggaccttctgagcagaatttccagtggtccatttacctgccttcgtcgccagagcgagaggtgcagatcgtcagcaccatggactcttccttcccctatgccatctacacccagcgcgtccgcggagggaagatcttcatagaaagagtccaggggaactcaaccctattgcacatcacagatcttcaggcccgggatgccggggagtatgaatgccacacacccagcactgataagcaatactttgggagttacagtgcaaagatgaacctagtggtgatcccagactccctgcagaccactgccatgccccagactctgcacagagtggagcaggacccgctggagctcacttgtgaggtggcctcagagaccattcagcacagccacctgtctgtggcctggctccggcagaaagttggcgagaagcccgtggaggtcatctccctgagccgagatttcatgcttcactccagcagcgaatatgcccagaggcagagcctgggggaggtgcggctggacaagctggggaggaccaccttccgcctcaccatcttccacctgcagccttctgaccagggcgaattctactgcgaggccgccgagtggatccaggatccggatgggtcgtggtatgctatgacccgaaagcgttccgagggagccgtggtcaacgtccagccaactgacaaagaattcactgttcggctggagacagagaagcggctgcacacggtgggcgagccggtggagttcagatgcatcctggaggctcagaatgttcccgaccgttactttgctgtctcctgggccttcaacagctcgctcatcgccaccatgggtcctaacgctgtgcctgtcctcaacagcgaatttgctcaccgggaagccaggggacagcttaaggtggccaaagagagcgacagtgtctttgtgctgaagatctaccacctccgccaggaagatagcgggaaatacaactgccgggtgactgagcgagagaaaaccgtgaccggggaattcattgataaggagagcaagcgtcccaagaacatccccatcatagtcctccccctcaagagcagcatctccgtggaggtggccagcaatgccagcgtcatccttgagggcgaggacctgcgcttctcctgcagtgtccgcacggcaggcaggccgcagggtcgcttctctgtcatctggcagcttgtggacaggcagaaccgccgcagcaatatcatgtggctagaccgggatggcaccgtgcagccaggctcgtcctactgggagcgcagcagctttgggggcgtccagatggagcaggtgcagcccaactcgttcagcctgggcatcttcaacagcaggaaggaggacgagggccagtatgaatgccatgtgactgaatgggtgcgggcagtggatggcgagtggcagattgttggggagcgccgggccagcactcccatctccatcacagctcttgaaatgggcttcgcagtcacagccatctcccggacaccgggggtgacctacagcgactcctttgacttgcagtgtatcatcaaaccccactaccctgcctgggtccccgtgtcggtgacatggcggttccagccggtgggcacggtggagttccatgacttggtgaccttcacccgggacggaggggtccagtggggggacaggtcctccagcttccgaacccgaactgccatcgagaaggctgagtccagcaacaacgtccgcctaagcatcagccgagccagtgacacggaagcaggcaagtaccagtgtgtggcagagctgtggcggaagaactacaacaacacctggacgcgactggcggagaggacctccaacctgctggagatcagggtgctgcagccagtgacaaagctgcaggtgagcaaatcgaagaggaccctcaccctggtggaaaacaagcccattcagttgaactgctcagtcaagtctcagactagccagaactcccactttgcggtgctctggtatgtccacaagccctcggatgccgatggcaagcttatcctgaagaccacccacaactccgcctttgaatacggtacttacgccgaggaggagggcctgagagccaggctccagtttgagaggcatgtgtcggggggcctgttcagcctcaccgtccagagagccgaggtcagcgacagcggcagctactactgccacgtggaggagtggctgctgagccccaactacgcctggtacaagctggcagaggaggtttctgggcgcacagaagtcactgtgaaacagccagacagccgcctgaggctcagccaagcccaggggaacctgtcggttctggagacccggcaggtacagctggagtgtgtggttctcaaccgcaccagcataacctcccagctcatggtggaatggtttgtatggaagcccaaccaccctgagcgggagactgtggcccgcttgagccgtgacgccaccttccactatggagagcaggcagccaagaacaatctgaaggggcggctgcatttggagagtccttcccccggcgtgtaccgtctcttcatccagaacgtggctgtgcaggacagcgggacctacagctgccatgtggaggagtggctgcccagccccagtggcatgtggtataagcgggcagaggacaccgctgggcagacagctctgacagtcatgcgaccaggtgagggtccacgtccccaagcttccactccctctggtgtttcccatttaagtatactgttttatgcactggataaaattagtttattaataaattatttgcagttaaataaaaaaa

SEQ ID NO: 456699 - DNA, 1006 bp, Homo sapiens
cctcgacactgttggcccactcgattccacgttcttaactgttccattttccgtatctgcttcgggcttccacctcatttttttcgctttgcccattctgtttcagccagtcgccaagaatcatgaaagtcgccagtggcagcaccgccaccgccgccgcgggccccagctgcgcgctgaaggccggcaagacagcgagcggtgcgggcgaggtggtgcgctgtctgtctgagcagagcgtggccatctcgcgctgcgccgggggcgccggggcgcgcctgcctgccctgctggacgagcagcaggtaaacgtgctgctctacgacatgaacggctgttactcacgcctcaaggagctggtgcccaccctgccccagaaccgcaaggtgagcaaggtggagattctccagcacgtcatcgactacatcagggaccttcagttggagctgaactcggaatccgaagttggaacccccgggggccgagggctgccggtccgggctccgctcagcaccctcaacggcgagatcagcgccctgacggccgaggcggcatgcgttcctgcggacgatcgcatcttgtgtcgctgaagcgcctcccccagggaccggcggaccccagccatccagggggcaagaggaattacgtgctctgtgggtctcccccaacgcgcctcgccggatctgagggagaacaagaccgatcggcggccactgcgcccttaactgcatccagcctggggctgaggctgaggcactggcgaggagagggcgctcctctctgcacacctactagtcaccagagactttagggggtgggattccactcgtgtgtttctattttttgaaaagcagacattttaaaaaatggtcacgtttggtgcttctcagatttctgaggaaattgctttgtattgtatattacaatgatcaccgactgaaaatattgttttacaatagttctgtggggctgtttttttgttattaaacaaataatttagatggtg

SEQ ID NO: 456700 - DNA, 408 bp, Homo sapiens
  misc_feature (2)..(2): n is a, c, g, or t
  misc_feature (46)..(46): n is a, c, g, or t
  misc_feature (49)..(49): n is a, c, g, or t
tnccggtcccggggcccgctcagcaccccctcaacggccgagaatncancccgcgggccgccggtgaaatacccactactcggatctgagggagaacaagaccgatcggcggccactgcgcccttaactgcatccagcctggggctgaggctgaggcactggcgaggagagggcgctcctctctgcacacctactagtcaccagagactttagggggtgggattccactcgtgtgtttctattttttgaaaagcagacattttaaaaaatggtcacgtttggtgcttctcagatttctgaggaaattgctttgtattgtatattacaatgatcaccgactgaaaatattgttttacaatagttctgtggggctgtttttttgttattaaacaaataatttagatggtg

SEQ ID NO: 456701 - DNA, 1244 bp, Homo sapiens
cctcgacactgttggcccactcgattccacgttcttaactgttccattttccgtatctgcttcgggcttccacctcatttttttcgctttgcccattctgtttcagccagtcgccaagaatcatgaaagtcgccagtggcagcaccgccaccgccgccgcgggccccagctgcgcgctgaaggccggcaagacagcgagcggtgcgggcgaggtggtgcgctgtctgtctgagcagagcgtggccatctcgcgctgcgccgggggcgccggggcgcgcctgcctgccctgctggacgagcagcaggtaaacgtgctgctctacgacatgaacggctgttactcacgcctcaaggagctggtgcccaccctgccccagaaccgcaaggtgagcaaggtggagattctccagcacgtcatcgactacatcagggaccttcagttggagctgaactcggaatccgaagttggaacccccgggggccgagggctgccggtccgggctccgctcagcaccctcaacggcgagatcagcgccctgacggccgaggtgagatccagatccgaccactagatcatccttataccgacggggaaacggaggccagagagggcgtgggcgcttgcaccacttccgtcccatccttgcgggtacctggctatgcgggggtgcctaaggagcctggaaaaagcgctcccccgtcgtgcttcctggggaagggggcgttcgctgcgctcggagcggcgtcccttccaacccgccggtctcatttcttctcgttttcacagcggcatgcgttcctgcggacgatcgcatcttgtgtcgctgaagcgcctcccccagggaccggcggaccccagccatccagggggcaagaggaattacgtgctctgtgggtctcccccaacgcgcctcgccggatctgagggagaacaagaccgatcggcggccactgcgcccttaactgcatccagcctggggctgaggctgaggcactggcgaggagagggcgctcctctctgcacacctactagtcaccagagactttagggggtgggattccactcgtgtgtttctattttttgaaaagcagacattttaaaaaatggtcacgtttggtgcttctcagatttctgaggaaattgctttgtattgtatattacaatgatcaccgactgaaaatattgttttacaatagttctgtggggctgtttttttgttattaaacaaataatttagatggtg

SEQ ID NO: 456702 - DNA, 967 bp, Homo sapiens
cctcgacactgttggcccactcgattccacgttcttaactgttccattttccgtatctgcttcgggcttccacctcatttttttcgctttgcccattctgtttcagccagtcgccaagaatcatgaaagtcgccagtggcagcaccgccaccgccgccgcgggccccagctgcgcgctgaaggccggcaagacagcgagcggtgcgggcgaggtggtgcgctgtctgtctgagcagagcgtggccatctcgcgctgcgccgggggcgccggggcgcgcctgcctgccctgctggacgagcagcaggtaaacgtgctgctctacgacatgaacggctgttactcacgcctcaaggagctggtgcccaccctgccccagaaccgcaaggtgagcaaggtggagattctccagcacgtcatcgactacatcagggaccttcagttggagctgaactcggaatccgaagttggaacccccgggggccgagggctgccggtccgggctccgctcagcaccctcaacggcgagatcagcgccctgacggccgaggcggcatgcgttcctgcggacgatcgcatcttgtgtcgctgaagcgcctcccccagggaccggcggaccccagccatccagggggcaagaggaattacgtgctctgtgggtctcccccaacgcgcctcgccggatctgagggagaacaagaccgatcggcggccactgcgcccttaactgcatccagcctggggctgaggctgaggcactggcgaggagagggcgctcctctctgcacacctactagtcaccagagactttagggggcgcccccccattcccccccctctatccttcccccaagggtgtcttctttggatggtcggggcccggccccccgggggggatagtgagggggctatgggtgtgtgtttcaaaaaacaaaaactgggggggttttttgccctttttcctttgga

SEQ ID NO: 456703 - DNA, 749 bp, Homo sapiens
cctcgacactgttggcccactcgattccacgttcttaactgttccattttccgtatctgcttcgggcttccacctcatttttttcgctttgcccattctgtttcagccagtcgccaagaatcatgaaagtcgccagtggcagcaccgccaccgccgccgcgggccccagctgcgcgctgaaggccggcaagacagcgagcggtgcgggcgaggtggtgcgctgtctgtctgagcagagcgtggccatctcgcgctgcgccgggggcgccggggcgcgcctgcctgccctgctggacgagcagcaggtaaacgtgctgctctacgacatgaacggctgttactcacgcctcaaggagctggtgcccaccctgccccagaaccgcaaggtgagcaaggtggagattctccagcacgtcatcgactacatcagggacgaacaagaccgatcggcggccactgcgcccttaactgcatccagcctggggctgaggctgaggcactggcgaggagagggcgctcctctctgcacacctactagtcaccagagactttagggggtgggattccactcgtgtgtttctattttttgaaaagcagacattttaaaaaatggtcacgtttggtgcttctcagatttctgaggaaattgctttgtattgtatattacaatgatcaccgactgaaaatattgttttacaatagttctgtggggctgtttttttgttattaaacaaataatttagatggtg

SEQ ID NO: 456704 - DNA, 1214 bp, Homo sapiens
cctcgacactgttggcccactcgattccacgttcttaactgttccattttccgtatctgcttcgggcttccacctcatttttttcgctttgcccattctgtttcagccagtcgccaagaatcatgaaagtcgccagtggcagcaccgccaccgccgccgcgggccccagctgcgcgctgaaggccggcaagacagcgagcggtgcgggcgaggtggtgcgctgtctgtctgagcagagcgtggccatctcgcgctgcgccgggggcgccggggcgcgcctgcctgccctgctggacgagcagcaggtaaacgtgctgctctacgacatgaacggctgttactcacgcctcaaggagctggtgcccaccctgccccagaaccgcaaggtgagcaaggtggagattctccagcacgtcatcgactacatcagggaccttcagttggagctgaactcggaatccgaagttggaacccccgggggccgagggctgccggtccgggctccgctcagcaccctcaacggcgagatcagcgccctgacggccgaggcggcatgcgttcctgcggacgatcgcatcttgtgtcgctgaagcgcctcccccagggaccggcggaccccagccatccagggggcaagaggaattacgtgctctgtgggtctcccccaacgcgcctcgccggatctgagggagaacaagaccgatcggcggccactgcgcccttaactgcatccagcctggggctgaggctgaggcactggcgaggagagggcgctcctctctgcacacctactagtcaccagagactttagggggtgggattccactcgtgtgtttctattttttgaaaagcagacattttaaaaaatggtcacgtttggtgcttctcagatttctgaggaaattgctttgtattgtatattacaatgatcaccgactgaaaatattgttttacaatagttctgtggggctgtttttttgttattaaacaaataatttagatggtgaaaaaaaaaaaaaaaaaaaaaaaagtggggtggccccaagggggcaaacaggcttgcgacaagtagagcgccgccacaaaggcccagggcacacagacgacgcccaggcacagacggtgcgcacgggaaggccgacacaaggtgaccacaagtggcactcagacacgagagccacgatcaccgagcaggcgcccagacagttgccgca

SEQ ID NO: 456705 - DNA, 1186 bp, Homo sapiens
cctcgacactgttggcccactcgattccacgttcttaactgttccattttccgtatctgcttcgggcttccacctcatttttttcgctttgcccattctgtttcagccagtcgccaagaatcatgaaagtcgccagtggcagcaccgccaccgccgccgcgggccccagctgcgcgctgaaggccggcaagacagcgagcggtgcgggcgaggtggtgcgctgtctgtctgagcagagcgtggccatctcgcgctgcgccgggggcgccggggcgcgcctgcctgccctgctggacgagcagcaggtaaacgtgctgctctacgacatgaacggctgttactcacgcctcaaggagctggtgcccaccctgccccagaaccgcaaggtgagcaaggtggagattctccagcacgtcatcgactacatcagggaccttcagttggagctgaactcggaatccgaagttggaacccccgggggccgagggctgccggtccgggctccgctcagcaccctcaacggcgagatcagcgccctgacggccgaggtgagatccagatccgaccactagatcatccttataccgacggggaaacggaggccagagagggcgtgggcgcttgcaccacttccgtcccatccttgcgggtacctggctatgcgggggtgcctaaggagcctggaaaaagcgctcccccgtcgtgcttcctggggaagggggcgttcggcggcatgcgttcctgcggacgatcgcatcttgtgtcgctgaagcgcctcccccagggaccggcggaccccagccatccagggggcaagaggaattacgtgctctgtgggtctcccccaacgcgcctcgccggatctgagggagaacaagaccgatcggcggccactgcgcccttaactgcatccagcctggggctgaggctgaggcactggcgaggagagggcgctcctctctgcacacctactagtcaccagagactttagggggtgggattccactcgtgtgtttctattttttgaaaagcagacattttaaaaaatggtcacgtttggtgcttctcagatttctgaggaaattgctttgtattgtatattacaatgatcaccgactgaaaatattgttttacaatagttctgtggggctgtttttttgttattaaacaaataatttagatggtg

SEQ ID NO: 456706 - DNA, 844 bp, Homo sapiens
cctcgacactgttggcccactcgattccacgttcttaactgttccattttccgtatctgcttcgggcttccacctcatttttttcgctttgcccattctgtttcagccagtcgccaagaatcatgaaagtcgccagtggcagcaccgccaccgccgccgcgggccccagctgcgcgctgaaggccggcaagacagcgagcggtgcgggcgaggtggtgcgctgtctgtctgagcagagcgtggccatctcgcgctgcgccgggggcgccggggcgcgcctgcctgccctgctggacgagcagcaggtaaacgtgctgctctacgacatgaacggctgttactcacgcctcaaggagctggtgcccaccctgccccagaaccgcaaggtgagcaaggtggagattctccagcacgtcatcgactacatcagggaccttcagttggagctgaactcggaatccgaagttggaacccccgggggccgagggctgccggtccgggctccgctcagcaccctcaacggcgagatcagcgccctgacggccgaggcggcatgcgttcctgcggacgatcgcatcttgtgtcgctgaggcactggcgaggagagggcgctcctctctgcacacctactagtcaccagagactttagggggtgggattccactcgtgtgtttctattttttgaaaagcagacattttaaaaaatggtcacgtttggtgcttctcagatttctgaggaaattgctttgtattgtatattacaatgatcaccgactgaaaatattgttttacaatagttctgtggggctgtttttttgttattaaacaaataatttagatggtg

SEQ ID NO: 456707 - DNA, 4634 bp, Homo sapiens
gtcacgccccgggcagcttggctggggctaggcttccggggctctgcggtcctcggcctgtgctggcagcctcggagcccaccgagccgggcggctgggatgatgaaccggacgacccccgaccaggagctggtgccggcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaatccgggaaaccaaagccacagattgtcgcctgcataatgtcttcaatgacttccttatgctctctaatacccagttcatagagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcacagtgacaatgaacaaaaccagcacaccacacaaatgagtgatgaggaagaggatgatgatggctgtgacctttttgctgactctgagaaggaggaggaagatattgaggacattgaagaaaatactagacctaaaagaagcagacctacatcgtttgcagatgagctggctgcccgcatcaagggggatgccatgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtggcggcaaggggctatttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcactgaaggagccacagaagcctgagcagcccactccaaggaaaagcccctatggtccccctcccactggcctctttgatgatgatgatggtgatgatgatgacgactttttctcggcaccccacagcaaaccttctaaaacacgcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttccagcaagaatctcaagccctcatcagaaacaaagactcaaaaaggcttattttcagatgaggaggactctgaggatttgttttcttctcaaagtgcgagtaacttaaaaggtgcatctctgctgcctggcaagctccccacgtcggtttccctgtttgatgatgaagatgaagaggataatctttttgggggtacagctgctaagaagcagacattgtctctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacaaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggctgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttaactctttcaaaaaccagaaacatcctgaatccattcaaggtagtaaagaaaaaggcatatggaagccggaaacacctcaggcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgaggctgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacacaagcccctttgcaaagtctctgggtcattccagaggggaggctgacctttttgattctggggacattttttccacgggcactggatctcagtccgtggagagaacaaaacccaaggcaaagatagcagagaatcctgccaacccaccagtgggtggtaaagcaaagagccccatgtttcctgctctaggcgaggccagcagtgatgatgatctctttcagtctgctaaaccaaaaccagcaaagaaaacaaatccctttcctctcctggaagatgaggatgacctctttacagatcagaaagtcaagaagaatgagacaaaatccagtagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctccactggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatattgtatatgctcatggtcttaactggattacaaaaagcaaatactagaacagctagctcatcttttacccaatgtacttagtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatctcagagatagcaaatgccacctgaccagaagtctttgttatatggatgggaaccctaacttagggcttgggcaggggaaagagaaagaagatgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaatcacaaaaaaatg

SEQ ID NO: 456708 - DNA, 397 bp, Homo sapiens
cggcacgaggagagaggacagaactggttggtttgttttgtttttaaaccacagtttgatttagttagccttgctggggccataatatgcttcagggtgtgtaaaagaagaaatctctttgtggctttcatgggcagggaatctcagagatagcaaatgccacctgaccagaagtctttgttatatggatgggaaccctaacttagggcttgggcaggggaaagagaaagaagatgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaatcacaaaaaaatg

SEQ ID NO: 456709 - DNA, 4697 bp, Homo sapiens
gtcacgccccgggcagcttggctggggctaggcttccggggctctgcggtcctcggcctgtgctggcagcctcggagcccaccgagccgggcggctgggatgatgaaccggacgacccccgaccaggagctggtgccggcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaatccgggaaaccaaagccacagattgtcgcctgcataatgtcttcaatgacttccttatgctctctaatacccagttcatagagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcacagtgacaatgaacaaaaccagcacaccacacaaatgagtgatgaggaagaggatgatgatggctgtgacctttttgctgactctgagaaggaggaggaagatattgaggacattgaagaaaatactagacctaaaagaagcagacctacatcgtttgcagatgagctggctgcccgcatcaagggggatgccatgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtggcggcaaggggctatttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcactgaaggagccacagaagcctgagcagcccactccaaggaaaagcccctatggtccccctcccactggcctctttgatgatgatgatggtgatgatgatgacgactttttctcggcaccccacagcaaaccttctaaaacacgcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttccagcaagaatctcaagccctcatcagaaacaaagactcaaaaaggcttattttcagatgaggaggactctgaggatttgttttcttctcaaagtgcgagtaacttaaaaggtgcatctctgctgcctggcaagctccccacgtcggtttccctgtttgatgatgaagatgaagaggataatctttttgggggtacagctgctaagaagcagacattgtctctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacaaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggctgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttaactctttcaaaaaccagaaacatcctgaatccattcaaggtagtaaagaaaaaggcatatggaagccggaaacacctcaggactcatcaggtctcgctccatttaaaaccaaagaaccatccactcggatcgggaagatacaagcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgaggctgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacacaagcccctttgcaaagtctctgggtcattccagaggggaggctgacctttttgattctggggacattttttccacgggcactggatctcagtccgtggagagaacaaaacccaaggcaaagatagcagagaatcctgccaacccaccagtgggtggtaaagcaaagagccccatgtttcctgctctaggcgaggccagcagtgatgatgatctctttcagtctgctaaaccaaaaccagcaaagaaaacaaatccctttcctctcctggaagatgaggatgacctctttacagatcagaaagtcaagaagaatgagacaaaatccagtagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctccactggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatattgtatatgctcatggtcttaactggattacaaaaagcaaatactagaacagctagctcatcttttacccaatgtacttagtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatctcagagatagcaaatgccacctgaccagaagtctttgttatatggatgggaaccctaacttagggcttgggcaggggaaagagaaagaagatgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaatcacaaaaaaatg

SEQ ID NO: 456710 - DNA, 3650 bp, Homo sapiens
tgatcgtccagaggatccccgtcgtccagcatctggggatgcatgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtggcggcaaggggctatttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcactgaaggagccacagaagcctgagcagcccactccaaggaaaagcccctatggtccccctcccactggcctctttgatgatgatgatggtgatgatgatgacgactttttctcggcaccccacagcaaaccttctaaaacacgcaaagtccaatccactgccgatatctttggtgacgaagaaggagatctgttcaaagaaaaagccgtagcatcgccagaagccactgtgagtcagacagatgaaaataaagcaagagcagaaaaaaaggatttgttttcttctcaaagtgcgagtaacttaaaaggtgcatctctgctgcctggcaagctccccacgtcggtttccctgtttgatgatgaagatgaagaggataatctttttgggggtacagctgctaagaagcagacattgtctctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacaaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggctgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttaactctttcaaaaaccagaaacatcctgaatccattcaaggtagtaaagaaaaaggcatatggaagccggaaacacctcaggactcatcaggtctcgctccatttaaaaccaaagaaccatccactcggatcgggaagatacaagcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgaggctgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacacaagcccctttgcaaagtctctgggtcattccagaggggaggctgacctttttgattctggggacattttttccacgggcactggatctcagtccgtggagagaacaaaacccaaggcaaagatagcagagaatcctgccaacccaccagtgggtggtaaagcaaagagccccatgtttcctgctctaggcgaggccagcagtgatgatgatctctttcagtctgctaaaccaaaaccagcaaagaaaacaaatccctttcctctcctggaagatgaggatgacctctttacagatcagaaagtcaagaagaatgagacaaaatccagtagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctccactggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatattgtatatgctcatggtcttaactggattacaaaaagcaaatactagaacagctagctcatcttttacccaatgtacttagtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatctcagagatagcaaatgccacctgaccagaagtctttgttatatggatgggaaccctaacttagggcttgggcaggggaaagagaaagaagatgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaatcacaaaaaaatg

SEQ ID NO: 456711 - DNA, 4324 bp, Homo sapiens
gtcacgccccgggcagcttggctggggctaggcttccggggctctgcggtcctcggcctgtgctggcagcctcggagcccaccgagccgggcggctgggatgatgaaccggacgacccccgaccaggagctggtgccggcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaatccgggaaaccaaagccacagattgtcgcctgcataatgtcttcaatgacttccttatgctctctaatacccagttcatagagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcacagtgacaatgaacaaaaccagcacaccacacaaatgagtgatgaggaagaggatgatgatggctgtgacctttttgctgactctgagaaggaggaggaagatattgaggacattgaagaaaatactagacctaaaagaagcagacctacatcgtttgcagatgagctggctgcccgcatcaagggggatgccatgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtggcggcaaggggctatttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcactgaaggagccacagaagcctgagcagcccactccaaggaaaagcccctatggtccccctcccactggcctctttgatgatgatgatggtgatgatgatgacgactttttctcggcaccccacagcaaaccttctaaaacacgcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttccagcaagaatctcaagccctcatcagaaacaaagactcaaaaaggcttattttcagatgaggaggactctgaggatttgttttcttctcaaagtgcgagtaacttaaaaggtgcatctctgctgcctggcaagctccccacgtcggtttccctgtttgatgatgaagatgaagaggataatctttttgggggtacagctgctaagaagcagacattgtctctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacaaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggctgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttaactctttcaaaaaccagaaacatcctgaatccattcaaggtagtaaagaaaaaggcatatggaagccggaaacacctcaggactcatcaggtctcgctccatttaaaaccaaagaaccatccactcggatcgggaagatacaagcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgaggctgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacacaagcccctttgcaaagtctctgggtcattccagaggggaggctgacctttttgattctggggacattttttccacgggcactggatctcagtccgtggagagaacaaaacccaaggcaaagatagcagagaatcctgccaacccaccagtgggtggtaaagcaaagagccccatgtttcctgctctaggcgaggccagcagtgatgatgatctctttcagtctgctaaaccaaaaccagcaaagaaaacaaatccctttcctctcctggaagatgaggatgacctctttacagatcagaaagtcaagaagaatgagacaaaatccagtagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctccactggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatattgtatatgctcatggtcttaactggattacaaaaagcaaatactagaacagctagctcatcttttacccaatgtacttagtatttttctgcactggtttaatcatgcttaatactacaaaacaaaaataaatatttcacag

SEQ ID NO: 456712 - DNA, 4656 bp, Homo sapiens
gtcacgccccgggcagcttggctggggctaggcttccggggctctgcggtcctcggcctgtgctggcagcctcggagcccaccgagccgggcggctgggatgatgaaccggacgacccccgaccaggagctggtgccggcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaatccgggaaaccaaagccacagattgtcgcctgcataatgtcttcaatgacttccttatgctctctaatacccagttcatagagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcacagtgacaatgaacaaaaccagcacaccacacaaatgagtgatgaggaagaggatgatgatggctgtgacctttttgctgactctgagaaggaggaggaagatattgaggacattgaagaaaatactagacctaaaagaagcagacctacatcgtttgcagatgagctggctgcccgcatcaagggggatgccatgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtggcggcaaggggctatttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcactgaaggagccacagaagcctgagcagcccactccaaggaaaagcccctatggtccccctcccactggcctctttgatgatgatgatggtgatgatgatgacgactttttctcggcaccccacagcaaaccttctaaaacacgcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttccagcaagaatctcaagccctcatcagaaacaaagactcaaaaaggcttattttcagatgaggaggactctgaggatttgttttcttctcaaagtgcgagtaacttaaaaggtgcatctctgctgcctggcaagctccccacgtcggtttccctgtttgatgatgaagatgaagaggataatctttttgggggtacagctgctaagaagcagacattgtctctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacaaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggctgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttaactctttcaaaaaccagaaacatcctgaatccattcaaggtagtaaagaaaaaggcatatggaagccggaaacacctcaggactcatcaggtctcgctccatttaaaaccaaagaaccatccactcggatcgggaagatacaagcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgaggctgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacacaagcccctttgcaaagtctctgggtcattccagaggggaggctgacctttttgattctggggacattttttccacgggcactggatctcagtccgtggagagaacaaaacccaaggcaaagatagcagagaatcctgccaacccaccagtgggtggtaaagcaaagagccccatgtttcctgctctaggcgaggccagcagtgatgatgatctctttcagtctgctaaaccaaaaccagcaaagaaaacaaatccctttcctctcctggaagatgaggatgacctctttacagatcagaaagtcaagaagaatgagacaaaatccagtagatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctccactggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatattgtatatgctcatggtcttaactggattacaaaaagcaaatactagaacagctagctcatcttttacccaatgtacttagtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatctcagagatagcaaatgccacctgaccagaagtctttgttatatggatgggaaccctaacttagggcttgggcaggggaaagagaaagaagatgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaatcacaaaaaaatg

SEQ ID NO: 456713 - DNA, 770 bp, Homo sapiens
ctccacactggtatccagtggaaagtggtagccaagtctatatttgatgatgatatggatgacatcttctccactggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatattgtatatgctcatggtcttaactggattacaaaaagcaaatactagaacagctagctcatcttttacccaatgtacttagtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatctcagagatagcaaatgccacctgaccagaagtctttgttatatggatgggaaccctaacttagggcttgggcaggggaaagagaaagaagatgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaatcacaaaaaaatg

SEQ ID NO: 456714 - DNA, 336 bp, Homo sapiens
atctgatgccatttctcagcctttctttgctttttatgaccctgacatctttaaagagtacaagcaagttttttttttatttgtaatgaataatttttggggggagagatacttcaagactacataaatatgtaattcctcaccataatgacactttcaattccagtaagtgggtatagatggttttatcaagatctctgtgatgctgttgtatggtggtttgtgattttgagctaaggacattttcttgtgaatattggtgtggtgacccttatctctcttctcaacagaaggctctgtaggcagtgatcgtggcagtattgtggacactgagga

SEQ ID NO: 456715 - DNA, 141 bp, Homo sapiens
ccatgctgttacgagagctgggtctttggtggtttgcttgcatgtgtcttaaaagtacctttctccacccctcttcagcaactgtttttcttttttctttctaaagatgacatcttctccactggtatccaggctaagaca

SEQ ID NO: 456716 - DNA, 556 bp, Homo sapiens
gtccttcccgggagtggggaggccggtgtgagttttgatcttccagctcaggcagacaccttacacagtgcaaacaaggtgatgaaaccatctttgcttccttgctctcttcttttaaccagaacatgcatatgcttctttctagtttatcagttgcatacacagcagtctttgactctccttttgaaggaggtgcctcatccttccttcagccgctcccccctccattctccccacccccctcatcctgcacctgcttttccatggcctgcatttggtacatttgcattctgctcagtagccacagtaacgtctcaccactttggctggtgtctgacacctgcaggtttccagcactgccacctgggggtcttctaaccacagagcagatcatgcccctcctgctggcgcttcctcactactccaaggagagcattcgggctcctgggtttggtatgaaacccctttgcaatcggtgccagcccatgtgtgcagcttcctcactagtcacttcacactttccagcctgactccaggcacaccaggtgccactccc

SEQ ID NO: 456717 - DNA, 429 bp, Homo sapiens
agtatcagtatattggagacccatactgcatggtatttattttgtaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggtgaagacattcaacttaaatatttattgcacaactattatgtttgggctactttaattgggcacacgattagtaagtcatggacttaacctctgggaagtgagtatgtcacttagtagtctcacattgactccaccagaaagactcgctttacctgagcactgatggagtacttgtgaggtgcaaggcaacatgtcaagttggggtg

SEQ ID NO: 456718 - DNA, 441 bp, Homo sapiens
acccgcctctgcagcgttcctggcgtcagcccctatcctccagcttcctccgccccaacctagggtagaaccccaaactccagtcccagtccacttccgcagcttcctcccctcagcatcgcaggtcggatcacgtgcgggttctgtcacgtgacatcaggtcacgtgaggccggtcacgccccgggcagcttggctggggctaggcttccggggctctgcggtcctcggcctgtgctggcagcctcggagcccaccgagccgggcggctgggatggtgagggcggcgggccggagaggggccggcctgggctggggccgccgtccctgccgccctcaggctcagcctctcttctcgtttttttcgctgcagatgaaccggacgacccccgaccaggagctggtgccggcgtcggagcccgtgtgggagcggccgtggtcg

SEQ ID NO: 456719 - DNA, 2977 bp, Homo sapiens
agtcatctcccctctcctcactccacacgccagagtttcatgaatctatactttaatagttagtgttttttgatgccatgccagatttgactctgaagtggagttaaggtaggatgaagaatcttcttcccactaaagaatttatttctccctctggatttccttggaatagaattaaaatagaaataaatataaattacatctgatttcctgcctgctctcagtgttgcctctcccgaggtcattgctgttgggccgtactctgcagcagtcttctcagaacgctgtggagctcctcctgggaacagcccaggagctggagagcgagtgacagttccacgtgcaggtgtcccagggtgtctcactgaagccttagtgtcctgagccgtaaacctgaggcacttggacgaacacatcaccactgacccttcctggggctcagatcttttgcttttagagccagtgcattaggctatggttgaatttttgtgtgctccttgaaatttctatttgataaccaacatggtaattttgcctgctggtcagttttaggtgctctgataaactgtgactcttgggaatcttactcatcttgtattccttgactccatatctgatctggcagctttccacttatgtgacagaggaggaggcatacgtgaagtagtgctagtgaaacatcaggccccaggagagatttgaatgcctttcccattaaagagctacagaaagtgacagttttgctccatcacagatttatttacaggcataagaaacacttgtctttctgtttcccaaatggatttttaactggatgtaatcttacacaggactcatcaggtctcgctccatttaaaaccaaagaaccatccactcggatcgggaagatacaagtaattaaaacactggaatcttcattgcctgccctgtggcatctataaacttttttgggtttcctactcttgtcagctgctgccaaacatcttctcatctcttcccccgcctcccctcccctgcacctagttgttgtctcctgtgtgctgcgtctttaacatctattctttgagcccagtggtgggcataggtgtaagacgctctgttttaattctgagactagattgggcgattttcctacgtttctctactcctctcgtattatacattatgtgtaccgaatcttgtcatgtgtcacaataaagataatagactgctgtgttgaagaacaaatacagagtttcatttttcttctttaggcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgaggctgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacacaagcccctttgcaaagtctctgggtcattccagaggggaggctgacctttttgattctggggacattttttccacgggcactggatctcagtccgtggagagaacaaaacccaaggcaaagatagcagagaatcctgccaacccaccagtgggtggtaaagcaaagagccccatgtttcctgctctaggcgaggccagcagtgatgatgatctctttcagtctgctaaaccaaaaccagcaaagaaaacaaatccctttcctctcctggaagatgaggatgacctctttacagatcagaaagtcaagaagaatgagacaaaatccagtagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctccactggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatattgtatatgctcatggtcttaactggattacaaaaagcaaatactagaacagctagctcatcttttacccaatgtacttagtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatctcagagatagcaaatgccacctgaccagaagtctttgttatatggatgggaaccctaacttagggcttgggcaggggaaagagaaagaagatgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaatcacaaaaaaatg

SEQ ID NO: 456720 - DNA, 4499 bp, Homo sapiens
gtcacgccccgggcagcttggctggggctaggcttccggggctctgcggtcctcggcctgtgctggcagcctcggagcccaccgagccgggcggctgggatgatgaaccggacgacccccgaccaggagctggtgccggcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaatccgggaaaccaaagccacagattgtcgcctgcataatgtcttcaatgacttccttatgctctctaatacccagttcatagagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcacagtgacaatgaacaaaaccagaaaagaagcagacctacatcgtttgcagatgagctggctgcccgcatcaagggggatgccatgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtggcggcaaggggctatttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcactgaaggagccacagaagcctgagcagcccactccaaggaaaagcccctatggtccccctcccactggcctctttgatgatgatgatggtgatgatgatgacgactttttctcggcaccccacagcaaaccttctaaaacacgcaaagtccaatccactgccgatatctttggtgacgaagaaggagatctgttcaaagaaaaagccgtagcatcgccagaagccactgtgagtcagacagatgaaaataaagcaagagcagaaaaaaaggatttgttttcttctcaaagtgcgagtaacttaaaaggtgcatctctgctgcctggcaagctccccacgtcggtttccctgtttgatgatgaagatgaagaggataatctttttgggggtacagctgctaagaagcagacattgtctctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacaaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggctgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttaactctttcaaaaaccagaaacatcctgaatccattcaaggtagtaaagaaaaaggcatatggaagccggaaacacctcaggactcatcaggtctcgctccatttaaaaccaaagaaccatccactcggatcgggaagatacaagcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgaggctgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacacaagcccctttgcaaagtctctgggtcattccagaggggaggctgacctttttgattctggggacattttttccacgggcactggatctcagtccgtggagagaacaaaacccaaggcaaagatagcagagaatcctgccaacccaccagtgggtggtaaagcaaagagccccatgtttcctgctctaggcgaggccagcagtgatgatgatctctttcagtctgctaaaccaaaaccagcaaagaaaacaaatccctttcctctcctggaagatgaggatgacctctttacagatcagaaagtcaagaagaatgagacaaaatccagtagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctccactggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatattgtatatgctcatggtcttaactggattacaaaaagcaaatactagaacagctagctcatcttttacccaatgtacttagtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatctcagagatagcaaatgccacctgaccagaagtctttgttatatggatgggaaccctaacttagggcttgggcaggggaaagagaaagaagatgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaatcacaaaaaaatg

SEQ ID NO: 456721 - DNA, 3689 bp, Homo sapiens
agggtgtcagtggactgtgccaggggtttagtgtgaaattcatcagactgcctcacactttgttaaatagtgtcagataaactccatgccagtttggagacacagcagatgccaacccgggaatttgagttctggacccatctttaatactccctgcaaaacattgctttctgtttgctagatgaagaggataacttattcgcaccccccaagctgaccgacgaggacttctcgccatttggctctggaggtggcctgttcagtggcggcaaggggctatttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcactgaaggagccacagaagcctgagcagcccactccaaggaaaagcccctatggtccccctcccactggcctctttgatgatgatgatggtgatgatgatgacgactttttctcggcaccccacagcaaaccttctaaaacacgcaaagtccaatccactgccgatatctttggtgacgaagaaggagatctgttcaaagaaaaagccgtagcatcgccagaagccactgtgagtcagacagatgaaaataaagcaagagcagaaaaaaaggatttgttttcttctcaaagtgcgagtaacttaaaaggtgcatctctgctgcctggcaagctccccacgtcggtttccctgtttgatgatgaagatgaagaggataatctttttgggggtacagctgctaagaagcagacattgtctctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacaaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggctgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttaactctttcaaaaaccagaaacatcctgaatccattcaaggtagtaaagaaaaaggcatatggaagccggaaacacctcaggactcatcaggtctcgctccatttaaaaccaaagaaccatccactcggatcgggaagatacaagcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgaggctgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacacaagcccctttgcaaagtctctgggtcattccagaggggaggctgacctttttgattctggggacattttttccacgggcactggatctcagtccgtggagagaacaaaacccaaggcaaagatagcagagaatcctgccaacccaccagtgggtggtaaagcaaagagccccatgtttcctgctctaggcgaggccagcagtgatgatgatctctttcagtctgctaaaccaaaaccagcaaagaaaacaaatccctttcctctcctggaagatgaggatgacctctttacagatcagaaagtcaagaagaatgagacaaaatccagtagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctccactggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatattgtatatgctcatggtcttaactggattacaaaaagcaaatactagaacagctagctcatcttttacccaatgtacttagtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatctcagagatagcaaatgccacctgaccagaagtctttgttatatggatgggaaccctaacttagggcttgggcaggggaaagagaaagaagatgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaatcacaaaaaaatg

SEQ ID NO: 456722 - DNA, 1949 bp, Homo sapiens
atcatcttcatcatccccaaacaggctcccaacacttggctctacctgtttggggatgatgaagatgatgatcttttcagctctgccaagtcccagcctttggtacaagagaaaaagagagtagtgaaaaaagaccactctgttaactctttcaaaaaccagaaacatcctgaatccattcaaggtagtaaagaaaaaggcatatggaagccggaaacacctcaggcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgaggctgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacacaagcccctttgcaaagtctctgggtcattccagaggggaggctgacctttttgattctggggacattttttccacgggcactggatctcagtccgtggagagaacaaaacccaaggcaaagatagcagagaatcctgccaacccaccagtgggtggtaaagcaaagagccccatgtttcctgctctaggcgaggccagcagtgatgatgatctctttcagtctgctaaaccaaaaccagcaaagaaaacaaatccctttcctctcctggaagatgaggatgacctctttacagatcagaaagtcaagaagaatgagacaaaatccagtagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctccactggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatattgtatatgctcatggtcttaactggattacaaaaagcaaatactagaacagctagctcatcttttacccaatgtacttagtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatctcagagatagcaaatgccacctgaccagaagtctttgttatatggatgggaaccctaacttagggcttgggcaggggaaagagaaagaagatgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaatcacaaaaaaatg

SEQ ID NO: 456723 - DNA, 1196 bp, Homo sapiens
gcaacgccggggccagagtcttaaaaccgagggcccgcaggggtccccgcggccgccgcgatgcagaaatacgagaaactggaaaagattggggaaggcacctacggaactgtgttcaaggccaaaaaccgggagactcatgagatcgtggctctgaaacgggtgaggctggatgacgatgatgagggtgtgccgagttccgccctccgggagatctgcctactcaaggagctgaagcacaagaacatcgtcaggcttcatgacgtcctgcacagcgacaagaagctgactttggtttttgaattctgtgaccaggacctgaagaagtattttgacagttgcaatggtgacctcgatcctgagattgtaaagtcattcctcttccagctactaaaagggctgggattctgtcatagccgcaatgtgctacacagggacctgaagccccagaacctgctaataaacaggaatggggagctgaaattggctgattttggcctggctcgagcctttgggattcccgtccgctgttactcagctgaggtggtcacactgtggtaccgcccaccggatgtcctctttggggccaagctgtactccacgtccatcgacatgtggtcagccggctgcatctttgcagagctggccaatgctgggcggcctctttttcccggcaatgatgtcgatgaccagttgaagaggatcttccgactgctggggacgcccaccgaggagcagtggccctctatgaccaagctgccagactataagccctatccgatgtacccggccacaacatccctggtgaacgtcgtgcccaaactcaatgccacagggagggatctgctgcagaaccttctgaagtgtaaccctgtccagcgtatctcagcagaagaggccctgcagcacccctacttctccgacttctgtccgccctaggccccgggacccccggcctccaggctggggcctggcctatttaagccccctcttgagaggggtgagacagtgggggtgcctggtgcgctgtgctccagcagtgctgggcccagccggggtggggtgcctgagcccgaatttctcactccctttgtggactttatttaatttcataaattggctcctttcccacaaaaaaaaaagggggcggacaaagaatcctcgagggccagtagagtaccgttttgtcaagggtc

SEQ ID NO: 456724 - DNA, 1133 bp, Homo sapiens
gcaacgccggggccagagtcttaaaaccgagggcccgcaggggtccccgcggccgccgcgatgcagaaatacgagaaactggaaaagattggggaaggcacctacggaactgtgttcaaggccaaaaaccgggagactcatgagatcgtggctctgaaacgggtgaggctggatgacgatgatgagggtgtgccgagttccgccctccgggagatctgcctactcaaggagctgaagcacaagaacatcgtcaggcttcatgacgtcctgcacagcgacaagaagctgactttggtttttgaattctgtgaccaggacctgaagaagtattttgacagttgcaatggtgacctcgatcctgagattgtaaagtcattcctcttccagctactaaaagggctgggattctgtcatagccgcaatgtgctacacagggacctgaagccccagaacctgctaataaacaggaatggggagctgaaattggctgattttggcctggctcgagcctttgggattcccgtccgctgttactcagctgaggtggtcacactgtggtaccgcccaccggatgtcctctttggggccaagctgtactccacgtccatcgacatgtggtcagccggctgcatctttgcagagctggccaatgctgggcggcctctttttcccggcaatgatgtcgatgaccagttgaagaggatcttccgactgctggggacgcccaccgaggagcagtggccctctatgaccaagctgccagactataagccctatccgatgtacccggccacaacatccctggtgaacgtcgtgcccaaactcaatgccacagggagggatctgctgcagaaccttctgaagtgtaaccctgtccagcgtatctcagcagaagaggccctgcagcacccctacttctccgacttctgtccgccctaggccccgggacccccggcctccaggctggggcctggcctatttaagccccctcttgagaggggtgagacagtgggggtgcctggtgcgctgtgctccagcagtgctgggcccagccggggtggggtgcctgagcccgaatttctcactccctttgtggactttatttaatttcataaattggctcctttcccaca

SEQ ID NO: 456725 - DNA, 543 bp, Homo sapiens
gcaacgccggggccagagtcttaaaaccgagggcccgcaggggtccccgcggccgccgcgatgcagaaatacgagaaactggaaaagattggggaaggcacctacggaactgtgttcaaggccaaaaaccgggagactcatgagatcgtggctctgaaacgggtgaggctggatgacgatgatgagggtgtgccgagttccgccctccgggagatctgcctactcaaggagctgaagcacaagaacatcgtcaggcttcatgacgtcctgcacagcgacaagaagctgactttggtttttgaattctgtgaccaggacctgaagaagtattttgacagttgcaatggtgacctcgatcctgagattgtaacttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgta

SEQ ID NO: 456726 - DNA, 1172 bp, Homo sapiens
gcaacgccggggccagagtcttaaaaccgagggcccgcaggggtccccgcggccgccgcgatgcagaaatacgagaaactggaaaagattggggaaggcacctacggaactgtgttcaaggccaaaaaccgggagactcatgagatcgtggctctgaaacggggtgtgccgagttccgccctccgggagatctgcctactcaaggagctgaagcacaagaacatcgtcaggcttcatgacgtcctgcacagcgacaagaagctgactttggtttttgaattctgtgaccaggacctgaagaagtattttgacagttgcaatggtgacctcgatcctgagattgtaaagtcattcctcttccagctactaaaagggctgggattctgtcatagccgcaatgtgctacacagggacctgaagccccagaacctgctaataaacaggaatggggagctgaaattggctgattttggcctggctcgagcctttgggattcccgtccgctgttactcagctgaggtggtcacactgtggtaccgcccaccggatgtcctctttggggccaagctgtactccacgtccatcgacatgtggtcagccggctgcatctttgcagagctggccaatgctgggcggcctctttttcccggcaatgatgtcgatgaccagttgaagaggatcttccgactgctggggacgcccaccgaggagcagtggccctctatgaccaagctgccagactataagccctatccgatgtacccggccacaacatccctggtgaacgtcgtgcccaaactcaatgccacagggagggatctgctgcagaaccttctgaagtgtaaccctgtccagcgtatctcagcagaagaggccctgcagcacccctacttctccgacttctgtccgccctaggccccgggacccccggcctccaggctggggcctggcctatttaagccccctcttgagaggggtgagacagtgggggtgcctggtgcgctgtgctccagcagtgctgggcccagccggggtggggtgcctgagcccgaatttctcactccctttgtggactttatttaatttcataaattggctcctttcccacaaaaaaaaaagggggcggacaaagaatcctcgagggccagtagagtaccgttttgtcaagggtc

SEQ ID NO: 456727 - DNA, 7044 bp, Homo sapiens
gggggaagggtagtggagagagaggaagcaggagggagggagaaaaagagagagactgactgtatctggggattctggcaaggtgaagagctggtctgtttggcaggaccttcccatctgggatccatctgtgtttccctggaatgggacaggcagctctagtcagtgagaaatcgcagatgtgagagagctgacacatgtccagctaatgaaaggaggaggaaggctggtctccgattgagctttgaagattaggaggagaaaaagaggagctttggaatatctatttcaaataaatttggtgtatttaagaatctggattgtttataatttgggcatttgggaggtggggttttgccatgttgcccaggtgggtctcaaactcctgggctaaagcgatcttcccatgttggctgcccaaagtgctgggattacaggcaagagccaccataccagttcctgtctagatattatgatgaagattgaggatggtagtttttgtggagcacaatcctgactgtacctgtgatgttgcattcatcttttggaacataagcagatcaccaggtgaatggctaaagaatctggaataagcttgaaagaaatacaggtcctggcaaggcaatggaaagggtctcaccctgtcactcaggctggagcacagtggtgtgatcacagctcactgcagcctcgacctcctggactcagttggtcctgagaaaagggtgccagcgatgcctggatcgcctgtggaagtgaagatacagtccagatcctcacctcccaccatgccacccctcccaccaataaatcctggaggaccgaggccagtgtccttcactcctactgcattaagcaatggcatcaaccattctcctcctaccctgaatggtgccccatcaccgccacagagattcagcaatggtcctgcctcctccacatcatctgcactcacaaatcagcaattgccagccacttgtggtgctcgacaactcagcaagttgaaacgctttcttaccactctgcaacagtttggcaatgacatctcccctgagattggggagaaggtgcggactcttgttcttgcactggtgaactcaacagtgacaattgaggaattccactgtaagctccaagaagccacaaactttccccttcgtccttttgtgattccatttctcaaggccaacctgcccctgctgcagcgggaactgctgcactgcgctcgggcggccaagcagaccccatcccagtacctggctcagcacgaacaccttctgctcaacacaagcattgcatcgcctgctgactcgtcagagttgctcatggaggtgcacggaaatgggaagaggcccagtccagagaggagagaagagaatagttttgatagagacacaattgctcctgagcctcctgccaagagagtatgtaccatcagccctgctcctcggcacagtcctgctctcactgtgcccctcatgaatcccgggggccaattccatcctacccctccacctcttcagcattacaccttagaggatattgcaacttctcacctgtatcgggaacccaacaagatgctagagcatcgagaagttcgtgatagacaccacagtcttggtctaaatggaggctatcaagatgagttggtagatcatcgtttgacagaaagggaatgggctgatgaatggaaacatcttgaccatgcgctgaattgcattatggaaatggtagagaaaacaaggcgctctatggcagttctgcggcgctgtcaggaatcagatcgtgaagaactcaactactggaaaagacggtacaatgaaaacacagagctgaggaaaacggggaccgagttggtctccaggcagcacagccctgggagtgcagattctctcagcaatgattctcagagagagttcaacagcaggccaggtacaggatacgtacctgtggagttttggaaaaaaacagaagaagctgtgaataaggtgaaaattcaggccatgtcagaagtacagaaggccgtcgctgaggcagagcagaaagcctttgaagtgattgcaacagagagagcacgaatggagcaaaccatagcggatgtcaagcggcaggccgcagaggatgctttcctcgtcatcaatgagcaagaggagtccacggagaactgctggaactgtggccgcaaagccagcgagacatgcagtggctgcaatatcgcgcgatactgtggctctttctgccagcacaaggactgggagcggcaccaccgcctctgtggtcagaacctgcatggccagagcccccacggccagggccggccgctgcttcctgtaggcaggggctcctctgccaggtccgccgactgcagcgtgcccagcccagccctcgacaagacctcggcaaccacatcgcgttcctcaacacctgcttctgtgacagctatcgacaccaacggactctgagccccggactctgcttaccctgatggctgctcagcaccacagagtgcttgggctgagggactgactgttggaacccgtgcatgtagctgccgggtcatcagcaagaaatgaattggaggcaggaagagtccaagcctgaataataacaccccacagcctctctgtgcacttgctgtctgcggagccagtgtgccattctctgcacatgggcagccagcctgagctgcctcctccatggctttcctggtttgttcctctctccactgaagctgacttagccggccccttttcagtgtagaccaccagctcccctccccatctccttgagtcagcagactgtccaatgtgctcagccaggctggaggcggcaggcggcaggcagcaggctgtggaggaggcccctcggtcagggagcggcctgcctcacccctgaatagctccttcggccccatctccatcctcagcagatgacactgattggcctcacggggacttgggtaagcaacaggcggcattcaggactcttctcaaccctgctgttcagacttgataagatctcagagtccacaggaaagaagtcactgttgcaataaaagcacccgtagtagcaaaaacataaaacaaataaaacttcccccacatcacagatgattttggacaagattttccaaccttgctggctactttagtttgggacctgttttttttctcatttgattttgcttgtgcagaaaatagtttccagcacatggattgatctgagagagaatgaggctcagttgtggatagtctgttttctctgagcatgttggccaactagtatcgtcaaattattgagtggatcatctcttggaaatgcagaacttctgccaccacttggctatttgcacagtcatcttgttctgtgtccttttatctctcagaccacacacatctggaacgctgtgggcatcttctgcccatgggctccatttggcacctgctgagccacagttgtcctgctggatgtgctgtgcaggttggtaggacttgcccccactgtcaaggcctggtctcatctgaaaagccctcctggacctcaaagaattcttcagacctcatagttacaggtcattatatctactatgttgatttatcatcaggcacacaacttctgtttccttctcttgtgttatctgatagcgtccctccttgagctcatcagaaaggttttatgaaatgtgaaccattttgggaaaagctgatcaatttttcttcctagcttcccattttcaaatgggacatcactcatatccctttcagaatgttaggaactgcctcccacattcttccctgtctttttgggttttgttttttgttgttgttgtggttttttaacacaaagcctgggcaacagagcaaaactctgtctcaaaaaaaaaaaaaaaaaggcaaaattaaagaatttcaagtccctaatttactctaaccaagcattttcagtcttacaaagaaatctagtgcacgacacctttaaaatgcctagatttccattgcctaaagtaaggtgtgaccagtgaaacaacagcagagaatcatgttcctttgctgtggaacacataagccccacagttttccagtcagcctaatacatgggtatcccccgaccccatctgcctccttaagccacagtccttggtggggaactctaagggggacggagtcagtaccccggacagggccacatttgcatgagacatggctgtctcacaggtcacagagccattacaacagcttactagtttttcatggatttgttggattaacaccttaagcaggttttttattgttattttgtttgtttgtttgttttgagacgggagtttctctcttgtctcccaggctggagtgcaatcgcgcaatctcggctcacggtaacctctgcctcccaggttcgggcgagtctcctgcctcagccttctgagtagctgggattgcaggcatgcgccaccacgcccaactgattttgtatttttagtagagacggggtttctccttgttggtcaggctggtctcaaaccccggacctcaggtgatccccccaccttggcctcccaaagtgccaggattacaggcatgagccactgtgtccggtcttgagcaggtttttaaaatctccagtggccataaaactagccagggtagctcatgcttttactggttggaataaggagccaaaaccaacaaaataatatttattagggctcgatgcccatttctgtggctaaggcttaggtttggtgtgcagagcctggcctgctcttgtgggctgtggttgctgtgacagtttcgttttctgaatctttgtaatgctcttccaccctgctcgtgctgcccagaggctgatctgcaaacctgggcagtattccacactgaagctcagtttgcaaaccttctgctgtgttaattctggtcagtttcacacagaagtcacgagggcctctgcccaggaccttctattcacatttcaagaatccctttctgaaattctccaactctctggtcaggaggaggagcaccattggggcggggtaggcagctagaggcgcaggagcgaatccaggttccttgcgtggttcccagcctctgctgacagcacctcagctaccaggtggggagtggaaattcagcctgcttagaggactgacctctacagttcatatttgcagtgacataaaaggcaaagaggagctggcatggtggtacagaaggtatcagtcaagcgcaggctcttcagaaacctagaaactaaaaagagatgcaacatgtgactggccatcagccagacatgtctagggtgagaccagtgctcagcaccacccgccaaggaacactgatgagttgtgggacattatggtcggccaagtgaggaatgattgcagggaccagagaagaccaaagatgccagatgtccccagagtttcttgagggctgggtttcacgtctttgcttgtcctttttgtccccacttgcctgcaccgtgcctgactcatccagtggggaaggtgactcaagaagttgtttaagcctaggcctaggcagtccacttcgggaggtgggggcactccacactggggggccctgcagctccagggctggtgctctagcagatccgctcaggcacggttgggtgaccgtggggtcaccgattgcgtagattatttctagggcagtgctgggttagaaatgtctgtctggaaacaggacacatcttgccaccacaagtccacacctggccttggctgctgcccgctctctgcagcgtggatttcctttgcccatttgggccagaaggtcaccaggagttcatcactgcttagtgtcaacttgacatcttcagcttccagacagaaaacccatgctttactttgtacagccctgtcccagagttagtaagcctcggcttgtcacctgcttgcaaagggtatagacatcattctgggtagttctagaggatatcgcaacaagtgcgtttgaaggttcagcacagctggaattgtacggtagtgagctcttcaaaatgaaaacagaatgaccggatggccatctgtcctggaaactgtagaattgaataaatcactgaaaatagaacacttcttggaggctttcttcagaactgaactagaaacaaggtttccaggctcccaggtcagtagaccaaaccaacttccttagatttttttttttaagctgtttgcagaaaactgggtggtagcgtgtctgaaccaaacggaagaatagccagcggagcatggactgttccagcacgggccagatggccagctgtcgagagcagccctgcccagattgcggtgggggctgtgccagcggctccgcagggcccttccaactctggagtgtctgtagttcttgtgaaaccaaaacgttgactacctgcctctttcctcgggcatcgacgtgctcatttccaaagatgatggtgcaggtgaccttttccatcgtgagctaagagaaggttaggaggcctgaggggcgggccttgtgtcccctcctccccctccacagcccctgaggtggagcttccctcacagaccccatctggtcgagcctacggctgcccagtgtacactcagtgatgcttataccaaatagggcatgtgcgctggtgtctgttggggacagccccatccctaccttggagtcggcagagaagcagcaataagcattaggcgaatgattgaaagggctgctgcgccaagaggccttcagtccccttaacgtggctttccaacttcctgacgaggctacaaaggctccgctcacaaaagaaagccaataatgtaaataaatagaaaacgaagcctccacgcgtggtttttaaagggggatgatgaatgtgacaccacccacagaatgcattagaatctggtttttctgtgctttgtcattttactctgataggaatttttgttacctaactctgtgcataacttatttaatgtactgtataaatgaaccaaaactgttaaatatgtatttagtttgttctacttaaagtagtcaataaaaaggctatattcct

SEQ ID NO: 456728 - DNA, 691 bp, Homo sapiens
tgaccagctaatgtttgtttgtttgtttgtttgtttgtttgtttgtttgtttttggagagatgaggttttaccatgttgcccaggctggtctcaaacttgtgagctcaagagatctgcccgcctcaacctcccaaagtgctgggattatatggatgtgagccaccatgcccagcccaatgtctcagactttctgtggttatttttgctttattccaatacctagctgcataatacatctaaaatctatgggagtagcttccagacatgagtatttttcgggaactcttcagatgcctgcacacccggtaagaaactctactctagagaatttatgggtcgactgttccagaagcctcaggagtacagttctgccttttccttgatgctgtttgtagaaagaattggaaaaaaaaaaaaaagaaaagaaaagaaaaaacaaaaaaaaagaaatacaatctgccaaatgccttttatgtcaaacgcatttttttctgatctgagaagttttgaaaaagtatagcaattaattattaatatttgccaatgactcacctttactgagattaaaattaatatgaatttattttagaaaactccctatgagtggctatcaaaatattctatgggttatcaaagaaggcaatatcaacaatagtggataggctttaatgacatttttttaaaagtaaa

SEQ ID NO: 456729 - DNA, 6968 bp, Homo sapiens
gggggaagggtagtggagagagaggaagcaggagggagggagaaaaagagagagactgactgtatctggggattctggcaaggtgaagagctggtctgtttggcaggaccttcccatctgggatccatctgtgtttccctggaatgggacaggcagctctagtcagtgagaaatcgcagatgtgagagagctgacacatgtccagctaatgaaaggaggaggaaggctggtctccgattgagctttgaagattaggaggagaaaaagaggagctttggaatatctatttcaaataaatttggtgtatttaagaatctggattgtttataatttgggcatttgggaggtggggttttgccatgttgcccaggtgggtctcaaactcctgggctaaagcgatcttcccatgttggctgcccaaagtgctgggattacaggcaagagccaccataccagttcctgtctagatattatgatgaagattgaggatggtagtttttgtggagcacaatcctgactgtacctgtgatgttgcattcatcttttggaacataagcagatcaccaggtgaatggctaaagaatctggaataagcttgaaagaaatacaggtcctggcaaggcaatggaaagttggtcctgagaaaagggtgccagcgatgcctggatcgcctgtggaagtgaagatacagtccagatcctcacctcccaccatgccacccctcccaccaataaatcctggaggaccgaggccagtgtccttcactcctactgcattaagcaatggcatcaaccattctcctcctaccctgaatggtgccccatcaccgccacagagattcagcaatggtcctgcctcctccacatcatctgcactcacaaatcagcaattgccagccacttgtggtgctcgacaactcagcaagttgaaacgctttcttaccactctgcaacagtttggcaatgacatctcccctgagattggggagaaggtgcggactcttgttcttgcactggtgaactcaacagtgacaattgaggaattccactgtaagctccaagaagccacaaactttccccttcgtccttttgtgattccatttctcaaggccaacctgcccctgctgcagcgggaactgctgcactgcgctcgggcggccaagcagaccccatcccagtacctggctcagcacgaacaccttctgctcaacacaagcattgcatcgcctgctgactcgtcagagttgctcatggaggtgcacggaaatgggaagaggcccagtccagagaggagagaagagaatagttttgatagagacacaattgctcctgagcctcctgccaagagagtatgtaccatcagccctgctcctcggcacagtcctgctctcactgtgcccctcatgaatcccgggggccaattccatcctacccctccacctcttcagcattacaccttagaggatattgcaacttctcacctgtatcgggaacccaacaagatgctagagcatcgagaagttcgtgatagacaccacagtcttggtctaaatggaggctatcaagatgagttggtagatcatcgtttgacagaaagggaatgggctgatgaatggaaacatcttgaccatgcgctgaattgcattatggaaatggtagagaaaacaaggcgctctatggcagttctgcggcgctgtcaggaatcagatcgtgaagaactcaactactggaaaagacggtacaatgaaaacacagagctgaggaaaacggggaccgagttggtctccaggcagcacagccctgggagtgcagattctctcagcaatgattctcagagagagttcaacagcaggccaggtacaggatacgtacctgtggagttttggaaaaaaacagaagaagctgtgaataaggtgaaaattcaggccatgtcagaagtacagaaggccgtcgctgaggcagagcagaaagcctttgaagtgattgcaacagagagagcacgaatggagcaaaccatagcggatgtcaagcggcaggccgcagaggatgctttcctcgtcatcaatgagcaagaggagtccacggagaactgctggaactgtggccgcaaagccagcgagacatgcagtggctgcaatatcgcgcgatactgtggctctttctgccagcacaaggactgggagcggcaccaccgcctctgtggtcagaacctgcatggccagagcccccacggccagggccggccgctgcttcctgtaggcaggggctcctctgccaggtccgccgactgcagcgtgcccagcccagccctcgacaagacctcggcaaccacatcgcgttcctcaacacctgcttctgtgacagctatcgacaccaacggactctgagccccggactctgcttaccctgatggctgctcagcaccacagagtgcttgggctgagggactgactgttggaacccgtgcatgtagctgccgggtcatcagcaagaaatgaattggaggcaggaagagtccaagcctgaataataacaccccacagcctctctgtgcacttgctgtctgcggagccagtgtgccattctctgcacatgggcagccagcctgagctgcctcctccatggctttcctggtttgttcctctctccactgaagctgacttagccggccccttttcagtgtagaccaccagctcccctccccatctccttgagtcagcagactgtccaatgtgctcagccaggctggaggcggcaggcggcaggcagcaggctgtggaggaggcccctcggtcagggagcggcctgcctcacccctgaatagctccttcggccccatctccatcctcagcagatgacactgattggcctcacggggacttgggtaagcaacaggcggcattcaggactcttctcaaccctgctgttcagacttgataagatctcagagtccacaggaaagaagtcactgttgcaataaaagcacccgtagtagcaaaaacataaaacaaataaaacttcccccacatcacagatgattttggacaagattttccaaccttgctggctactttagtttgggacctgttttttttctcatttgattttgcttgtgcagaaaatagtttccagcacatggattgatctgagagagaatgaggctcagttgtggatagtctgttttctctgagcatgttggccaactagtatcgtcaaattattgagtggatcatctcttggaaatgcagaacttctgccaccacttggctatttgcacagtcatcttgttctgtgtccttttatctctcagaccacacacatctggaacgctgtgggcatcttctgcccatgggctccatttggcacctgctgagccacagttgtcctgctggatgtgctgtgcaggttggtaggacttgcccccactgtcaaggcctggtctcatctgaaaagccctcctggacctcaaagaattcttcagacctcatagttacaggtcattatatctactatgttgatttatcatcaggcacacaacttctgtttccttctcttgtgttatctgatagcgtccctccttgagctcatcagaaaggttttatgaaatgtgaaccattttgggaaaagctgatcaatttttcttcctagcttcccattttcaaatgggacatcactcatatccctttcagaatgttaggaactgcctcccacattcttccctgtctttttgggttttgttttttgttgttgttgtggttttttaacacaaagcctgggcaacagagcaaaactctgtctcaaaaaaaaaaaaaaaaaggcaaaattaaagaatttcaagtccctaatttactctaaccaagcattttcagtcttacaaagaaatctagtgcacgacacctttaaaatgcctagatttccattgcctaaagtaaggtgtgaccagtgaaacaacagcagagaatcatgttcctttgctgtggaacacataagccccacagttttccagtcagcctaatacatgggtatcccccgaccccatctgcctccttaagccacagtccttggtggggaactctaagggggacggagtcagtaccccggacagggccacatttgcatgagacatggctgtctcacaggtcacagagccattacaacagcttactagtttttcatggatttgttggattaacaccttaagcaggttttttattgttattttgtttgtttgtttgttttgagacgggagtttctctcttgtctcccaggctggagtgcaatcgcgcaatctcggctcacggtaacctctgcctcccaggttcgggcgagtctcctgcctcagccttctgagtagctgggattgcaggcatgcgccaccacgcccaactgattttgtatttttagtagagacggggtttctccttgttggtcaggctggtctcaaaccccggacctcaggtgatccccccaccttggcctcccaaagtgccaggattacaggcatgagccactgtgtccggtcttgagcaggtttttaaaatctccagtggccataaaactagccagggtagctcatgcttttactggttggaataaggagccaaaaccaacaaaataatatttattagggctcgatgcccatttctgtggctaaggcttaggtttggtgtgcagagcctggcctgctcttgtgggctgtggttgctgtgacagtttcgttttctgaatctttgtaatgctcttccaccctgctcgtgctgcccagaggctgatctgcaaacctgggcagtattccacactgaagctcagtttgcaaaccttctgctgtgttaattctggtcagtttcacacagaagtcacgagggcctctgcccaggaccttctattcacatttcaagaatccctttctgaaattctccaactctctggtcaggaggaggagcaccattggggcggggtaggcagctagaggcgcaggagcgaatccaggttccttgcgtggttcccagcctctgctgacagcacctcagctaccaggtggggagtggaaattcagcctgcttagaggactgacctctacagttcatatttgcagtgacataaaaggcaaagaggagctggcatggtggtacagaaggtatcagtcaagcgcaggctcttcagaaacctagaaactaaaaagagatgcaacatgtgactggccatcagccagacatgtctagggtgagaccagtgctcagcaccacccgccaaggaacactgatgagttgtgggacattatggtcggccaagtgaggaatgattgcagggaccagagaagaccaaagatgccagatgtccccagagtttcttgagggctgggtttcacgtctttgcttgtcctttttgtccccacttgcctgcaccgtgcctgactcatccagtggggaaggtgactcaagaagttgtttaagcctaggcctaggcagtccacttcgggaggtgggggcactccacactggggggccctgcagctccagggctggtgctctagcagatccgctcaggcacggttgggtgaccgtggggtcaccgattgcgtagattatttctagggcagtgctgggttagaaatgtctgtctggaaacaggacacatcttgccaccacaagtccacacctggccttggctgctgcccgctctctgcagcgtggatttcctttgcccatttgggccagaaggtcaccaggagttcatcactgcttagtgtcaacttgacatcttcagcttccagacagaaaacccatgctttactttgtacagccctgtcccagagttagtaagcctcggcttgtcacctgcttgcaaagggtatagacatcattctgggtagttctagaggatatcgcaacaagtgcgtttgaaggttcagcacagctggaattgtacggtagtgagctcttcaaaatgaaaacagaatgaccggatggccatctgtcctggaaactgtagaattgaataaatcactgaaaatagaacacttcttggaggctttcttcagaactgaactagaaacaaggtttccaggctcccaggtcagtagaccaaaccaacttccttagatttttttttttaagctgtttgcagaaaactgggtggtagcgtgtctgaaccaaacggaagaatagccagcggagcatggactgttccagcacgggccagatggccagctgtcgagagcagccctgcccagattgcggtgggggctgtgccagcggctccgcagggcccttccaactctggagtgtctgtagttcttgtgaaaccaaaacgttgactacctgcctctttcctcgggcatcgacgtgctcatttccaaagatgatggtgcaggtgaccttttccatcgtgagctaagagaaggttaggaggcctgaggggcgggccttgtgtcccctcctccccctccacagcccctgaggtggagcttccctcacagaccccatctggtcgagcctacggctgcccagtgtacactcagtgatgcttataccaaatagggcatgtgcgctggtgtctgttggggacagccccatccctaccttggagtcggcagagaagcagcaataagcattaggcgaatgattgaaagggctgctgcgccaagaggccttcagtccccttaacgtggctttccaacttcctgacgaggctacaaaggctccgctcacaaaagaaagccaataatgtaaataaatagaaaacgaagcctccacgcgtggtttttaaagggggatgatgaatgtgacaccacccacagaatgcattagaatctggtttttctgtgctttgtcattttactctgataggaatttttgttacctaactctgtgcataacttatttaatgtactgtataaatgaaccaaaactgttaaatatgtatttagtttgttctacttaaagtagtcaataaaaaggctatattcct

SEQ ID NO: 456730 - DNA, 7484 bp, Homo sapiens
gggggaagggtagtggagagagaggaagcaggagggagggagaaaaagagagagactgactgtatctggggattctggcaaggtgaagagctggtctgtttggcaggaccttcccatctgggatccatctgtgtttccctggaatgggacaggcagctctagtcagtgagaaatcgcagatgtgagagagctgacacatgtccagctaatgaaaggaggaggaaggctggtctccgattgagctttgaagattaggaggagaaaaagaggagctttggaatatctatttcaaataaatttggtgtatttaagaatctggattgtttataatttgggcatttgggttggtcctgagaaaagggtgccagcgatgcctggatcgcctgtggaagtgaagatacagtccagatcctcacctcccaccatgccacccctcccaccaataaatcctggaggaccgaggccagtgtccttcactcctactgcattaagcaatggcatcaaccattctcctcctaccctgaatggtgccccatcaccgccacagagattcagcaatggtcctgcctcctccacatcatctgcactcacaaatcagcaattgccagccacttgtggtgctcgacaactcagcaagttgaaacgctttcttaccactctgcaacagtttggcaatgacatctcccctgagattggggagaaggtgcggactcttgttcttgcactggtgaactcaacagtgacaattgaggaattccactgtaagctccaagaagccacaaactttccccttcgtccttttgtgattccatttctcaaggccaacctgcccctgctgcagcgggaactgctgcactgcgctcgggcggccaagcagaccccatcccagtacctggctcagcacgaacaccttctgctcaacacaagcattgcatcgcctgctgactcgtcagagttgctcatggaggtgcacggaaatgggaagaggcccagtccagagaggagagaagagaatagttttgatagagacacaattgctcctgagcctcctgccaagagagtatgtaccatcagccctgctcctcggcacagtcctgctctcactgtgcccctcatgaatcccgggggccaattccatcctacccctccacctcttcagcattacaccttagaggatattgcaacttctcacctgtatcgggaacccaacaagatgctagagcatcgagaagttcgtgatagacaccacagtcttggtctaaatggaggctatcaagatgagttggtagatcatcgtttgacagaaagggaatgggctgatgaatggaaacatcttgaccatgcgctgaattgcattatggaaatggtagagaaaacaaggcgctctatggcagttctgcggcgctgtcaggaatcagatcgtgaagaactcaactactggaaaagacggtacaatgaaaacacagagctgaggaaaacggggaccgagttggtctccaggcagcacagccctgggagtgcagattctctcagcaatgattctcagagagagttcaacagcaggccaggtacaggatacgtacctgtggagttttggaaaaaaacagaagaagctgtgaataaggtgaaaattcaggccatgtcagaagtacagaaggccgtcgctgaggcagagcagaaagcctttgaagtgattgcaacagagagagcacgaatggagcaaaccatagcggatgtcaagcggcaggccgcagaggatgctttcctcgtcatcaatgagcaagaggagtccacggagaactgctggaactgtggccgcaaagccagcgagacatgcagtggctgcaatatcgcgcgatactgtggctctttctgccagcacaaggactgggagcggcaccaccgcctctgtggtcagaacctgcatggccagagcccccacggccagggccggccgctgcttcctgtaggcaggggctcctctgccaggtccgccgactgcagcgtgcccagcccagccctcgacaagacctcggcaaccacatcgcgttcctcaacacctgcttctgtgacagctatcgacaccaacggactctgagccccggactctgcttaccctgatggctgctcagcaccacagagtgcttgggctgagggactgactgttggaacccgtgcatgtagctgccgggtcatcagcaagaaatgaattggaggcaggaagagtccaagcctgaataataacaccccacagcctctctgtgcacttgctgtctgcggagccagtgtgccattctctgcacatgggcagccagcctgagctgcctcctccatggctttcctggtttgttcctctctccactgaagctgacttagccggccccttttcagtgtagaccaccagctcccctccccatctccttgagtcagcagactgtccaatgtgctcagccaggctggaggcggcaggcggcaggcagcaggctgtggaggaggcccctcggtcagggagcggcctgcctcacccctgaatagctccttcggccccatctccatcctcagcagatgacactgattggcctcacggggacttgggtaagcaacaggcggcattcaggactcttctcaaccctgctgttcagacttgataagatctcagagtccacaggaaagaagtcactgttgcaataaaagcacccgtagtagcaaaaacataaaacaaataaaacttcccccacatcacagatgattttggacaagattttccaaccttgctggctactttagtttgggacctgttttttttctcatttgattttgcttgtgcagaaaatagtttccagcacatggattgatctgagagagaatgaggctcagttgtggatagtctgttttctctgagcatgttggccaactagtatcgtcaaattattgagtggatcatctcttggaaatgcagaacttctgccaccacttggctatttgcacagtcatcttgttctgtgtccttttatctctcagaccacacacatctggaacgctgtgggcatcttctgcccatgggctccatttggcacctgctgagccacagttgtcctgctggatgtgctgtgcaggttggtaggacttgcccccactgtcaaggcctggtctcatctgaaaagccctcctggacctcaaagaattcttcagacctcatagttacaggtcattatatctactatgttgatttatcatcaggcacacaacttctgtttccttctcttgtgttatctgatagcgtccctccttgagctcatcagaaaggttttatgaaatgtgaaccattttgggaaaagctgatcaatttttcttcctagcttcccattttcaaatgggacatcactcatatccctttcagaatgttaggaactgcctcccacattcttccctgtctttttgggttttgttttttgttgttgttgtggttttttaacacaaagctcactctgttgcccaggctggagtgcagtggcatgatcttggctcactgcaacctctgccttccaggttcaagcaattctcctgcctcgagcctcccgagtagctgagattacaggcgcccaccaccacgcccagctagatttttgtattttttagtagagacagggtttcaccatgttggccaggctgatctcgaactcctgacctcaggtgacctgccttggcctcccaaagtgcagggattacaagcgtgagccaccatgcccggcctgtctttttggttttgatgggagtctgaggaccccgacccctcctgctctccatctttgagcctctggcatcctctcacacccagaaatcagttggagtaagtttaattggccctgctccagctggcctttgaagcacaagtttaaatctccaccttctgtgcactgaccagagtctaaaataaaagttgtcagtaccataaaggaaaagggatccacacaggtagccttctccttggatacaggtacatcttactgtaagaatttcaagtcctggctgggcgcagtggctcactcctgtaatcccagcactttgagagaccgaggcaggcagatcacttgaggtcaggaattcaagaccaacctggccaacatggtgaaaccctgtctctaataaaaaaaaaatagaaaaatcagccgggtgtggtggcacacacctgtaatcctagctactcaggaggctgaggcaagagaatctcttgaacctgtgagccagaggttgcagtgagccgagattccaccactgcactccagcctgggcaacagagcaaaactctgtctcaaaaaaaaaaaaaaaaaggcaaaattaaagaatttcaagtccctaatttactctaaccaagcattttcagtcttacaaagaaatctagtgcacgacacctttaaaatgcctagatttccattgcctaaagtaaggtgtgaccagtgaaacaacagcagagaatcatgttcctttgctgtggaacacataagccccacagttttccagtcagcctaatacatgggtatcccccgaccccatctgcctccttaagccacagtccttggtggggaactctaagggggacggagtcagtaccccggacagggccacatttgcatgagacatggctgtctcacaggtcacagagccattacaacagcttactagtttttcatggatttgttggattaacaccttaagcaggttttttattgttattttgtttgtttgtttgttttgagacgggagtttctctcttgtctcccaggctggagtgcaatcgcgcaatctcggctcacggtaacctctgcctcccaggttcgggcgagtctcctgcctcagccttctgagtagctgggattgcaggcatgcgccaccacgcccaactgattttgtatttttagtagagacggggtttctccttgttggtcaggctggtctcaaaccccggacctcaggtgatccccccaccttggcctcccaaagtgccaggattacaggcatgagccactgtgtccggtcttgagcaggtttttaaaatctccagtggccataaaactagccagggtagctcatgcttttactggttggaataaggagccaaaaccaacaaaataatatttattagggctcgatgcccatttctgtggctaaggcttaggtttggtgtgcagagcctggcctgctcttgtgggctgtggttgctgtgacagtttcgttttctgaatctttgtaatgctcttccaccctgctcgtgctgcccagaggctgatctgcaaacctgggcagtattccacactgaagctcagtttgcaaaccttctgctgtgttaattctggtcagtttcacacagaagtcacgagggcctctgcccaggaccttctattcacatttcaagaatccctttctgaaattctccaactctctggtcaggaggaggagcaccattggggcggggtaggcagctagaggcgcaggagcgaatccaggttccttgcgtggttcccagcctctgctgacagcacctcagctaccaggtggggagtggaaattcagcctgcttagaggactgacctctacagttcatatttgcagtgacataaaaggcaaagaggagctggcatggtggtacagaaggtatcagtcaagcgcaggctcttcagaaacctagaaactaaaaagagatgcaacatgtgactggccatcagccagacatgtctagggtgagaccagtgctcagcaccacccgccaaggaacactgatgagttgtgggacattatggtcggccaagtgaggaatgattgcagggaccagagaagaccaaagatgccagatgtccccagagtttcttgagggctgggtttcacgtctttgcttgtcctttttgtccccacttgcctgcaccgtgcctgactcatccagtggggaaggtgactcaagaagttgtttaagcctaggcctaggcagtccacttcgggaggtgggggcactccacactggggggccctgcagctccagggctggtgctctagcagatccgctcaggcacggttgggtgaccgtggggtcaccgattgcgtagattatttctagggcagtgctgggttagaaatgtctgtctggaaacaggacacatcttgccaccacaagtccacacctggccttggctgctgcccgctctctgcagcgtggatttcctttgcccatttgggccagaaggtcaccaggagttcatcactgcttagtgtcaacttgacatcttcagcttccagacagaaaacccatgctttactttgtacagccctgtcccagagttagtaagcctcggcttgtcacctgcttgcaaagggtatagacatcattctgggtagttctagaggatatcgcaacaagtgcgtttgaaggttcagcacagctggaattgtacggtagtgagctcttcaaaatgaaaacagaatgaccggatggccatctgtcctggaaactgtagaattgaataaatcactgaaaatagaacacttcttggaggctttcttcagaactgaactagaaacaaggtttccaggctcccaggtcagtagaccaaaccaacttccttagatttttttttttaagctgtttgcagaaaactgggtggtagcgtgtctgaaccaaacggaagaatagccagcggagcatggactgttccagcacgggccagatggccagctgtcgagagcagccctgcccagattgcggtgggggctgtgccagcggctccgcagggcccttccaactctggagtgtctgtagttcttgtgaaaccaaaacgttgactacctgcctctttcctcgggcatcgacgtgctcatttccaaagatgatggtgcaggtgaccttttccatcgtgagctaagagaaggttaggaggcctgaggggcgggccttgtgtcccctcctccccctccacagcccctgaggtggagcttccctcacagaccccatctggtcgagcctacggctgcccagtgtacactcagtgatgcttataccaaatagggcatgtgcgctggtgtctgttggggacagccccatccctaccttggagtcggcagagaagcagcaataagcattaggcgaatgattgaaagggctgctgcgccaagaggccttcagtccccttaacgtggctttccaacttcctgacgaggctacaaaggctccgctcacaaaagaaagccaataatgtaaataaatagaaaacgaagcctccacgcgtggtttttaaagggggatgatgaatgtgacaccacccacagaatgcattagaatctggtttttctgtgctttgtcattttactctgataggaatttttgttacctaactctgtgcataacttatttaatgtactgtataaatgaaccaaaactgttaaatatgtatttagtttgttctacttaaagtagtcaataaaaaggctatattcct

SEQ ID NO: 456731 - DNA, 7270 bp, Homo sapiens
cgcctgccaccatgcccagctaatttttgtttagtagagatggggtttcaccatgttggccaggctcgtcttgaactcctgacctcaggtgatctgcctgcattggcctcccaacgtgctgggattacagttggtcctgagaaaagggtgccagcgatgcctggatcgcctgtggaagtgaagatacagtccagatcctcacctcccaccatgccacccctcccaccaataaatcctggaggaccgaggccagtgtccttcactcctactgcattaagcaatggcatcaaccattctcctcctaccctgaatggtgccccatcaccgccacagagattcagcaatggtcctgcctcctccacatcatctgcactcacaaatcagcaattgccagccacttgtggtgctcgacaactcagcaagttgaaacgctttcttaccactctgcaacagtttggcaatgacatctcccctgagattggggagaaggtgcggactcttgttcttgcactggtgaactcaacagtgacaattgaggaattccactgtaagctccaagaagccacaaactttccccttcgtccttttgtgattccatttctcaaggccaacctgcccctgctgcagcgggaactgctgcactgcgctcgggcggccaagcagaccccatcccagtacctggctcagcacgaacaccttctgctcaacacaagcattgcatcgcctgctgactcgtcagagttgctcatggaggtgcacggaaatgggaagaggcccagtccagagaggagagaagagaatagttttgatagagacacaattgctcctgagcctcctgccaagagagtatgtaccatcagccctgctcctcggcacagtcctgctctcactgtgcccctcatgaatcccgggggccaattccatcctacccctccacctcttcagcattacaccttagaggatattgcaacttctcacctgtatcgggaacccaacaagatgctagagcatcgagaagttcgtgatagacaccacagtcttggtctaaatggaggctatcaagatgagttggtagatcatcgtttgacagaaagggaatgggctgatgaatggaaacatcttgaccatgcgctgaattgcattatggaaatggtagagaaaacaaggcgctctatggcagttctgcggcgctgtcaggaatcagatcgtgaagaactcaactactggaaaagacggtacaatgaaaacacagagctgaggaaaacggggaccgagttggtctccaggcagcacagccctgggagtgcagattctctcagcaatgattctcagagagagttcaacagcaggccaggtacaggatacgtacctgtggagttttggaaaaaaacagaagaagctgtgaataaggtgaaaattcaggccatgtcagaagtacagaaggccgtcgctgaggcagagcagaaagcctttgaagtgattgcaacagagagagcacgaatggagcaaaccatagcggatgtcaagcggcaggccgcagaggatgctttcctcgtcatcaatgagcaagaggagtccacggagaactgctggaactgtggccgcaaagccagcgagacatgcagtggctgcaatatcgcgcgatactgtggctctttctgccagcacaaggactgggagcggcaccaccgcctctgtggtcagaacctgcatggccagagcccccacggccagggccggccgctgcttcctgtaggcaggggctcctctgccaggtccgccgactgcagcgtgcccagcccagccctcgacaagacctcggcaaccacatcgcgttcctcaacacctgcttctgtgacagctatcgacaccaacggactctgagccccggactctgcttaccctgatggctgctcagcaccacagagtgcttgggctgagggactgactgttggaacccgtgcatgtagctgccgggtcatcagcaagaaatgaattggaggcaggaagagtccaagcctgaataataacaccccacagcctctctgtgcacttgctgtctgcggagccagtgtgccattctctgcacatgggcagccagcctgagctgcctcctccatggctttcctggtttgttcctctctccactgaagctgacttagccggccccttttcagtgtagaccaccagctcccctccccatctccttgagtcagcagactgtccaatgtgctcagccaggctggaggcggcaggcggcaggcagcaggctgtggaggaggcccctcggtcagggagcggcctgcctcacccctgaatagctccttcggccccatctccatcctcagcagatgacactgattggcctcacggggacttgggtaagcaacaggcggcattcaggactcttctcaaccctgctgttcagacttgataagatctcagagtccacaggaaagaagtcactgttgcaataaaagcacccgtagtagcaaaaacataaaacaaataaaacttcccccacatcacagatgattttggacaagattttccaaccttgctggctactttagtttgggacctgttttttttctcatttgattttgcttgtgcagaaaatagtttccagcacatggattgatctgagagagaatgaggctcagttgtggatagtctgttttctctgagcatgttggccaactagtatcgtcaaattattgagtggatcatctcttggaaatgcagaacttctgccaccacttggctatttgcacagtcatcttgttctgtgtccttttatctctcagaccacacacatctggaacgctgtgggcatcttctgcccatgggctccatttggcacctgctgagccacagttgtcctgctggatgtgctgtgcaggttggtaggacttgcccccactgtcaaggcctggtctcatctgaaaagccctcctggacctcaaagaattcttcagacctcatagttacaggtcattatatctactatgttgatttatcatcaggcacacaacttctgtttccttctcttgtgttatctgatagcgtccctccttgagctcatcagaaaggttttatgaaatgtgaaccattttgggaaaagctgatcaatttttcttcctagcttcccattttcaaatgggacatcactcatatccctttcagaatgttaggaactgcctcccacattcttccctgtctttttgggttttgttttttgttgttgttgtggttttttaacacaaagctcactctgttgcccaggctggagtgcagtggcatgatcttggctcactgcaacctctgccttccaggttcaagcaattctcctgcctcgagcctcccgagtagctgagattacaggcgcccaccaccacgcccagctagatttttgtattttttagtagagacagggtttcaccatgttggccaggctgatctcgaactcctgacctcaggtgacctgccttggcctcccaaagtgcagggattacaagcgtgagccaccatgcccggcctgtctttttggttttgatgggagtctgaggaccccgacccctcctgctctccatctttgagcctctggcatcctctcacacccagaaatcagttggagtaagtttaattggccctgctccagctggcctttgaagcacaagtttaaatctccaccttctgtgcactgaccagagtctaaaataaaagttgtcagtaccataaaggaaaagggatccacacaggtagccttctccttggatacaggtacatcttactgtaagaatttcaagtcctggctgggcgcagtggctcactcctgtaatcccagcactttgagagaccgaggcaggcagatcacttgaggtcaggaattcaagaccaacctggccaacatggtgaaaccctgtctctaataaaaaaaaaatagaaaaatcagccgggtgtggtggcacacacctgtaatcctagctactcaggaggctgaggcaagagaatctcttgaacctgtgagccagaggttgcagtgagccgagattccaccactgcactccagcctgggcaacagagcaaaactctgtctcaaaaaaaaaaaaaaaaaggcaaaattaaagaatttcaagtccctaatttactctaaccaagcattttcagtcttacaaagaaatctagtgcacgacacctttaaaatgcctagatttccattgcctaaagtaaggtgtgaccagtgaaacaacagcagagaatcatgttcctttgctgtggaacacataagccccacagttttccagtcagcctaatacatgggtatcccccgaccccatctgcctccttaagccacagtccttggtggggaactctaagggggacggagtcagtaccccggacagggccacatttgcatgagacatggctgtctcacaggtcacagagccattacaacagcttactagtttttcatggatttgttggattaacaccttaagcaggttttttattgttattttgtttgtttgtttgttttgagacgggagtttctctcttgtctcccaggctggagtgcaatcgcgcaatctcggctcacggtaacctctgcctcccaggttcgggcgagtctcctgcctcagccttctgagtagctgggattgcaggcatgcgccaccacgcccaactgattttgtatttttagtagagacggggtttctccttgttggtcaggctggtctcaaaccccggacctcaggtgatccccccaccttggcctcccaaagtgccaggattacaggcatgagccactgtgtccggtcttgagcaggtttttaaaatctccagtggccataaaactagccagggtagctcatgcttttactggttggaataaggagccaaaaccaacaaaataatatttattagggctcgatgcccatttctgtggctaaggcttaggtttggtgtgcagagcctggcctgctcttgtgggctgtggttgctgtgacagtttcgttttctgaatctttgtaatgctcttccaccctgctcgtgctgcccagaggctgatctgcaaacctgggcagtattccacactgaagctcagtttgcaaaccttctgctgtgttaattctggtcagtttcacacagaagtcacgagggcctctgcccaggaccttctattcacatttcaagaatccctttctgaaattctccaactctctggtcaggaggaggagcaccattggggcggggtaggcagctagaggcgcaggagcgaatccaggttccttgcgtggttcccagcctctgctgacagcacctcagctaccaggtggggagtggaaattcagcctgcttagaggactgacctctacagttcatatttgcagtgacataaaaggcaaagaggagctggcatggtggtacagaaggtatcagtcaagcgcaggctcttcagaaacctagaaactaaaaagagatgcaacatgtgactggccatcagccagacatgtctagggtgagaccagtgctcagcaccacccgccaaggaacactgatgagttgtgggacattatggtcggccaagtgaggaatgattgcagggaccagagaagaccaaagatgccagatgtccccagagtttcttgagggctgggtttcacgtctttgcttgtcctttttgtccccacttgcctgcaccgtgcctgactcatccagtggggaaggtgactcaagaagttgtttaagcctaggcctaggcagtccacttcgggaggtgggggcactccacactggggggccctgcagctccagggctggtgctctagcagatccgctcaggcacggttgggtgaccgtggggtcaccgattgcgtagattatttctagggcagtgctgggttagaaatgtctgtctggaaacaggacacatcttgccaccacaagtccacacctggccttggctgctgcccgctctctgcagcgtggatttcctttgcccatttgggccagaaggtcaccaggagttcatcactgcttagtgtcaacttgacatcttcagcttccagacagaaaacccatgctttactttgtacagccctgtcccagagttagtaagcctcggcttgtcacctgcttgcaaagggtatagacatcattctgggtagttctagaggatatcgcaacaagtgcgtttgaaggttcagcacagctggaattgtacggtagtgagctcttcaaaatgaaaacagaatgaccggatggccatctgtcctggaaactgtagaattgaataaatcactgaaaatagaacacttcttggaggctttcttcagaactgaactagaaacaaggtttccaggctcccaggtcagtagaccaaaccaacttccttagatttttttttttaagctgtttgcagaaaactgggtggtagcgtgtctgaaccaaacggaagaatagccagcggagcatggactgttccagcacgggccagatggccagctgtcgagagcagccctgcccagattgcggtgggggctgtgccagcggctccgcagggcccttccaactctggagtgtctgtagttcttgtgaaaccaaaacgttgactacctgcctctttcctcgggcatcgacgtgctcatttccaaagatgatggtgcaggtgaccttttccatcgtgagctaagagaaggttaggaggcctgaggggcgggccttgtgtcccctcctccccctccacagcccctgaggtggagcttccctcacagaccccatctggtcgagcctacggctgcccagtgtacactcagtgatgcttataccaaatagggcatgtgcgctggtgtctgttggggacagccccatccctaccttggagtcggcagagaagcagcaataagcattaggcgaatgattgaaagggctgctgcgccaagaggccttcagtccccttaacgtggctttccaacttcctgacgaggctacaaaggctccgctcacaaaagaaagccaataatgtaaataaatagaaaacgaagcctccacgcgtggtttttaaagggggatgatgaatgtgacaccacccacagaatgcattagaatctggtttttctgtgctttgtcattttactctgataggaatttttgttacctaactctgtgcataacttatttaatgtactgtataaatgaaccaaaactgttaaatatgtatttagtttgttctacttaaagtagtcaataaaaaggctatattcct

SEQ ID NO: 456732 - DNA, 7486 bp, Homo sapiens
gggggaagggtagtggagagagaggaagcaggagggagggagaaaaagagagagactgactgtatctggggattctggcaaggtgaagagctggtctgtttggcaggaccttcccatctgggatccatctgtgtttccctggaatgggacaggcagctctagtcagtgagaaatcgcagatgtgagagagctgacacatgtccagctaatgaaaggaggaggaaggctggtctccgattgagctttgaagattaggaggagaaaaagaggagctttggaatatctatttcaaataaatttggtgtatttaagaatctggattgtttataatttgggcatttgggttggtcctgagaaaagggtgccagcgatgcctggatcgcctgtggaagtgaagatacagtccagatcctcacctcccaccatgccacccctcccaccaataaatcctggaggaccgaggccagtgtccttcactcctactgcattaagcaatggcatcaaccattctcctcctaccctgaatggtgccccatcaccgccacagagattcagcaatggtcctgcctcctccacatcatctgcactcacaaatcagcaattgccagccacttgtggtgctcgacaactcagcaagttgaaacgctttcttaccactctgcaacagtttggcaatgacatctcccctgagattggggagaaggtgcggactcttgttcttgcactggtgaactcaacagtgacaattgaggaattccactgtaagctccaagaagccacaaactttccccttcgtccttttgtgattccatttctcaaggccaacctgcccctgctgcagcgggaactgctgcactgcgctcgggcggccaagcagaccccatcccagtacctggctcagcacgaacaccttctgctcaacacaagcattgcatcgcctgctgactcgtcagagttgctcatggaggtgcacggaaatgggaagaggcccagtccagagaggagagaagagaatagttttgatagagacacaattgctcctgagcctcctgccaagagagtatgtaccatcagccctgctcctcggcacagtcctgctctcactgtgcccctcatgaatcccgggggccaattccatcctacccctccacctcttcagcattacaccttagaggatattgcaacttctcacctgtatcgggaacccaacaagatgctagagcatcgagaagttcgtgatagacaccacagtcttggtctaaatggaggctatcaagatgagttggtagatcatcgtttgacagaaagggaatgggctgatgaatggaaacatcttgaccatgcgctgaattgcattatggaaatggtagagaaaacaaggcgctctatggcagttctgcggcgctgtcaggaatcagatcgtgaagaactcaactactggaaaagacggtacaatgaaaacacagagctgaggaaaacggggaccgagttggtctccaggcagcacagccctgggagtgcagattctctcagcaatgattctcagagagagttcaacagcaggccaggtacaggatacgtacctgtggagttttggaaaaaaacagaagaagctgtgaataaggtgaaaattcaggccatgtcagaagtacagaaggccgtcgctgaggcagagcagaaagcctttgaagtgattgcaacagagagagcacgaatggagcaaaccatagcggatgtcaagcggcaggccgcagaggatgctttcctcgtcatcaatgagcaagaggagtccacggagaactgctggaactgtggccgcaaagccagcgagacatgcagtggctgcaatatcgcgcgatactgtggctctttctgccagcacaaggactgggagcggcaccaccgcctctgtggtcagaacctgcatggccagagcccccacggccagggccggccgctgcttcctgtaggcaggggctcctctgccaggtccgccgactgcagcgtgcccagcccagccctcgacaagacctcggcaaccacatcgcgttcctcaacacctgcttctgtgacagctatcgacaccaacggactctgagccccggactctgcttaccctgatggctgctcagcaccacagagtgcttgggctgagggactgactgttggaacccgtgcatgtagctgccgggtcatcagcaagaaatgaattggaggcaggaagagtccaagcctgaataataacaccccacagcctctctgtgcacttgctgtctgcggagccagtgtgccattctctgcacatgggcagccagcctgagctgcctcctccatggctttcctggtttgttcctctctccactgaagctgacttagccggccccttttcagtgtagaccaccagctcccctccccatctccttgagtcagcagactgtccaatgtgctcagccaggctggaggcggcaggcggcaggcagcaggctgtggaggaggcccctcggtcagggagcggcctgcctcacccctgaatagctccttcggccccatctccatcctcagcagatgacactgattggcctcacggggacttgggtaagcaacaggcggcattcaggactcttctcaaccctgctgttcagacttgataagatctcagagtccacaggaaagaagtcactgttgcaataaaagcacccgtagtagcaaaaacataaaacaaataaaacttcccccacatcacagatgattttggacaagattttccaaccttgctggctactttagtttgggacctgttttttttctcatttgattttgcttgtgcagaaaatagtttccagcacatggattgatctgagagagaatgaggctcagttgtggatagtctgttttctctgagcatgttggccaactagtatcgtcaaattattgagtggatcatctcttggaaatgcagaacttctgccaccacttggctatttgcacagtcatcttgttctgtgtccttttatctctcagaccacacacatctggaacgctgtgggcatcttctgcccatgggctccatttggcacctgctgagccacagttgtcctgctggatgtgctgtgcaggttggtaggacttgcccccactgtcaaggcctggtctcatctgaaaagccctcctggacctcaaagaattcttcagacctcatagttacaggtcattatatctactatgttgatttatcatcaggcacacaacttctgtttccttctcttgtgttatctgatagcgtccctccttgagctcatcagaaaggttttatgaaatgtgaaccattttgggaaaagctgatcaatttttcttcctagcttcccattttcaaatgggacatcactcatatccctttcagaatgttaggaactgcctcccacattcttccctgtctttttgggttttgttttttgttgttgttgtggttttttaacacaaagctcactctgttgcccaggctggagtgcagtggcatgatcttggctcactgcaacctctgccttccaggttcaagcaattctcctgcctcgagcctcccgagtagctgagattacaggcgcccaccaccacgcccagctagatttttgtattttttagtagagacagggtttcaccatgttggccaggctgatctcgaactcctgacctcaggtgacctgccttggcctcccaaagtgcagggattacaagcgtgagccaccatgcccggcctgtctttttggttttgatgggagtctgaggaccccgacccctcctgctctccatctttgagcctctggcatcctctcacacccagaaatcagttggagtaagtttaattggccctgctccagctggcctttgaagcacaagtttaaatctccaccttctgtgcactgaccagagtctaaaataaaagttgtcagtaccataaaggaaaagggatccacacaggtagccttctccttggatacaggtacatcttactgtaagaatttcaagtcctggctgggcgcagtggctcactcctgtaatcccagcactttgagagaccgaggcaggcagatcacttgaggtcaggaattcaagaccaacctggccaacatggtgaaaccctgtctctaataaaaaaaaaatagaaaaatcagccgggtgtggtggcacacacctgtaatcctagctactcaggaggctgaggcaagagaatctcttgaacctgtgagccagaggttgcagtgagccgagattccaccactgcactccagcctgggcaacagagcaaaactctgtctcaaaaaaaaaaaaaaaaaggcaaaattaaagaatttcaagtccctaatttactctaaccaagcattttcagtcttacaaagaaatctagtgcacgacacctttaaaatgcctagatttccattgcctaaagtaaggtgtgaccagtgaaacaacagcagagaatcatgttcctttgctgtggaacacataagccccacagttttccagtcagcctaatacatgggtatcccccgaccccatctgcctccttaagccacagtccttggtggggaactctaagggggacggagtcagtaccccggacagggccacatttgcatgagacatggctgtctcacaggtcacagagccattacaacagcttactagtttttcatggatttgttggattaacaccttaagcaggttttttattgttattttgtttgtttgtttgttttgagacgggagtttctctcttgtctcccaggctggagtgcaatcgcgcaatctcggctcacggtaacctctgcctcccaggttcgggcgagtctcctgcctcagccttctgagtagctgggattgcaggcatgcgccaccacgcccaactgattttgtatttttagtagagacggggtttctccttgttggtcaggctggtctcaaaccccggacctcaggtgatccccccaccttggcctcccaaagtgccaggattacaggcatgagccactgtgtccggtcttgagcaggtttttaaaatctccagtggccataaaactagccagggtagctcatgcttttactggttggaataaggagccaaaaccaacaaaataatatttattagggctcgatgcccatttctgtggctaaggcttaggtttggtgtgcagagcctggcctgctcttgtgggctgtggttgctgtgacagtttcgttttctgaatctttgtaatgctcttccaccctgctcgtgctgcccagaggctgatctgcaaacctgggcagtattccacactgaagctcagtttgcaaaccttctgctgtgttaattctggtcagtttcacacagaagtcacgagggcctctgcccaggaccttctattcacatttcaagaatccctttctgaaattctccaactctctggtcaggaggaggagcaccattggggcggggtaggcagctagaggcgcaggagcgaatccaggttccttgcgtggttcccagcctctgctgacagcacctcagctaccaggtggggagtggaaattcagcctgcttagaggactgacctctacagttcatatttgcagtgacataaaaggcaaagaggagctggcatggtggtacagaaggtatcagtcaagcgcaggctcttcagaaacctagaaactaaaaagagatgcaacatgtgactggccatcagccagacatgtctagggtgagaccagtgctcagcaccacccgccaaggaacactgatgagttgtgggacattatggtcggccaagtgaggaatgattgcagggaccagagaagaccaaagatgccagatgtccccagagtttcttgagggctgggtttcacgtctttgcttgtcctttttgtccccacttgcctgcaccgtgcctgactcatccagtggggaaggtgactcaagaagttgtttaagcctaggcctaggcagtccacttcgggaggtgggggcactccacactggggggccctgcagctccagggctggtgctctagcagatccgctcaggcacggttgggtgaccgtggggtcaccgattgcgtagattatttctagggcagtgctgggttagaaatgtctgtctggaaacaggacacatcttgccaccacaagtccacacctggccttggctgctgcccgctctctgcagcgtggatttcctttgcccatttgggccagaaggtcaccaggagttcatcactgcttagtgtcaacttgacatcttcagcttccagacagaaaacccatgctttactttgtacagccctgtcccagagttagtaagcctcggcttgtcacctgcttgcaaagggtatagacatcattctgggtagttctagaggatatcgcaacaagtgcgtttgaaggttcagcacagctggaattgtacggtagtgagctcttcaaaatgaaaacagaatgaccggatggccatctgtcctggaaactgtagaattgaataaatcactgaaaatagaacacttcttggaggctttcttcagaactgaactagaaacaaggtttccaggctcccaggtcagtagaccaaaccaacttccttagatttttttttttaagctgtttgcagaaaactgggtggtagcgtgtctgaaccaaacggaagaatagccagcggagcatggactgttccagcacgggccagatggccagctgtcgagagcagccctgcccagattgcggtgggggctgtgccagcggctccgcagggcccttccaactctggagtgtctgtagttcttgtgaaaccaaaacgttgactacctgcctctttcctcgggcatcgacgtgctcatttccaaagatgatggtgcaggtgaccttttccatcgtgagctaagagaaggttaggaggcctgaggggcgggccttgtgtcccctcctccccctccacagcccctgaggtggagcttccctcacagaccccatctggtcgagcctacggctgcccagtgtacactcagtgatgcttataccaaatagggcatgtgcgctggtgtctgttggggacagccccatccctaccttggagtcggcagagaagcagcaataagcattaggcgaatgattgaaagggctgctgcgccaagaggccttcagtccccttaacgtggctttccaacttcctgacgaggctacaaaggctccgctcacaaaagaaagccaataatgtaaataaatagaaaacgaagcctccacgcgtggtttttaaagggggatgatgaatgtgacaccacccacagaatgcattagaatctggtttttctgtgctttgtcattttactctgataggaatttttgttacctaactctgtgcataacttatttaatgtcttcgtatccattcaccctagctgttataaaagtatatgtttcgataccctttacgtagtccagcattcgcctttattcctt

SEQ ID NO: 456733 - DNA, 7430 bp, Homo sapiens
gggggaagggtagtggagagagaggaagcaggagggagggagaaaaagagagagactgactgtatctggggattctggcaaggtgaagagctggtctgtttggcaggaccttcccatctgggatccatctgtgtttccctggaatgggacaggcagctctagtcagtgagaaatcgcagatgtgagagagctgacacatgtccagctaatgaaaggaggaggaaggctggtctccgattgagctttgaagattaggaggagaaaaagaggagctttggaatatctatttcaaataaatttggtgtatttaagaatctggattgtttataatttgggcatttgggttggtcctgagaaaagggtgccagcgatgcctggatcgcctgtggaagtgaagatacagtccagatcctcacctcccaccatgccacccctcccaccaataaatcctggaggaccgaggccagtgtccttcactcctactgcattaagcaatggcatcaaccattctcctcctaccctgaatggtgccccatcaccgccacagagattcagcaatggtcctgcctcctccacatcatctgcactcacaaatcagcaattgccagccacttgtggtgctcgacaactcagcaagttgaaacgctttcttaccactctgcaacagtttggcaatgacatctcccctgagattggggagaaggtgcggactcttgttcttgcactggtgaactcaacagtgacaattgaggaattccactgtaagctccaagaagccacaaactttccccttcgtccttttgtgattccatttctcaaggccaacctgcccctgctgcagcgggaactgctgcactgcgctcgggcggccaagcagaccccatcccagtacctggctcagcacgaacaccttctgctcaacacaagcattgcatcgcctgctgactcgtcagagttgctcatggaggtgcacggaaatgggaagaggcccagtccagagaggagagaagagaatagttttgatagagacacaattgctcctgagcctcctgccaagagagtatgtaccatcagccctgctcctcggcacagtcctgctctcactgtgcccctcatgaatcccgggggccaattccatcctacccctccacctcttcagcattacaccttagaggatattgcaacttctcacctgtatcgggaacccaacaagatgctagagcatcgagaagttcgtgatagacaccacagtcttggtctaaatggaggctatcaagatgagttggtagatcatcgtttgacagaaagggaatgggctgatgaatggaaacatcttgaccatgcgctgaattgcattatggaaatggtagagaaaacaaggcgctctatggcagttctgcggcgctgtcaggaatcagatcgtgaagaactcaactactggaaaagacggtacaatgaaaacacagagctgaggaaaacggggaccgagttggtctccaggcagcacagccctgggagtgcagattctctcagcaatgattctcagagagagttcaacagcaggccaggtacaggatacgtacctgtggagttttggaaaaaaacagaagaagctgtgaataaggtgaaaattcaggccatgtcagaagtacagaaggccgtcgctgaggcagagcagaaagcctttgaagtgattgcaacagagagagcacgaatggagcaaaccatagcggatgtcaagcggcaggccgcagaggatgctttcctcgtcatcaatgagcaagaggagtccacggagaactgctggaactgtggccgcaaagccagcgagacatgcagtggctgcaatatcgcgcgatactgtggctctttctgccagcacaaggactgggagcggcaccaccgcctctgtggtcagaacctgcatggccagagcccccacggccagggccggccgctgcttcctgtaggcaggggctcctctgccaggtccgccgactgcagcgtgcccagcccagccctcgacaagacctcggcaaccacatcgcgttcctcaacacctgcttctgtgacagctatcgacaccaacggactctgagccccggactctgcttaccctgatggctgctcagcaccacagagtgcttgggctgagggactgactgttggaacccgtgcatgtagctgccgggtcatcagcaagaaatgaattggaggcaggaagagtccaagcctgaataataacaccccacagcctctctgtgcacttgctgtctgcggagccagtgtgccattctctgcacatgggcagccagcctgagctgcctcctccatggctttcctggtttgttcctctctccactgaagctgacttagccggccccttttcagtgtagaccaccagctcccctccccatctccttgagtcagcagactgtccaatgtgctcagccaggctggaggcggcaggcggcaggcagcaggctgtggaggaggcccctcggtcagggagcggcctgcctcacccctgaatagctccttcggccccatctccatcctcagcagatgacactgattggcctcacggggacttgggtaagcaacaggcggcattcaggactcttctcaaccctgctgttcagacttgataagatctcagagtccacaggaaagaagtcactgttgcaataaaagcacccgtagtagcaaaaacataaaacaaataaaacttcccccacatcacagatgattttggacaagattttccaaccttgctggctactttagtttgggacctgttttttttctcatttgattttgcttgtgcagaaaatagtttccagcacatggattgatctgagagagaatgaggctcagttgtggatagtctgttttctctgagcatgttggccaactagtatcgtcaaattattgagtggatcatctcttggaaatgcagaacttctgccaccacttggctatttgcacagtcatcttgttctgtgtccttttatctctcagaccacacacatctggaacgctgtgggcatcttctgcccatgggctccatttggcacctgctgagccacagttgtcctgctggatgtgctgtgcaggttggtaggacttgcccccactgtcaaggcctggtctcatctgaaaagccctcctggacctcaaagaattcttcagacctcatagttacaggtcattatatctactatgttgatttatcatcaggcacacaacttctgtttccttctcttgtgttatctgatagcgtccctccttgagctcatcagaaaggttttatgaaatgtgaaccattttgggaaaagctgatcaatttttcttcctagcttcccattttcaaatgggacatcactcatatccctttcagaatgttaggaactgcctcccacattcttccctgtctttttgggttttgttttttgttgttgttgtggttttttaacacaaagctcactctgttgcccaggctggagtgcagtggcatgatcttggctcactgcaacctctgccttccaggttcaagcaattctcctgcctcgagcctcccgagtagctgagattacaggcgcccaccaccacgcccagctagatttttgtattttttagtagagacagggtttcaccatgttggccaggctgatctcgaactcctgacctcaggtgacctgccttggcctcccaaagtgcagggattacaagcgtgagccaccatgcccggcctgtctttttggttttgatgggagtctgaggaccccgacccctcctgctctccatctttgagcctctggcatcctctcacacccagaaatcagttggagtaagtttaattggccctgctccagctggcctttgaagcacaagtttaaatctccaccttctgtgcactgaccagagtctaaaataaaagttgtcagtaccataaaggaaaagggatccacacaggtagccttctccttggatacaggtacatcttactgtaagaatttcaagtcctggctgggcgcagtggctcactcctgtaatcccagcactttgagagaccgaggcaggcagatcacttgaggtcaggaattcaagaccaacctggccaacatggtgaaaccctgtctctaataaaaaaaaaatagaaaaatcagccgggtgtggtggcacacacctgtaatcctagctactcaggaggctgaggcaagagaatctcttgaacctgtgagccagaggttgcagtgagccgagattccaccactgcactccagcctgggcaacagagcaaaactctgtctcaaaaaaaaaaaaaaaaaggcaaaattaaagaatttcaagtccctaatttactctaaccaagcattttcagtcttacaaagaaatctagtgcacgacacctttaaaatgcctagatttccattgcctaaagtaaggtgtgaccagtgaaacaacagcagagaatcatgttcctttgctgtggaacacataagccccacagttttccagtcagcctaatacatgggtatcccccgaccccatctgcctccttaagccacagtccttggtggggaactctaagggggacggagtcagtaccccggacagggccacatttgcatgagacatggctgtctcacaggtcacagagccattacaacagcttactagtttttcatggatttgttggattaacaccttaagcaggttttttattgttattttgtttgtttgtttgttttgagacgggagtttctctcttgtctcccaggctggagtgcaatcgcgcaatctcggctcacggtaacctctgcctcccaggttcgggcgagtctcctgcctcagccttctgagtagctgggattgcaggcatgcgccaccacgcccaactgattttgtatttttagtagagacggggtttctccttgttggtcaggctggtctcaaaccccggacctcaggtgatccccccaccttggcctcccaaagtgccaggattacaggcatgagccactgtgtccggtcttgagcaggtttttaaaatctccagtggccataaaactagccagggtagctcatgcttttactggttggaataaggagccaaaaccaacaaaataatatttattagggctcgatgcccatttctgtggctaaggcttaggtttggtgtgcagagcctggcctgctcttgtgggctgtggttgctgtgacagtttcgttttctgaatctttgtaatgctcttccaccctgctcgtgctgcccagaggctgatctgcaaacctgggcagtattccacactgaagctcagtttgcaaaccttctgctgtgttaattctggtcagtttcacacagaagtcacgagggcctctgcccaggaccttctattcacatttcaagaatccctttctgaaattctccaactctctggtcaggaggaggagcaccattggggcggggtaggcagctagaggcgcaggagcgaatccaggttccttgcgtggttcccagcctctgctgacagcacctcagctaccaggtggggagtggaaattcagcctgcttagaggactgacctctacagttcatatttgcagtgacataaaaggcaaagaggagctggcatggtggtacagaaggtatcagtcaagcgcaggctcttcagaaacctagaaactaaaaagagatgcaacatgtgactggccatcagccagacatgtctagggtgagaccagtgctcagcaccacccgccaaggaacactgatgagttgtgggacattatggtcggccaagtgaggaatgattgcagggaccagagaagaccaaagatgccagatgtccccagagtttcttgagggctgggtttcacgtctttgcttgtcctttttgtccccacttgcctgcaccgtgcctgactcatccagtggggaaggtgactcaagaagttgtttaagcctaggcctaggcagtccacttcgggaggtgggggcactccacactggggggccctgcagctccagggctggtgctctagcagatccgctcaggcacggttgggtgaccgtggggtcaccgattgcgtagattatttctagggcagtgctgggttagaaatgtctgtctggaaacaggacacatcttgccaccacaagtccacacctggccttggctgctgcccgctctctgcagcgtggatttcctttgcccatttgggccagaaggtcaccaggagttcatcactgcttagtgtcaacttgacatcttcagcttccagacagaaaacccatgctttactttgtacagccctgtcccagagttagtaagcctcggcttgtcacctgcttgcaaagggtatagacatcattctgggtagttctagaggatatcgcaacaagtgcgtttgaaggttcagcacagctggaattgtacggtagtgagctcttcaaaatgaaaacagaatgaccggatggccatctgtcctggaaactgtagaattgaataaatcactgaaaatagaacacttcttggaggctttcttcagaactgaactagaaacaaggtttccaggctcccaggtcagtagaccaaaccaacttccttagatttttttttttaagctgtttgcagaaaactgggtggtagcgtgtctgaaccaaacggaagaatagccagcggagcatggactgttccagcacgggccagatggccagctgtcgagagcagccctgcccagattgcggtgggggctgtgccagcggctccgcagggcccttccaactctggagtgtctgtagttcttgtgaaaccaaaacgttgactacctgcctctttcctcgggcatcgacgtgctcatttccaaagatgatggtgcaggtgaccttttccatcgtgagctaagagaaggttaggaggcctgaggggcgggccttgtgtcccctcctccccctccacagcccctgaggtggagcttccctcacagaccccatctggtcgagcctacggctgcccagtgtacactcagtgatgcttataccaaatagggcatgtgcgctggtgtctgttggggacagccccatccctaccttggagtcggcagagaagcagcaataagcattaggcgaatgattgaaagggctgctgcgccaagaggccttcagtccccttaacgtggctttccaacttcctgacgaggctacaaaggctccgctcacaaaagaaagccaataatgtaaataaatagccacagaatgcattagaatctggtttttctgtgctttgtcattttactctgataggaatttttgttacctaactctgtgcataacttatttaatgtactgtataaatgaaccaaaactgttaaatatgtatttagtttgttctacttaaagtagtcaataaaaaggctatattcct

SEQ ID NO: 456734 - DNA, 4391 bp, Homo sapiens
tgaggcaggtactattacacccccattttacaaatgagtgctatgagaaacagagaggttcagtgacttgccaaacgtcacacagctaggttaggtctacctggccaggtagacgtcattatatctactatgttgatttatcatcaggcacacaacttctgtttccttctcttgtgttatctgatagcgtccctccttgagctcatcagaaaggttttatgaaatgtgaaccattttgggaaaagctgatcaatttttcttcctagcttcccattttcaaatgggacatcactcatatccctttcagaatgttaggaactgcctcccacattcttccctgtctttttgggttttgttttttgttgttgttgtggttttttaacacaaagctcactctgttgcccaggctggagtgcagtggcatgatcttggctcactgcaacctctgccttccaggttcaagcaattctcctgcctcgagcctcccgagtagctgagattacaggcgcccaccaccacgcccagctagatttttgtattttttagtagagacagggtttcaccatgttggccaggctgatctcgaactcctgacctcaggtgacctgccttggcctcccaaagtgcagggattacaagcgtgagccaccatgcccggcctgtctttttggttttgatgggagtctgaggaccccgacccctcctgctctccatctttgagcctctggcatcctctcacacccagaaatcagttggagtaagtttaattggccctgctccagctggcctttgaagcacaagtttaaatctccaccttctgtgcactgaccagagtctaaaataaaagttgtcagtaccataaaggaaaagggatccacacaggtagccttctccttggatacaggtacatcttactgtaagaatttcaagtcctggctgggcgcagtggctcactcctgtaatcccagcactttgagagaccgaggcaggcagatcacttgaggtcaggaattcaagaccaacctggccaacatggtgaaaccctgtctctaataaaaaaaaaatagaaaaatcagccgggtgtggtggcacacacctgtaatcctagctactcaggaggctgaggcaagagaatctcttgaacctgtgagccagaggttgcagtgagccgagattccaccactgcactccagcctgggcaacagagcaaaactctgtctcaaaaaaaaaaaaaaaaaggcaaaattaaagaatttcaagtccctaatttactctaaccaagcattttcagtcttacaaagaaatctagtgcacgacacctttaaaatgcctagatttccattgcctaaagtaaggtgtgaccagtgaaacaacagcagagaatcatgttcctttgctgtggaacacataagccccacagttttccagtcagcctaatacatgggtatcccccgaccccatctgcctccttaagccacagtccttggtggggaactctaagggggacggagtcagtaccccggacagggccacatttgcatgagacatggctgtctcacaggtcacagagccattacaacagcttactagtttttcatggatttgttggattaacaccttaagcaggttttttattgttattttgtttgtttgtttgttttgagacgggagtttctctcttgtctcccaggctggagtgcaatcgcgcaatctcggctcacggtaacctctgcctcccaggttcgggcgagtctcctgcctcagccttctgagtagctgggattgcaggcatgcgccaccacgcccaactgattttgtatttttagtagagacggggtttctccttgttggtcaggctggtctcaaaccccggacctcaggtgatccccccaccttggcctcccaaagtgccaggattacaggcatgagccactgtgtccggtcttgagcaggtttttaaaatctccagtggccataaaactagccagggtagctcatgcttttactggttggaataaggagccaaaaccaacaaaataatatttattagggctcgatgcccatttctgtggctaaggcttaggtttggtgtgcagagcctggcctgctcttgtgggctgtggttgctgtgacagtttcgttttctgaatctttgtaatgctcttccaccctgctcgtgctgcccagaggctgatctgcaaacctgggcagtattccacactgaagctcagtttgcaaaccttctgctgtgttaattctggtcagtttcacacagaagtcacgagggcctctgcccaggaccttctattcacatttcaagaatccctttctgaaattctccaactctctggtcaggaggaggagcaccattggggcggggtaggcagctagaggcgcaggagcgaatccaggttccttgcgtggttcccagcctctgctgacagcacctcagctaccaggtggggagtggaaattcagcctgcttagaggactgacctctacagttcatatttgcagtgacataaaaggcaaagaggagctggcatggtggtacagaaggtatcagtcaagcgcaggctcttcagaaacctagaaactaaaaagagatgcaacatgtgactggccatcagccagacatgtctagggtgagaccagtgctcagcaccacccgccaaggaacactgatgagttgtgggacattatggtcggccaagtgaggaatgattgcagggaccagagaagaccaaagatgccagatgtccccagagtttcttgagggctgggtttcacgtctttgcttgtcctttttgtccccacttgcctgcaccgtgcctgactcatccagtggggaaggtgactcaagaagttgtttaagcctaggcctaggcagtccacttcgggaggtgggggcactccacactggggggccctgcagctccagggctggtgctctagcagatccgctcaggcacggttgggtgaccgtggggtcaccgattgcgtagattatttctagggcagtgctgggttagaaatgtctgtctggaaacaggacacatcttgccaccacaagtccacacctggccttggctgctgcccgctctctgcagcgtggatttcctttgcccatttgggccagaaggtcaccaggagttcatcactgcttagtgtcaacttgacatcttcagcttccagacagaaaacccatgctttactttgtacagccctgtcccagagttagtaagcctcggcttgtcacctgcttgcaaagggtatagacatcattctgggtagttctagaggatatcgcaacaagtgcgtttgaaggttcagcacagctggaattgtacggtagtgagctcttcaaaatgaaaacagaatgaccggatggccatctgtcctggaaactgtagaattgaataaatcactgaaaatagaacacttcttggaggctttcttcagaactgaactagaaacaaggtttccaggctcccaggtcagtagaccaaaccaacttccttagatttttttttttaagctgtttgcagaaaactgggtggtagcgtgtctgaaccaaacggaagaatagccagcggagcatggactgttccagcacgggccagatggccagctgtcgagagcagccctgcccagattgcggtgggggctgtgccagcggctccgcagggcccttccaactctggagtgtctgtagttcttgtgaaaccaaaacgttgactacctgcctctttcctcgggcatcgacgtgctcatttccaaagatgatggtgcaggtgaccttttccatcgtgagctaagagaaggttaggaggcctgaggggcgggccttgtgtcccctcctccccctccacagcccctgaggtggagcttccctcacagaccccatctggtcgagcctacggctgcccagtgtacactcagtgatgcttataccaaatagggcatgtgcgctggtgtctgttggggacagccccatccctaccttggagtcggcagagaagcagcaataagcattaggcgaatgattgaaagggctgctgcgccaagaggccttcagtccccttaacgtggctttccaacttcctgacgaggctacaaaggctccgctcacaaaagaaagccaataatgtaaataaatagaaaacgaagcctccacgcgtggtttttaaagggggatgatgaatgtgacaccacccacagaatgcattagaatctggtttttctgtgctttgtcattttactctgataggaatttttgttacctaactctgtgcataacttatttaatgtactgtataaatgaaccaaaactgttaaatatgtatttagtttgttctacttaaagtagtcaataaaaaggctatattcct

SEQ ID NO: 456735 - DNA, 3549 bp, Homo sapiens
agcatcggccagcttgagaaataaagggacagagtacaaaagagagaaattttaaagctgggcgtccaggggagacatcatatgtcgttggtcctgagaaaagggtgccagcgatgcctggatcgcctgtggaagtgaagatacagtccagatcctcacctcccaccatgccacccctcccaccaataaatcctggaggaccgaggccagtgtccttcactcctactgcattaagcaatggcatcaaccattctcctcctaccctgaatggtgccccatcaccgccacagagattcagcaatggtcctgcctcctccacatcatctgcactcacaaatcagcaattgccagcctgggcaacagagcaaaactctgtctcaaaaaaaaaaaaaaaaaggcaaaattaaagaatttcaagtccctaatttactctaaccaagcattttcagtcttacaaagaaatctagtgcacgacacctttaaaatgcctagatttccattgcctaaagtaaggtgtgaccagtgaaacaacagcagagaatcatgttcctttgctgtggaacacataagccccacagttttccagtcagcctaatacatgggtatcccccgaccccatctgcctccttaagccacagtccttggtggggaactctaagggggacggagtcagtaccccggacagggccacatttgcatgagacatggctgtctcacaggtcacagagccattacaacagcttactagtttttcatggatttgttggattaacaccttaagcaggttttttattgttattttgtttgtttgtttgttttgagacgggagtttctctcttgtctcccaggctggagtgcaatcgcgcaatctcggctcacggtaacctctgcctcccaggttcgggcgagtctcctgcctcagccttctgagtagctgggattgcaggcatgcgccaccacgcccaactgattttgtatttttagtagagacggggtttctccttgttggtcaggctggtctcaaaccccggacctcaggtgatccccccaccttggcctcccaaagtgccaggattacaggcatgagccactgtgtccggtcttgagcaggtttttaaaatctccagtggccataaaactagccagggtagctcatgcttttactggttggaataaggagccaaaaccaacaaaataatatttattagggctcgatgcccatttctgtggctaaggcttaggtttggtgtgcagagcctggcctgctcttgtgggctgtggttgctgtgacagtttcgttttctgaatctttgtaatgctcttccaccctgctcgtgctgcccagaggctgatctgcaaacctgggcagtattccacactgaagctcagtttgcaaaccttctgctgtgttaattctggtcagtttcacacagaagtcacgagggcctctgcccaggaccttctattcacatttcaagaatccctttctgaaattctccaactctctggtcaggaggaggagcaccattggggcggggtaggcagctagaggcgcaggagcgaatccaggttccttgcgtggttcccagcctctgctgacagcacctcagctaccaggtggggagtggaaattcagcctgcttagaggactgacctctacagttcatatttgcagtgacataaaaggcaaagaggagctggcatggtggtacagaaggtatcagtcaagcgcaggctcttcagaaacctagaaactaaaaagagatgcaacatgtgactggccatcagccagacatgtctagggtgagaccagtgctcagcaccacccgccaaggaacactgatgagttgtgggacattatggtcggccaagtgaggaatgattgcagggaccagagaagaccaaagatgccagatgtccccagagtttcttgagggctgggtttcacgtctttgcttgtcctttttgtccccacttgcctgcaccgtgcctgactcatccagtggggaaggtgactcaagaagttgtttaagcctaggcctaggcagtccacttcgggaggtgggggcactccacactggggggccctgcagctccagggctggtgctctagcagatccgctcaggcacggttgggtgaccgtggggtcaccgattgcgtagattatttctagggcagtgctgggttagaaatgtctgtctggaaacaggacacatcttgccaccacaagtccacacctggccttggctgctgcccgctctctgcagcgtggatttcctttgcccatttgggccagaaggtcaccaggagttcatcactgcttagtgtcaacttgacatcttcagcttccagacagaaaacccatgctttactttgtacagccctgtcccagagttagtaagcctcggcttgtcacctgcttgcaaagggtatagacatcattctgggtagttctagaggatatcgcaacaagtgcgtttgaaggttcagcacagctggaattgtacggtagtgagctcttcaaaatgaaaacagaatgaccggatggccatctgtcctggaaactgtagaattgaataaatcactgaaaatagaacacttcttggaggctttcttcagaactgaactagaaacaaggtttccaggctcccaggtcagtagaccaaaccaacttccttagatttttttttttaagctgtttgcagaaaactgggtggtagcgtgtctgaaccaaacggaagaatagccagcggagcatggactgttccagcacgggccagatggccagctgtcgagagcagccctgcccagattgcggtgggggctgtgccagcggctccgcagggcccttccaactctggagtgtctgtagttcttgtgaaaccaaaacgttgactacctgcctctttcctcgggcatcgacgtgctcatttccaaagatgatggtgcaggtgaccttttccatcgtgagctaagagaaggttaggaggcctgaggggcgggccttgtgtcccctcctccccctccacagcccctgaggtggagcttccctcacagaccccatctggtcgagcctacggctgcccagtgtacactcagtgatgcttataccaaatagggcatgtgcgctggtgtctgttggggacagccccatccctaccttggagtcggcagagaagcagcaataagcattaggcgaatgattgaaagggctgctgcgccaagaggccttcagtccccttaacgtggctttccaacttcctgacgaggctacaaaggctccgctcacaaaagaaagccaataatgtaaataaatagaaaacgaagcctccacgcgtggtttttaaagggggatgatgaatgtgacaccacccacagaatgcattagaatctggtttttctgtgctttgtcattttactctgataggaatttttgttacctaactctgtgcataacttatttaatgtactgtataaatgaaccaaaactgttaaatatgtatttagtttgttctacttaaagtagtcaataaaaaggctatattcct

SEQ ID NO: 456736 - DNA, 1654 bp, Homo sapiens
tatagggaatcaccgtgagacaggagcaggtggcagccagggaacagtctctcaacgcacgtatgcaggcattgtgccttgcctcaggatgctgctgtcagccatgtgaggcatggtccctcgacgaagttgtttaagcctaggcctaggcagtccacttcgggaggtgggggcactccacactggggggccctgcagctccagggctggtgctctagcagatccgctcaggcacggttgggtgaccgtggggtcaccgattgcgtagattatttctagggcagtgctgggttagaaatgtctgtctggaaacaggacacatcttgccaccacaagtccacacctggccttggctgctgcccgctctctgcagcgtggatttcctttgcccatttgggccagaaggtcaccaggagttcatcactgcttagtgtcaacttgacatcttcagcttccagacagaaaacccatgctttactttgtacagccctgtcccagagttagtaagcctcggcttgtcacctgcttgcaaagggtatagacatcattctgggtagttctagaggatatcgcaacaagtgcgtttgaaggttcagcacagctggaattgtacggtagtgagctcttcaaaatgaaaacagaatgaccggatggccatctgtcctggaaactgtagaattgaataaatcactgaaaatagaacacttcttggaggctttcttcagaactgaactagaaacaaggtttccaggctcccaggtcagtagaccaaaccaacttccttagatttttttttttaagctgtttgcagaaaactgggtggtagcgtgtctgaaccaaacggaagaatagccagcggagcatggactgttccagcacgggccagatggccagctgtcgagagcagccctgcccagattgcggtgggggctgtgccagcggctccgcagggcccttccaactctggagtgtctgtagttcttgtgaaaccaaaacgttgactacctgcctctttcctcgggcatcgacgtgctcatttccaaagatgatggtgcaggtgaccttttccatcgtgagctaagagaaggttaggaggcctgaggggcgggccttgtgtcccctcctccccctccacagcccctgaggtggagcttccctcacagaccccatctggtcgagcctacggctgcccagtgtacactcagtgatgcttataccaaatagggcatgtgcgctggtgtctgttggggacagccccatccctaccttggagtcggcagagaagcagcaataagcattaggcgaatgattgaaagggctgctgcgccaagaggccttcagtccccttaacgtggctttccaacttcctgacgaggctacaaaggctccgctcacaaaagaaagccaataatgtaaataaatagaaaacgaagcctccacgcgtggtttttaaagggggatgatgaatgtgacaccacccacagaatgcattagaatctggtttttctgtgctttgtcattttactctgataggaatttttgttacctaactctgtgcataacttatttaatgtactgtataaatgaaccaaaactgttaaatatgtatttagtttgttctacttaaagtagtcaataaaaaggctatattcct

SEQ ID NO: 456737 - DNA, 2620 bp, Homo sapiens
  misc_feature (1851)..(1851): n is a, c, g, or t
agattccctcagcatcttacctctcaacgttcttctctctgctctgacacatctttcccaaagctgcatttcagtttcctcaaggacaacactgatgtacagaaatccttgtccccctaagtttgattcaaatatatcttctctggccaggtaacacccataatcccagaatttggaaggcccaggccgacttgaggccaggagcttaagaccagcctggggaatgtagcatgactccttcctctacaaaaaaaaaaatttaaattagctgggcatggccaggcacggtggctcacgcctgtaatcccaccactttgggaggccaaggtgggcggatcacgaggtcaggagttcaaggttgcagtgagctataaatcatgctactgcactccagcctaagtgacagagctagaccctatctctgaaaaaaaaaatttttaagcaaatacgtcttctctgtgagtcagtagtgtcctgtacatgtgtacctccatcatactgtaatgaatagcttagttgcctcttttcccactagactatgagatctttgaggggaagaaacaaacaattatgctcttaatataaaataaggttttataaactagctgaaggaggaaggtgtttatccctctcatacaggactgccctatatccactatgtatgtaaacctgagtccatttctctggcctaactcactatttccctgtgtcacacaatccatcctttccccttgtctacccacaagtatacttaaaatcattcatgtagcccttccatacatttaatctatttgtgtttgcttttcaagacctgattgcttcccttgcagtagatataaaagagtgtcattctcttacacttagtttttattcctgattaccagaattacaggtttcttttgctgtattgtgcaaatgtcatatacttaaaacagatataacgttaactttaaaagaatttttttggtatgaaatgtgggaaagtgttcaaacattttcctttaatatgtttaaattggacataccccttttccctgaaggaaaatgtcttaatgtttaccgaataataaatatgatatatttggaaaatccaacataattgcacactcagaaataactgttattgtgattattctcccaggcattaaatatatgatataatatgcatgtgtgttatttttgtaagtggattcttagaaaatataatgttctgtttctggtttttcacttaacagtattgtaggtaccttctctgccttaatgcgtacaaatctgctctaccccctccctgcataagcattctgatacatgactcttgtaattttaatgtagctttctgttggtagatctatatattttcctttttttttttttttgttaggaaaatatattgtgatagcgtgggggtaagttgcatgttacatactatgtttttgaacacttacaaagtttctaaaagtaaattcctagaaatgttatagctctttctggggagcaagcagggattcagaataatccccatatttcattttgttcgtttgttttaatttgttatcatacagtgttatcggcaattgaaatacaaatattgtgtgaactttgaagaaaatatttttatttgttcattccccttagcagagttgctgagtctcattcctaatttgaggcctagacttttgggaaaacacagaggacgtccaccttttagagaacagtgataacttaccaatgggggtttgccggttgggagttattctggtatgcataatgcatacaggccacttgaaggtagaaggcaactattcttttttcttttgcttctggtggtttttgtttgtttgtttgtttgtntgtttgtttgaagatttgggggaagttatgccaggaggtagggggcagaacttggaaaaagaaatgaacttttgaaaaaatgtgacactgggttactgagtccaaaatgtcttagagttgacatcctaggccaagtcattatctctgtaacaggaaacattgtaagcttgattgcctgttcctgaagtgacttgcaatgaacccctcaatatcagggatcagagtgcctctcttcatgggtagtgagaaaggcagtgccctattctgcagcctaggctgctgggcaaaggggagaatttggtggtggtgaagggaatcaaggagggtttctgtcataagaaaccagtgtggtttacctttgccaggcgtctgagttcctgatgatgttcctgcagttatccttttccttatgatttaaaagtctttagcagctgagcacggtggctcacccctgtaatcccaacactttggaaggctgagggaggaagatagcttgagctcaggagttcaggaccagcctagacaacatagcgagactgcatctctactaaacatttaaaaaacaaaataaaaagaccgggcgcggtggctctcccttgtaatcccaccactttaggaggccgaggcgggtggatcacaaagtcaggagttcaccgtcaggagatcacaggaggtggaggttacagtgagccgagaccgcgccactgcgctctggcctgggcaacagagcaagactccatctcaaataaataaataaataaataacatt

SEQ ID NO: 456738 - DNA, 2552 bp, Homo sapiens
  misc_feature (1783)..(1783): n is a, c, g, or t
ggacggagtcagtaccccggacagggcccacatttgcgatgagacatggctgtctcacaggtcacagagccaattacaacagcttactagtttttcatggatttgttggattaacaccttaagcaggttttttattgttattttgtttgttttttttttttgagacggagtttctctcttgttgcccaggctggagtgcaatggcacggtctcggctcaccgcaacctctgcctcccatctacttgggaggctgaggcaggagaatcacttgaacccgggaggcagaagttgcagtgagccgagaaatcatgctactgcactccagcctaagtgacagagctagaccctatctctgaaaaaaaaaatttttaagcaaatacgtcttctctgtgagtcagtagtgtcctgtacatgtgtacctccatcatactgtaatgaatagcttagttgcctcttttcccactagactatgagatctttgaggggaagaaacaaacaattatgctcttaatataaaataaggttttataaactagctgaaggaggaaggtgtttatccctctcatacaggactgccctatatccactatgtatgtaaacctgagtccatttctctggcctaactcactatttccctgtgtcacacaatccatcctttccccttgtctacccacaagtatacttaaaatcattcatgtagcccttccatacatttaatctatttgtgtttgcttttcaagacctgattgcttcccttgcagtagatataaaagagtgtcattctcttacacttagtttttattcctgattaccagaattacaggtttcttttgctgtattgtgcaaatgtcatatacttaaaacagatataacgttaactttaaaagaatttttttggtatgaaatgtgggaaagtgttcaaacattttcctttaatatgtttaaattggacataccccttttccctgaaggaaaatgtcttaatgtttaccgaataataaatatgatatatttggaaaatccaacataattgcacactcagaaataactgttattgtgattattctcccaggcattaaatatatgatataatatgcatgtgtgttatttttgtaagtggattcttagaaaatataatgttctgtttctggtttttcacttaacagtattgtaggtaccttctctgccttaatgcgtacaaatctgctctaccccctccctgcataagcattctgatacatgactcttgtaattttaatgtagctttctgttggtagatctatatattttcctttttttttttttttgttaggaaaatatattgtgatagcgtgggggtaagttgcatgttacatactatgtttttgaacacttacaaagtttctaaaagtaaattcctagaaatgttatagctctttctggggagcaagcagggattcagaataatccccatatttcattttgttcgtttgttttaatttgttatcatacagtgttatcggcaattgaaatacaaatattgtgtgaactttgaagaaaatatttttatttgttcattccccttagcagagttgctgagtctcattcctaatttgaggcctagacttttgggaaaacacagaggacgtccaccttttagagaacagtgataacttaccaatgggggtttgccggttgggagttattctggtatgcataatgcatacaggccacttgaaggtagaaggcaactattcttttttcttttgcttctggtggtttttgtttgtttgtttgtttgtntgtttgtttgaagatttgggggaagttatgccaggaggtagggggcagaacttggaaaaagaaatgaacttttgaaaaaatgtgacactgggttactgagtccaaaatgtcttagagttgacatcctaggccaagtcattatctctgtaacaggaaacattgtaagcttgattgcctgttcctgaagtgacttgcaatgaacccctcaatatcagggatcagagtgcctctcttcatgggtagtgagaaaggcagtgccctattctgcagcctaggctgctgggcaaaggggagaatttggtggtggtgaagggaatcaaggagggtttctgtcataagaaaccagtgtggtttacctttgccaggcgtctgagttcctgatgatgttcctgcagttatccttttccttatgatttaaaagtctttagcagctgagcacggtggctcacccctgtaatcccaacactttggaaggctgagggaggaagatagcttgagctcaggagttcaggaccagcctagacaacatagcgagactgcatctctactaaacatttaaaaaacaaaataaaaagaccgggcgcggtggctctcccttgtaatcccaccactttaggaggccgaggcgggtggatcacaaagtcaggagttcaccgtcaggagatcacaggaggtggaggttacagtgagccgagaccgcgccactgcgctctggcctgggcaacagagcaagactccatctcaaataaataaataaataaataacatt

SEQ ID NO: 456739 - DNA, 1408 bp, Homo sapiens
gggggaagggtagtggagagagaggaagcaggagggagggagaaaaagagagagactgactgtatctggggattctggcaaggtgaagagctggtctgtttggcaggaccttcccatctgggatccatctgtgtttccctggaatgggacaggcagctctagtcagtgagaaatcgcagatgtgagagagctgacacatgtccagctaatgaaaggaggaggaaggctggtctccgattgagctttgaagattaggaggagaaaaagaggagctttggaatatctatttcaaataaatttggtgtatttaagaatctggattgtttataatttgggcatttgggttggtcctgagaaaagggtgccagcgatgcctggatcgcctgtggaagtgaagatacagtccagatcctcacctcccaccatgccacccctcccaccaataaatcctggaggaccgaggccagtgtccttcactcctactgcattaagcaatggcatcaaccattctcctcctaccctgaatggtgccccatcaccgccacagagattcagcaatggtcctgcctcctccacatcatctgcactcacaaatcagcaattgccagccacttgtggtgctcgacaactcagcaagttgaaacgctttcttaccactctgcaacagtttggcaatgacatctcccctgagattggggagaaggtgcggactcttgttcttgcactggtgaactcaacagtgacaattgaggaattccactgtaagctccaagaagccacaaactttccccttcgtccttttgtgattccatttctcaaggccaacctgcccctgctgcagcgggaactgctgcactgcgctcgggcggccaagcagaccccatcccagtacctggctcagcacgaacaccttctgctcaacacaagcattgcatcgcctgctgactcgtcagagttgctcatggaggtgcacggaaatgggaagaggcccagtccagagaggagagaagagaatagttttgatagagacacaattgctcctgagcctcctgccaagagagtatgtaccatcagccctgctcctcggcacagtcctgctctcactgtgcccctcatgaatcccgggggccaattccatcctacccctccacctcttcagcattacaccttagaggatattgcaacttctcacctgtatcgggaacccaacaagatgctagagcatcgagaagttcgtgatagacaccacagtcttggtctaaatggaggctatcaagatgagttggtagatcatcgtttgacagaaagggaatgggctgatgaatggaaacatcttgaccatgcctgatcatatgaatgtaagaacagcgcttatgcattcgccttcagacagatctagaggagcgcg

SEQ ID NO: 456740 - DNA, 2488 bp, Homo sapiens
  misc_feature (1851)..(1851): n is a, c, g, or t
agattccctcagcatcttacctctcaacgttcttctctctgctctgacacatctttcccaaagctgcatttcagtttcctcaaggacaacactgatgtacagaaatccttgtccccctaagtttgattcaaatatatcttctctggccaggtaacacccataatcccagaatttggaaggcccaggccgacttgaggccaggagcttaagaccagcctggggaatgtagcatgactccttcctctacaaaaaaaaaaatttaaattagctgggcatggccaggcacggtggctcacgcctgtaatcccaccactttgggaggccaaggtgggcggatcacgaggtcaggagttcaaggttgcagtgagctataaatcatgctactgcactccagcctaagtgacagagctagaccctatctctgaaaaaaaaaatttttaagcaaatacgtcttctctgtgagtcagtagtgtcctgtacatgtgtacctccatcatactgtaatgaatagcttagttgcctcttttcccactagactatgagatctttgaggggaagaaacaaacaattatgctcttaatataaaataaggttttataaactagctgaaggaggaaggtgtttatccctctcatacaggactgccctatatccactatgtatgtaaacctgagtccatttctctggcctaactcactatttccctgtgtcacacaatccatcctttccccttgtctacccacaagtatacttaaaatcattcatgtagcccttccatacatttaatctatttgtgtttgcttttcaagacctgattgcttcccttgcagtagatataaaagagtgtcattctcttacacttagtttttattcctgattaccagaattacaggtttcttttgctgtattgtgcaaatgtcatatacttaaaacagatataacgttaactttaaaagaatttttttggtatgaaatgtgggaaagtgttcaaacattttcctttaatatgtttaaattggacataccccttttccctgaaggaaaatgtcttaatgtttaccgaataataaatatgatatatttggaaaatccaacataattgcacactcagaaataactgttattgtgattattctcccaggcattaaatatatgatataatatgcatgtgtgttatttttgtaagtggattcttagaaaatataatgttctgtttctggtttttcacttaacagtattgtaggtaccttctctgccttaatgcgtacaaatctgctctaccccctccctgcataagcattctgatacatgactcttgtaattttaatgtagctttctgttggtagatctatatattttcctttttttttttttttgttaggaaaatatattgtgatagcgtgggggtaagttgcatgttacatactatgtttttgaacacttacaaagtttctaaaagtaaattcctagaaatgttatagctctttctggggagcaagcagggattcagaataatccccatatttcattttgttcgtttgttttaatttgttatcatacagtgttatcggcaattgaaatacaaatattgtgtgaactttgaagaaaatatttttatttgttcattccccttagcagagttgctgagtctcattcctaatttgaggcctagacttttgggaaaacacagaggacgtccaccttttagagaacagtgataacttaccaatgggggtttgccggttgggagttattctggtatgcataatgcatacaggccacttgaaggtagaaggcaactattcttttttcttttgcttctggtggtttttgtttgtttgtttgtttgtntgtttgtttgaagatttgggggaagttatgccaggaggtagggggcagaacttggaaaaagaaatgaacttttgaaaaaatgtgacactgggttactgagtccaaaatgtcttagagttgacatcctaggccaagtcattatctctgtaacaggaaacattgtaagcttgattgcctgttcctgaagtgacttgcaatgaacccctcaatatcagggatcagagtgcctctcttcatgggtagtgagaaaggcagtgccctattctgcagcctaggctgctgggcaaaggggagaatttggtggtggtgaagggaatcaaggagggtttctgtcataagaaaccagtgtggtttacctttgccaggcgtctgagttcctgatgatgttcctgcagttatccttttccttatgatttaaaagtctttagcaccaccgcactcagcctacttaatgctaccaataattaatggaacatgtatgcttgaagtgaacataaccacagccatgacatcctttgcttttaataaaagctggtttagctactactccctcagctgaggaattacagagtcactccctaatctttgtgatgggatgatcacttcaggtcagaaaccaaataaagtcatgtagtat

SEQ ID NO: 456741 - DNA, 875 bp, Homo sapiens
gggggaagggtagtggagagagaggaagcaggagggagggagaaaaagagagagactgactgtatctggggattctggcaaggtgaagagctggtctgtttggcaggaccttcccatctgggatccatctgtgtttccctggaatgggacaggcagctctagtcagtgagaaatcgcagatgtgagagagctgacacatgtccagctaatgaaaggaggaggaaggctggtctccgattgagctttgaagattaggaggagaaaaagaggagctttggaatatctatttcaaataaatttggtgtatttaagaatctggattgtttataatttgggcatttgggaggtggggttttgccatgttgcccaggtgggtctcaaactcctgggctaaagcgatcttcccatgttggctgcccaaagtgctgggattacaggcaagagccaccataccagttcctgtctagatattatgatgaagattgaggatggtagtttttgtggagcacaatcctgactgtacctgtgatgttgcattcatcttttggaacataagcagatcaccaggtgaatggctaaagaatctggaataagcttgaaagaaatacaggtcctggcaaggcaatggaaaggtatgtgtgaaacattcatttctaatagaggactaatttaataacagaaatatactcttccctagaaacaatttgctttaaagtgctaggattacaggcttgagccaccacacccggccctattattattattattttgacacagggtcttaactcttcacccaggctggagtgcagtggtgccatcatggctcactcagcctagacttcatggctcagtagttgtcccacctcagcctcccg

SEQ ID NO: 456742 - DNA, 806 bp, Homo sapiens
cggggcggggcgcggcctaacggcggcggcggcggcggcgacggcgacagcagcggtggtggtgtctggttagctcggcggctgcagatctcgcggcgacgcctgcgagggacccgggccgcgggtcgaggcgggcggcgcctgcgagggacccgtgtcgcgggtagaggcgggcggcgcgcggcggcggcgctcggcgatggtaggcgtccctggagcggccgccttccagcgtaagtggggcgtgaatgcgggcggccgaggggggcgtgtgagggcctgcggctccgcaggcgcggtgattccgagtgccccgggcgcgaggccgggagtggaaactgaggcccgaagcggggcggcggatccaaggtcacgcagcggggcgggccttcccgggctcctgaggccaccccgtcgcttcctgcgccgcccgaagagctcggggctcacggtgtgagggaaattgtggggcccgcggcctcggaacttaggccgggccggcgtccatgggacttgccggcgggcaagaatcattttgttgtcccagcgctggggccacgaagtccggctcctggggaaatactacacccgcccgatgttgagggttggaggagatgagaatggcccctcggagggcctgtttgagcgcaggctcagtagttggctacctgggttcacatccaggcttccccatttaggtagtgaccttggctctcccggtgcctcagttcccccatctgcaaaatggggatgtggagcgggttccctccctcccccagggttcttgggttttgtgaggccagtaa

SEQ ID NO: 456743 - DNA, 287 bp, Homo sapiens
ttggtcctgagaaaagggtgccagcgatgcctggatcgcctgtggaagtgaagatacagtccagatcctcacctcccaccatgccacccctcccaccaataaatcctggaggaccgaggccagtgtccttcactcctactgcatgtgagacctcttagttacttatgtttgtagttcagagtgacatttggatctaagtgactgacttgtatgaagcgttccacatatattattcagtgttttcaaagtactattgaaaatatagacacagatatatatttctggtt

SEQ ID NO: 456744 - DNA, 652 bp, Homo sapiens
ccacgcgtccgatgagcacgtcgatgcccgaggaaagaggcaggtagtcaacgttttggtttcacaagaactacagacactccagagttggaagggccctgggcgggccttgtgtcccctcctccccctccacagcccctgaggtggagcttccctcacagaccccatctggtcgagcctacggctgcccagtgtacactcagtgatgcttataccaaatagggcatgtgcgctggtgtctgttggggacagccccatccctaccttggagtcggcagagaagcagcaataagcattaggcgaatgattgaaagggctgctgcgccaagaggccttcagtccccttaacgtggctttccaacttcctgacgaggctacaaaggctccgctcacaaaagaaagccaataatgtaaataaatagaaaacgaagcctccacgcgtggtttttaaagggggatgatgaatgtgacaccacccacagaatgcattagaatctggtttttctgtgctttgtcattttactctgataggaatttttgttacctaactctgtgcataacttatttaatgtactgtataaatgaaccaaaactgttaaatatgtatttagtttgttctacttaaagtagtcaataaaaaggctatattcct

SEQ ID NO: 456745 - DNA, 1469 bp, Homo sapiens
gggggaagggtagtggagagagaggaagcaggagggagggagaaaaagagagagactgactgtatctggggattctggcaaggtgaagagctggtctgtttggcaggaccttcccatctgggatccatctgtgtttccctggaatgggacaggcagctctagtcagtgagaaatcgcagatgtgagagagctgacacatgtccagctaatgaaaggaggaggaaggctggtctccgattgagctttgaagattaggaggagaaaaagaggagctttggaatatctatttcaaataaatttggtgtatttaagaatctggattgtttataatttgggcatttgggttggtcctgagaaaagggtgccagcgatgcctggatcgcctgtggaagtgaagatacagtccagatcctcacctcccaccatgccacccctcccaccaataaatcctggaggaccgaggccagtgtccttcactcctactgcattaagcaatggcatcaaccattctcctcctaccctgaatggtgccccatcaccgccacagagattcagcaatggtcctgcctcctccacatcatctgcactcacaaatcagcaattgccagccacttgtggtgctcgacaactcagcaagttgaaacgctttcttaccactctgcaacagtttggcaatgacatctcccctgagattggggagaaggtgcggactcttgttcttgcactggtgaactcaacagtgacaattgaggaattccactgtaagctccaagaagccacaaactttccccttcgtccttttgtgattccatttctcaaggccaacctgcccctgctgcagcgggaactgctgcactgcgctcgggcggccaagcagaccccatcccagtacctggctcagcacgaacaccttctgctcaacacaagcattgcatcgcctgctgactcgtcagagttgctcatggaggtgcacggaaatgggaagaggcccagtccagagagctgcataatacatctaaaatctatgggagtagcttccagacatgagtatttttcgggaactcttcagatgcctgcacacccggtaagaaactctactctagagaatttatgggtcgactgttccagaagcctcaggagtacagttctgccttttccttgatgctgtttgtagaaagaattggaaaaaaaaaaaaaagaaaagaaaagaaaaaacaaaaaaaaagaaatacaatctgccaaatgccttttatgtcaaacgcatttttttctgatctgagaagttttgaaaaagtatagcaattaattattaatatttgccaatgactcacctttactgagattaaaattaatatgaatttattttagaaaactccctatgagtggctatcaaaatattctatgggttatcaaagaaggcaatatcaacaatagtggataggctttaatgacatttttttaaaagtaaa

SEQ ID NO: 456746 - DNA, 7373 bp, Homo sapiens
cggggcggggcgcggcctaacggcggcggcggcggcggcgacggcgacagcagcggtggtggtgtctggttagctcggcggctgcagatctcgcggcgacgcctgcgagggacccgggccgcgggtcgaggcgggcggcgcctgcgagggacccgtgtcgcgggtagaggcgggcggcgcgcggcggcggcgctcggcgatggtaggcgtccctggagcggccgccttccagcttggtcctgagaaaagggtgccagcgatgcctggatcgcctgtggaagtgaagatacagtccagatcctcacctcccaccatgccacccctcccaccaataaatcctggaggaccgaggccagtgtccttcactcctactgcattaagcaatggcatcaaccattctcctcctaccctgaatggtgccccatcaccgccacagagattcagcaatggtcctgcctcctccacatcatctgcactcacaaatcagcaattgccagccacttgtggtgctcgacaactcagcaagttgaaacgctttcttaccactctgcaacagtttggcaatgacatctcccctgagattggggagaaggtgcggactcttgttcttgcactggtgaactcaacagtgacaattgaggaattccactgtaagctccaagaagccacaaactttccccttcgtccttttgtgattccatttctcaaggccaacctgcccctgctgcagcgggaactgctgcactgcgctcgggcggccaagcagaccccatcccagtacctggctcagcacgaacaccttctgctcaacacaagcattgcatcgcctgctgactcgtcagagttgctcatggaggtgcacggaaatgggaagaggcccagtccagagaggagagaagagaatagttttgatagagacacaattgctcctgagcctcctgccaagagagtatgtaccatcagccctgctcctcggcacagtcctgctctcactgtgcccctcatgaatcccgggggccaattccatcctacccctccacctcttcagcattacaccttagaggatattgcaacttctcacctgtatcgggaacccaacaagatgctagagcatcgagaagttcgtgatagacaccacagtcttggtctaaatggaggctatcaagatgagttggtagatcatcgtttgacagaaagggaatgggctgatgaatggaaacatcttgaccatgcgctgaattgcattatggaaatggtagagaaaacaaggcgctctatggcagttctgcggcgctgtcaggaatcagatcgtgaagaactcaactactggaaaagacggtacaatgaaaacacagagctgaggaaaacggggaccgagttggtctccaggcagcacagccctgggagtgcagattctctcagcaatgattctcagagagagttcaacagcaggccaggtacaggatacgtacctgtggagttttggaaaaaaacagaagaagctgtgaataaggtgaaaattcaggccatgtcagaagtacagaaggccgtcgctgaggcagagcagaaagcctttgaagtgattgcaacagagagagcacgaatggagcaaaccatagcggatgtcaagcggcaggccgcagaggatgctttcctcgtcatcaatgagcaagaggagtccacggagaactgctggaactgtggccgcaaagccagcgagacatgcagtggctgcaatatcgcgcgatactgtggctctttctgccagcacaaggactgggagcggcaccaccgcctctgtggtcagaacctgcatggccagagcccccacggccagggccggccgctgcttcctgtaggcaggggctcctctgccaggtccgccgactgcagcgtgcccagcccagccctcgacaagacctcggcaaccacatcgcgttcctcaacacctgcttctgtgacagctatcgacaccaacggactctgagccccggactctgcttaccctgatggctgctcagcaccacagagtgcttgggctgagggactgactgttggaacccgtgcatgtagctgccgggtcatcagcaagaaatgaattggaggcaggaagagtccaagcctgaataataacaccccacagcctctctgtgcacttgctgtctgcggagccagtgtgccattctctgcacatgggcagccagcctgagctgcctcctccatggctttcctggtttgttcctctctccactgaagctgacttagccggccccttttcagtgtagaccaccagctcccctccccatctccttgagtcagcagactgtccaatgtgctcagccaggctggaggcggcaggcggcaggcagcaggctgtggaggaggcccctcggtcagggagcggcctgcctcacccctgaatagctccttcggccccatctccatcctcagcagatgacactgattggcctcacggggacttgggtaagcaacaggcggcattcaggactcttctcaaccctgctgttcagacttgataagatctcagagtccacaggaaagaagtcactgttgcaataaaagcacccgtagtagcaaaaacataaaacaaataaaacttcccccacatcacagatgattttggacaagattttccaaccttgctggctactttagtttgggacctgttttttttctcatttgattttgcttgtgcagaaaatagtttccagcacatggattgatctgagagagaatgaggctcagttgtggatagtctgttttctctgagcatgttggccaactagtatcgtcaaattattgagtggatcatctcttggaaatgcagaacttctgccaccacttggctatttgcacagtcatcttgttctgtgtccttttatctctcagaccacacacatctggaacgctgtgggcatcttctgcccatgggctccatttggcacctgctgagccacagttgtcctgctggatgtgctgtgcaggttggtaggacttgcccccactgtcaaggcctggtctcatctgaaaagccctcctggacctcaaagaattcttcagacctcatagttacaggtcattatatctactatgttgatttatcatcaggcacacaacttctgtttccttctcttgtgttatctgatagcgtccctccttgagctcatcagaaaggttttatgaaatgtgaaccattttgggaaaagctgatcaatttttcttcctagcttcccattttcaaatgggacatcactcatatccctttcagaatgttaggaactgcctcccacattcttccctgtctttttgggttttgttttttgttgttgttgtggttttttaacacaaagctcactctgttgcccaggctggagtgcagtggcatgatcttggctcactgcaacctctgccttccaggttcaagcaattctcctgcctcgagcctcccgagtagctgagattacaggcgcccaccaccacgcccagctagatttttgtattttttagtagagacagggtttcaccatgttggccaggctgatctcgaactcctgacctcaggtgacctgccttggcctcccaaagtgcagggattacaagcgtgagccaccatgcccggcctgtctttttggttttgatgggagtctgaggaccccgacccctcctgctctccatctttgagcctctggcatcctctcacacccagaaatcagttggagtaagtttaattggccctgctccagctggcctttgaagcacaagtttaaatctccaccttctgtgcactgaccagagtctaaaataaaagttgtcagtaccataaaggaaaagggatccacacaggtagccttctccttggatacaggtacatcttactgtaagaatttcaagtcctggctgggcgcagtggctcactcctgtaatcccagcactttgagagaccgaggcaggcagatcacttgaggtcaggaattcaagaccaacctggccaacatggtgaaaccctgtctctaataaaaaaaaaatagaaaaatcagccgggtgtggtggcacacacctgtaatcctagctactcaggaggctgaggcaagagaatctcttgaacctgtgagccagaggttgcagtgagccgagattccaccactgcactccagcctgggcaacagagcaaaactctgtctcaaaaaaaaaaaaaaaaaggcaaaattaaagaatttcaagtccctaatttactctaaccaagcattttcagtcttacaaagaaatctagtgcacgacacctttaaaatgcctagatttccattgcctaaagtaaggtgtgaccagtgaaacaacagcagagaatcatgttcctttgctgtggaacacataagccccacagttttccagtcagcctaatacatgggtatcccccgaccccatctgcctccttaagccacagtccttggtggggaactctaagggggacggagtcagtaccccggacagggccacatttgcatgagacatggctgtctcacaggtcacagagccattacaacagcttactagtttttcatggatttgttggattaacaccttaagcaggttttttattgttattttgtttgtttgtttgttttgagacgggagtttctctcttgtctcccaggctggagtgcaatcgcgcaatctcggctcacggtaacctctgcctcccaggttcgggcgagtctcctgcctcagccttctgagtagctgggattgcaggcatgcgccaccacgcccaactgattttgtatttttagtagagacggggtttctccttgttggtcaggctggtctcaaaccccggacctcaggtgatccccccaccttggcctcccaaagtgccaggattacaggcatgagccactgtgtccggtcttgagcaggtttttaaaatctccagtggccataaaactagccagggtagctcatgcttttactggttggaataaggagccaaaaccaacaaaataatatttattagggctcgatgcccatttctgtggctaaggcttaggtttggtgtgcagagcctggcctgctcttgtgggctgtggttgctgtgacagtttcgttttctgaatctttgtaatgctcttccaccctgctcgtgctgcccagaggctgatctgcaaacctgggcagtattccacactgaagctcagtttgcaaaccttctgctgtgttaattctggtcagtttcacacagaagtcacgagggcctctgcccaggaccttctattcacatttcaagaatccctttctgaaattctccaactctctggtcaggaggaggagcaccattggggcggggtaggcagctagaggcgcaggagcgaatccaggttccttgcgtggttcccagcctctgctgacagcacctcagctaccaggtggggagtggaaattcagcctgcttagaggactgacctctacagttcatatttgcagtgacataaaaggcaaagaggagctggcatggtggtacagaaggtatcagtcaagcgcaggctcttcagaaacctagaaactaaaaagagatgcaacatgtgactggccatcagccagacatgtctagggtgagaccagtgctcagcaccacccgccaaggaacactgatgagttgtgggacattatggtcggccaagtgaggaatgattgcagggaccagagaagaccaaagatgccagatgtccccagagtttcttgagggctgggtttcacgtctttgcttgtcctttttgtccccacttgcctgcaccgtgcctgactcatccagtggggaaggtgactcaagaagttgtttaagcctaggcctaggcagtccacttcgggaggtgggggcactccacactggggggccctgcagctccagggctggtgctctagcagatccgctcaggcacggttgggtgaccgtggggtcaccgattgcgtagattatttctagggcagtgctgggttagaaatgtctgtctggaaacaggacacatcttgccaccacaagtccacacctggccttggctgctgcccgctctctgcagcgtggatttcctttgcccatttgggccagaaggtcaccaggagttcatcactgcttagtgtcaacttgacatcttcagcttccagacagaaaacccatgctttactttgtacagccctgtcccagagttagtaagcctcggcttgtcacctgcttgcaaagggtatagacatcattctgggtagttctagaggatatcgcaacaagtgcgtttgaaggttcagcacagctggaattgtacggtagtgagctcttcaaaatgaaaacagaatgaccggatggccatctgtcctggaaactgtagaattgaataaatcactgaaaatagaacacttcttggaggctttcttcagaactgaactagaaacaaggtttccaggctcccaggtcagtagaccaaaccaacttccttagatttttttttttaagctgtttgcagaaaactgggtggtagcgtgtctgaaccaaacggaagaatagccagcggagcatggactgttccagcacgggccagatggccagctgtcgagagcagccctgcccagattgcggtgggggctgtgccagcggctccgcagggcccttccaactctggagtgtctgtagttcttgtgaaaccaaaacgttgactacctgcctctttcctcgggcatcgacgtgctcatttccaaagatgatggtgcaggtgaccttttccatcgtgagctaagagaaggttaggaggcctgaggggcgggccttgtgtcccctcctccccctccacagcccctgaggtggagcttccctcacagaccccatctggtcgagcctacggctgcccagtgtacactcagtgatgcttataccaaatagggcatgtgcgctggtgtctgttggggacagccccatccctaccttggagtcggcagagaagcagcaataagcattaggcgaatgattgaaagggctgctgcgccaagaggccttcagtccccttaacgtggctttccaacttcctgacgaggctacaaaggctccgctcacaaaagaaagccaataatgtaaataaatagaaaacgaagcctccacgcgtggtttttaaagggggatgatgaatgtgacaccacccacagaatgcattagaatctggtttttctgtgctttgtcattttactctgataggaatttttgttacctaactctgtgcataacttatttaatgtactgtataaatgaaccaaaactgttaaatatgtatttagtttgttctacttaaagtagtcaataaaaaggctatattcct

SEQ ID NO: 456747 - DNA, 7230 bp, Homo sapiens
gggggaagggtagtggagagagaggaagcaggagggagggagaaaaagagagagactgactgtatctggggattctggcaaggtgaagagctggtctgtttggcaggaccttcccatctgggatccatctgtgtttccctggaatgggacaggcagctctagtcagtgagaaatcgcagatgtgagagagctgacacatgtccagctaatgaaaggaggaggaaggctggtctccgattgagctttgaagattaggaggagaaaaagaggagctttggaatatctatttcaaataaatttggtgtatttaagaatctggattgtttataatttgggcatttgggttggtcctgagaaaagggtgccagcgatgcctggatcgcctgtggaagtgaagatacagtccagatcctcacctcccaccatgccacccctcccaccaataaatcctggaggaccgaggccagtgtccttcactcctactgcattaagcaatggcatcaaccattctcctcctaccctgaatggtgccccatcaccgccacagagattcagcaatggtcctgcctcctccacatcatctgcactcacaaatcagcaattgccagccacttgtggtgctcgacaactcagcaagttgaaacgctttcttaccactctgcaacagtttggcaatgacatctcccctgagattggggagaaggtgcggactcttgttcttgcactggtgaactcaacagtgacaattgaggaattccactgtaagctccaagaagccacaaactttccccttcgtccttttgtgattccatttctcaaggccaacctgcccctgctgcagcgggaactgctgcactgcgctcgggcggccaagcagaccccatcccagtacctggctcagcacgaacaccttctgctcaacacaagcattgcatcgcctgctgactcgtcagagttgctcatggaggtgcacggaaatgggaagaggcccagtccagagaggtctaaatggaggctatcaagatgagttggtagatcatcgtttgacagaaagggaatgggctgatgaatggaaacatcttgaccatgcgctgaattgcattatggaaatggtagagaaaacaaggcgctctatggcagttctgcggcgctgtcaggaatcagatcgtgaagaactcaactactggaaaagacggtacaatgaaaacacagagctgaggaaaacggggaccgagttggtctccaggcagcacagccctgggagtgcagattctctcagcaatgattctcagagagagttcaacagcaggccaggtacaggatacgtacctgtggagttttggaaaaaaacagaagaagctgtgaataaggtgaaaattcaggccatgtcagaagtacagaaggccgtcgctgaggcagagcagaaagcctttgaagtgattgcaacagagagagcacgaatggagcaaaccatagcggatgtcaagcggcaggccgcagaggatgctttcctcgtcatcaatgagcaagaggagtccacggagaactgctggaactgtggccgcaaagccagcgagacatgcagtggctgcaatatcgcgcgatactgtggctctttctgccagcacaaggactgggagcggcaccaccgcctctgtggtcagaacctgcatggccagagcccccacggccagggccggccgctgcttcctgtaggcaggggctcctctgccaggtccgccgactgcagcgtgcccagcccagccctcgacaagacctcggcaaccacatcgcgttcctcaacacctgcttctgtgacagctatcgacaccaacggactctgagccccggactctgcttaccctgatggctgctcagcaccacagagtgcttgggctgagggactgactgttggaacccgtgcatgtagctgccgggtcatcagcaagaaatgaattggaggcaggaagagtccaagcctgaataataacaccccacagcctctctgtgcacttgctgtctgcggagccagtgtgccattctctgcacatgggcagccagcctgagctgcctcctccatggctttcctggtttgttcctctctccactgaagctgacttagccggccccttttcagtgtagaccaccagctcccctccccatctccttgagtcagcagactgtccaatgtgctcagccaggctggaggcggcaggcggcaggcagcaggctgtggaggaggcccctcggtcagggagcggcctgcctcacccctgaatagctccttcggccccatctccatcctcagcagatgacactgattggcctcacggggacttgggtaagcaacaggcggcattcaggactcttctcaaccctgctgttcagacttgataagatctcagagtccacaggaaagaagtcactgttgcaataaaagcacccgtagtagcaaaaacataaaacaaataaaacttcccccacatcacagatgattttggacaagattttccaaccttgctggctactttagtttgggacctgttttttttctcatttgattttgcttgtgcagaaaatagtttccagcacatggattgatctgagagagaatgaggctcagttgtggatagtctgttttctctgagcatgttggccaactagtatcgtcaaattattgagtggatcatctcttggaaatgcagaacttctgccaccacttggctatttgcacagtcatcttgttctgtgtccttttatctctcagaccacacacatctggaacgctgtgggcatcttctgcccatgggctccatttggcacctgctgagccacagttgtcctgctggatgtgctgtgcaggttggtaggacttgcccccactgtcaaggcctggtctcatctgaaaagccctcctggacctcaaagaattcttcagacctcatagttacaggtcattatatctactatgttgatttatcatcaggcacacaacttctgtttccttctcttgtgttatctgatagcgtccctccttgagctcatcagaaaggttttatgaaatgtgaaccattttgggaaaagctgatcaatttttcttcctagcttcccattttcaaatgggacatcactcatatccctttcagaatgttaggaactgcctcccacattcttccctgtctttttgggttttgttttttgttgttgttgtggttttttaacacaaagctcactctgttgcccaggctggagtgcagtggcatgatcttggctcactgcaacctctgccttccaggttcaagcaattctcctgcctcgagcctcccgagtagctgagattacaggcgcccaccaccacgcccagctagatttttgtattttttagtagagacagggtttcaccatgttggccaggctgatctcgaactcctgacctcaggtgacctgccttggcctcccaaagtgcagggattacaagcgtgagccaccatgcccggcctgtctttttggttttgatgggagtctgaggaccccgacccctcctgctctccatctttgagcctctggcatcctctcacacccagaaatcagttggagtaagtttaattggccctgctccagctggcctttgaagcacaagtttaaatctccaccttctgtgcactgaccagagtctaaaataaaagttgtcagtaccataaaggaaaagggatccacacaggtagccttctccttggatacaggtacatcttactgtaagaatttcaagtcctggctgggcgcagtggctcactcctgtaatcccagcactttgagagaccgaggcaggcagatcacttgaggtcaggaattcaagaccaacctggccaacatggtgaaaccctgtctctaataaaaaaaaaatagaaaaatcagccgggtgtggtggcacacacctgtaatcctagctactcaggaggctgaggcaagagaatctcttgaacctgtgagccagaggttgcagtgagccgagattccaccactgcactccagcctgggcaacagagcaaaactctgtctcaaaaaaaaaaaaaaaaaggcaaaattaaagaatttcaagtccctaatttactctaaccaagcattttcagtcttacaaagaaatctagtgcacgacacctttaaaatgcctagatttccattgcctaaagtaaggtgtgaccagtgaaacaacagcagagaatcatgttcctttgctgtggaacacataagccccacagttttccagtcagcctaatacatgggtatcccccgaccccatctgcctccttaagccacagtccttggtggggaactctaagggggacggagtcagtaccccggacagggccacatttgcatgagacatggctgtctcacaggtcacagagccattacaacagcttactagtttttcatggatttgttggattaacaccttaagcaggttttttattgttattttgtttgtttgtttgttttgagacgggagtttctctcttgtctcccaggctggagtgcaatcgcgcaatctcggctcacggtaacctctgcctcccaggttcgggcgagtctcctgcctcagccttctgagtagctgggattgcaggcatgcgccaccacgcccaactgattttgtatttttagtagagacggggtttctccttgttggtcaggctggtctcaaaccccggacctcaggtgatccccccaccttggcctcccaaagtgccaggattacaggcatgagccactgtgtccggtcttgagcaggtttttaaaatctccagtggccataaaactagccagggtagctcatgcttttactggttggaataaggagccaaaaccaacaaaataatatttattagggctcgatgcccatttctgtggctaaggcttaggtttggtgtgcagagcctggcctgctcttgtgggctgtggttgctgtgacagtttcgttttctgaatctttgtaatgctcttccaccctgctcgtgctgcccagaggctgatctgcaaacctgggcagtattccacactgaagctcagtttgcaaaccttctgctgtgttaattctggtcagtttcacacagaagtcacgagggcctctgcccaggaccttctattcacatttcaagaatccctttctgaaattctccaactctctggtcaggaggaggagcaccattggggcggggtaggcagctagaggcgcaggagcgaatccaggttccttgcgtggttcccagcctctgctgacagcacctcagctaccaggtggggagtggaaattcagcctgcttagaggactgacctctacagttcatatttgcagtgacataaaaggcaaagaggagctggcatggtggtacagaaggtatcagtcaagcgcaggctcttcagaaacctagaaactaaaaagagatgcaacatgtgactggccatcagccagacatgtctagggtgagaccagtgctcagcaccacccgccaaggaacactgatgagttgtgggacattatggtcggccaagtgaggaatgattgcagggaccagagaagaccaaagatgccagatgtccccagagtttcttgagggctgggtttcacgtctttgcttgtcctttttgtccccacttgcctgcaccgtgcctgactcatccagtggggaaggtgactcaagaagttgtttaagcctaggcctaggcagtccacttcgggaggtgggggcactccacactggggggccctgcagctccagggctggtgctctagcagatccgctcaggcacggttgggtgaccgtggggtcaccgattgcgtagattatttctagggcagtgctgggttagaaatgtctgtctggaaacaggacacatcttgccaccacaagtccacacctggccttggctgctgcccgctctctgcagcgtggatttcctttgcccatttgggccagaaggtcaccaggagttcatcactgcttagtgtcaacttgacatcttcagcttccagacagaaaacccatgctttactttgtacagccctgtcccagagttagtaagcctcggcttgtcacctgcttgcaaagggtatagacatcattctgggtagttctagaggatatcgcaacaagtgcgtttgaaggttcagcacagctggaattgtacggtagtgagctcttcaaaatgaaaacagaatgaccggatggccatctgtcctggaaactgtagaattgaataaatcactgaaaatagaacacttcttggaggctttcttcagaactgaactagaaacaaggtttccaggctcccaggtcagtagaccaaaccaacttccttagatttttttttttaagctgtttgcagaaaactgggtggtagcgtgtctgaaccaaacggaagaatagccagcggagcatggactgttccagcacgggccagatggccagctgtcgagagcagccctgcccagattgcggtgggggctgtgccagcggctccgcagggcccttccaactctggagtgtctgtagttcttgtgaaaccaaaacgttgactacctgcctctttcctcgggcatcgacgtgctcatttccaaagatgatggtgcaggtgaccttttccatcgtgagctaagagaaggttaggaggcctgaggggcgggccttgtgtcccctcctccccctccacagcccctgaggtggagcttccctcacagaccccatctggtcgagcctacggctgcccagtgtacactcagtgatgcttataccaaatagggcatgtgcgctggtgtctgttggggacagccccatccctaccttggagtcggcagagaagcagcaataagcattaggcgaatgattgaaagggctgctgcgccaagaggccttcagtccccttaacgtggctttccaacttcctgacgaggctacaaaggctccgctcacaaaagaaagccaataatgtaaataaatagaaaacgaagcctccacgcgtggtttttaaagggggatgatgaatgtgacaccacccacagaatgcattagaatctggtttttctgtgctttgtcattttactctgataggaatttttgttacctaactctgtgcataacttatttaatgtactgtataaatgaaccaaaactgttaaatatgtatttagtttgttctacttaaagtagtcaataaaaaggctatattcct

SEQ ID NO: 456748 - DNA, 6526 bp, Homo sapiens
gggggaagggtagtggagagagaggaagcaggagggagggagaaaaagagagagactgactgtatctggggattctggcaaggtgaagagctggtctgtttggcaggaccttcccatctgggatccatctgtgtttccctggaatgggacaggcagctctagtcagtgagaaatcgcagatgtgagagagctgacacatgtccagctaatgaaaggaggaggaaggctggtctccgattgagctttgaagattaggaggagaaaaagaggagctttggaatatctatttcaaataaatttggtgtatttaagaatctggattgtttataatttgggcatttgggttggtcctgagaaaagggtgccagcgatgcctggatcgcctgtggaagtgaagatacagtccagatcctcacctcccaccatgccacccctcccaccaataaatcctggaggaccgaggccagtgtccttcactcctactgcattaagcaatggcatcaaccattctcctcctaccctgaatggtgccccatcaccgccacagagattcagcaatggtcctgcctcctccacatcatctgcactcacaaatcagcaattgccagccacttgtggtgctcgacaactcagcaagttgaaacgctttcttaccactctgcaacagtttggcaatgacatctcccctgagattggggagaaggtgcggactcttgttcttgcactggtgaactcaacagtgacaattgaggaattccactgtaagctccaagaagccacaaactttccccttcgtccttttgtgattccatttctcaaggccaacctgcccctgctgcagcgggaactgctgcactgcgctcgggcggccaagcagaccccatcccagtacctggctcagcacgaacaccttctgctcaacacaagcattgcatcgcctgctgactcgtcagagttgctcatggaggtgcacggaaatgggaagaggcccagtccagagaggagagaagagaatagttttgatagagacacaattgctcctgagcctcctgccaagagagtatgtaccatcagccctgctcctcggcacagtcctgctctcactgtgcccctcatgaatcccgggggccaattccatcctacccctccacctcttcagcattacaccttagaggatattgcaacttctcacctgtatcgggaacccaacaagatgctagagcatcgagaagttcgtgatagacaccacagtcttggtctaaatggaggctatcaagatgagttggtagatcatcgtttgacagaaagggaatgggctgatgaatggaaacatcttgaccatgcgctgaattgcattatggaaatggtagagaaaacaaggcgctctatggcagttctgcggcgctgtcaggaatcagatcgtgaagaactcaactactggaaaagacggtacaatgaaaacacagagctgaggaaaacggggaccgagttggtctccaggcagcacagccctgggagtgcagattctctcagcaatgattctcagagagagttcaacagcaggccaggtacaggatacgtacctgtggagttttggaaaaaaacagaagaagctgtgaataaggtgaaaattcaggccatgtcagaagtacagaaggccgtcgctgaggcagagcagaaagcctttgaagtgattgcaacagagagagcacgaatggagcaaaccatagcggatgtcaagcggcaggccgcagaggatgctttcctcgtcatcaatgagcaagaggagtccacggagaactgctggaactgtggccgcaaagccagcgagacatgcagtggctgcaatatcgcgcgatactgtggctctttctgccagcacaaggactgggagcggcaccaccgcctctgtggtcagaacctgcatggccagagcccccacggccagggccggccgctgcttcctgtaggcaggggctcctctgccaggtccgccgactgcagcgtgcccagcccagccctcgacaagacctcggcaaccacatcgcgttcctcaacacctgcttctgtgacagctatcgacaccaacggactctgagccccggactctgcttaccctgatggctgctcagcaccacagagtgcttgggctgagggactgactgttggaacccgtgcatgtagctgccgggtcatcagcaagaaatgaattggaggcaggaagagtccaagcctgaataataacaccccacagcctctctgtgcacttgctgtctgcggagccagtgtgccattctctgcacatgggcagccagcctgagctgcctcctccatggctttcctggtttgttcctctctccactgaagctgacttagccggccccttttcagtgtagaccaccagctcccctccccatctccttgagtcagcagactgtccaatgtgctcagccaggctggaggcggcaggcggcaggcagcaggctgtggaggaggcccctcggtcagggagcggcctgcctcacccctgaatagctccttcggccccatctccatcctcagcagatgacactgattggcctcacggggacttgggtaagcaacaggcggcattcaggactcttctcaaccctgctgttcagacttgataagatctcagagtccacaggaaagaagtcactgttgcaataaaagcacccgtagtagcaaaaacataaaacaaataaaacttcccccacatcacagatgattttggacaagattttccaaccttgctggctactttagtttgggacctgttttttttctcatttgattttgcttgtgcagaaaatagtttccagcacatggattgatctgagagagaatgaggctcagttgtggatagtctgttttctctgagcatgttggccaactagtatcgtcaaattattgagtggatcatctcttggaaatgcagaacttctgccaccacttggctatttgcacagtcatcttgttctgtgtccttttatctctcagaccacacacatctggaacgctgtgggcatcttctgcccatgggctccatttggcacctgctgagccacagttgtcctgctggatgtgctgtgcaggttggtaggacttgcccccactgtcaaggcctggtctcatctgaaaagccctcctggacctcaaagaattcttcagacctcatagttacaggtcattatatctactatgttgatttatcatcaggcacacaacttctgtttccttctcttgtgttatctgatagcgtccctccttgagctcatcagaaaggttttatgaaatgtgaaccattttgggaaaagctgatcaatttttcttcctagcttcccattttcaaatgggacatcactcatatccctttcagaatgttaggaactgcctcccacattcttccctgtctttttgggttttgttttttgttgttgttgtggttttttaacacaaagctcactctgttgcccaggctggagtgcagtggcatgatcttggctcactgcaacctctgccttccaggttcaagcaattctcctgcctcgagcctcccgagtagctgagattacaggcgcccaccaccacgcccagctagatttttgtattttttagtagagacagggtttcaccatgttggccaggctgatctcgaactcctgacctcaggtgacctgccttggcctcccaaagtgcagggattacaagcgtgagccaccatgcccggcctgtctttttggttttgatgggagtctgaggaccccgacccctcctgctctccatctttgagcctctggcatcctctcacacccagaaatcagttggagtaagtttaattggccctgctccagctggcctttgaagcacaagtttaaatctccaccttctgtgcactgaccagagtctaaaataaaagttgtcagtaccataaaggaaaagggatccacacaggtagccttctccttggatacaggtacatcttactgtaagaatttcaagtcctggctgggcgcagtggctcactcctgtaatcccagcactttgagagaccgaggcaggcagatcacttgaggtcaggaattcaagaccaacctggccaacatggtgaaaccctgtctctaataaaaaaaaaatagaaaaatcagccgggtgtggtggcacacacctgtaatcctagctactcaggaggctgaggcaagagaatctcttgaacctgtgagccagaggttgcagtgagccgagattccaccactgcactccagcctgggcaacagagcaaaactctgtctcaaaaaaaaaaaaaaaaaggcaaaattaaagaatttcaagtccctaatttactctaaccaagcattttcagtcttacaaagaaatctagtgcacgacacctttaaaatgcctagatttccattgcctaaagtaaggtgtgaccagtgaaacaacagcagagaatcatgttcctttgctgtggaacacataagccccacagttttccagtcagcctaatacatgggtatcccccgaccccatctgcctccttaagccacagtccttggtggggaactctaagggggacggagtcagtaccccggacagggccacatttgcatgagacatggctgtctcacaggtcacagagccattacaacagcttactagtttttcatggatttgttggattaacaccttaagcaggttttttattgttattttgtttgtttgtttgttttgagacgggagtttctctcttgtctcccaggctggagtgcaatcgcgcaatctcggctcacggtaacctctgcctcccaggttcgggcgagtctcctgcctcagccttctgagtagctgggattgcaggcatgcgccaccacgcccaactgattttgtatttttagtagagacggggtttctccttgttggtcaggctggtctcaaaccccggacctcaggtgatccccccaccttggcctcccaaagtgccaggattacaggcatgagccactgtgtccggtcttgagcaggtttttaaaatctccagtggccataaaactagccagggtagctcatgcttttactggttggaataaggagccaaaaccaacaaaataatatttattagggctcgatgcccatttctgtggctaaggcttaggtttggtgtgcagagcctggcctgctcttgtgggctgtggttgctgtgacagtttcgttttctgaatctttgtaatgctcttccaccctgctcgtgctgcccagaggctgatctgcaaacctgggcagtattccacactgaagctcagtttgcaaaccttctgctgtgttaattctggtcagtttcacacagaagtcacgagggcctctgcccaggaccttctattcacatttcaagaatccctttctgaaattctccaactctctggtcaggaggaggagcaccattggggcggggtaggcagctagaggcgcaggagcgaatccaggttccttgcgtggttcccagcctctgctgacagcacctcagctaccaggtggggagtggaaattcagcctgcttagaggactgacctctacagttcatatttgcagtgacataaaaggcaaagaggagctggcatggtggtacagaaggtatcagtcaagcgcaggctcttcagaaacctagaaactaaaaagagatgcaacatgtgactggccatcagccagacatgtctagggtgagaccagtgctcagcaccacccgccaaggaacactgatgagttgtgggacattatggtcggccaagtgaggaatgattgcagggaccagagaagaccaaagatgccagatgtccccagagtttcttgagggctgggtttcacgtctttgcttgtcctttttgtccccacttgcctgcaccgtgcctgactcatccagtggggaaggtgactcaagaagttgtttaagcctaggcctaggcagtccacttcgggaggtgggggcactccacactggggggccctgcagctccagggctggtgctctagcagatccgctcaggcacggttgggtgaccgtggggtcaccgattgcgtagattatttctagggcagtgctgggttagaaatgtctgtctggaaacaggacacatcttgccaccacaagtccacacctggccttggctgctgcccgctctctgcagcgtggatttcctttgcccatttgggccagaaggtccaggtatgccggcatacctggaccttctgtattcccaggttcaagcgatgctcctgcctcagcctcccgagtagctgggaatacagaagggcatcatcacacccagctactttttgtatttttagtagagacagggttgcgccacgttggccaggcaggtcttgtactcctggcctcatgtgatccactcatcctcggcttccaaaagtgccgggattacaggtgtgaaccacctcacctggccatacgcttgaatatgttttatttgatactgagattacatggtaa

SEQ ID NO: 456749 - DNA, 1604 bp, Homo sapiens
  misc_feature (835)..(835): n is a, c, g, or t
cggggcggggcgcggcctaacggcggcggcggcggcggcgacggcgacagcagcggtggtggtgtctggttagctcggcggctgcagatctcgcggcgacgcctgcgagggacccgggccgcgggtcgaggcgggcggcgcctgcgagggacccgtgtcgcgggtagaggcgggcggcgcgcggcggcggcgctcggcgatggtaggcgtccctggagcggccgccttccagcttggtcctgagaaaagggtgccagcgatgcctggatcgcctgtggaagtgaagatacagtccagatcctcacctcccaccatgccacccctcccaccaataaatcctggaggaccgaggccagtgtccttcactcctactgcattaagcaatggcatcaaccattctcctcctaccctgaatggtgccccatcaccgccacagagattcagcaatggtcctgcctcctccacatcatctgcactcacaaatcagcaattgccagccacttgtggtgctcgacaactcagcaagttgaaacgctttcttaccactctgcaacagtttggcaatgacatctcccctgagattggggagaaggtgcggactcttgttcttgcactggtgcagagttgctgagtctcattcctaatttgaggcctagacttttgggaaaacacagaggacgtccaccttttagagaacagtgataacttaccaatgggggtttgccggttgggagttattctggtatgcataatgcatacaggccacttgaaggtagaaggcaactattcttttttcttttgcttctggtggtttttgtttgtttgtttgtttgtntgtttgtttgaagatttgggggaagttatgccaggaggtagggggcagaacttggaaaaagaaatgaacttttgaaaaaatgtgacactgggttactgagtccaaaatgtcttagagttgacatcctaggccaagtcattatctctgtaacaggaaacattgtaagcttgattgcctgttcctgaagtgacttgcaatgaacccctcaatatcagggatcagagtgcctctcttcatgggtagtgagaaaggcagtgccctattctgcagcctaggctgctgggcaaaggggagaatttggtggtggtgaagggaatcaaggagggtttctgtcataagaaaccagtgtggtttacctttgccaggcgtctgagttcctgatgatgttcctgcagttatccttttccttatgatttaaaagtctttagcagctgagcacggtggctcacccctgtaatcccaacactttggaaggctgagggaggaagatagcttgagctcaggagttcaggaccagcctagacaacatagcgagactgcatctctactaaacatttaaaaaacaaaataaaaagaccgggcgcggtggctctcccttgtaatcccaccactttaggaggccgaggcgggtggatcacaaagtcaggagttcaccgtcaggagatcacaggaggtggaggttacagtgagccgagaccgcgccactgcgctctggcctgggcaacagagcaagactccatctcaaataaataaataaataaataacatt

SEQ ID NO: 456750 - DNA, 909 bp, Homo sapiens
ctaaaattctgtgtttctgctagtttcttcctcaagataaaactgtggaactcatagtgaattccctctctttgggcagtttgagccaggccgctatttaatcacaacatcacaagtcagatttttcctacctagtgttggcagtggaacacaccagaactgctaaggccaaggaaatcccattttttgaagaggctttcctttgttagcttctctttctagtagtaaaggtaaaagaaaaatagatgttaaagatataaatatcttagggggtttttattggtataaatatttgtacacaaaaagaatatgtaatgtaaactggatatgtattttttacattttacttaacctgaattttacacaatctttgcttgaatgctccaacaatgaaaggagaaaatatgtatttaaacaatttttaagtatttattctttattcaggacacttgagtttcattcaagctatagttttaaaatgtaaaaatgctgagaaattaaaagcagtcaaatgcttttgtctgagtctttgttcaaggaagtatcttagacaactttgccttaaaagttcttgaggcaaatgaaaaccagtttttcagaattagaaagaccacaattaacttagtatcctataactttggtgttttaaaaagtaattctcaaaggggtgagtcaagtcagaaagagaactgtgtgtgtaaattgtcaggttttgacgtttgtttccagccatttccagagagaaaacttcatttttattcttctcagcagcacatttcaaaggaaaattgtacaattcttatattcacaatatcacagctaaaattatctagtataaagactctacgatttacatcgtaagattcagaaagagcacattttgagtttgaaaacaaatgaagtgatatg

SEQ ID NO: 456751 - DNA, 1946 bp, Homo sapiens
agcggagtgacgcgggcccgggcgcgacggtctcggcggcggcggcggcggcgacagagcgagcgcggcgcggggccaccatgggggcccagctcagcacgttgggccatatggtgctcttcccagtctggttcctgtacagtctgctcatgaagctgttccagcgctccacgccagccatcaccctcgagagcccggacatcaagtacccgctgcggctcatcgaccgggagatcatcagccatgacacccggcgcttccgctttgccctgccgtcaccccagcacatcctgggcctccctgtcggccagcacatctacctctcggctcgaattgatggaaacctggtcgtccggccctatacacccatctccagcgatgatgacaagggcttcgtggacctggtcatcaaggtttacttcaaggacacccatcccaagtttcccgctggagggaagatgtctcagtacctggagagcatgcagattggagacaccattgagttccggggccccagtgggctgctggtctaccagggcaaagggaagttcgccatccgacctgacaaaaagtccaaccctatcatcaggacagtgaagtctgtgggcatgatcgcgggagggacaggcatcaccccgatgctgcaggtgatccgcgccatcatgaaggaccctgatgaccacactgtgtgccacctgctctttgccaaccagaccgagaaggacatcctgctgcgacctgagctggaggaactcaggaacaaacattctgcacgcttcaagctctggtacacgctggacagagcccctgaagcctgggactacggccagggcttcgtgaatgaggagatgatccgggaccaccttccacccccagaggaggagccgctggtgctgatgtgtggccccccacccatgatccagtacgcctgccttcccaacctggaccacgtgggccaccccacggagcgctgcttcgtcttctgagggccgggcacggtcacacggccacccgccccgcgcaccccacgccctgttcacgctcacccagtcacctccccacatcgcacactggggccccgggttcagcctggcctgcccgtgccctggtgaatcacctggctgagcagttcccctggagccccttcgggagcagggctgtgtcccagatgggccacggctgagccttcagagtacgtcctgcctggcacttactggtccttaccagagacgcccagccccatccctgtcctcatgacccctcgtccaccccccacacacactataaggctgagggctgccagcagccccgtctgcccaccattcccggccgtggaccatagtcgggatgtcagcagacacacatgggcagcccaaagctgcaggtgccagggcccaccccagcctcgcctgtcacccccactcccgcctcagggccaggcccaggcctcaccacctgacgctgcatgagacattgacaccagaaagccctcttgggggcactgctccctaccccagggccctggccagccgggagcttggctctcctctggctagagtgggaagagggggctggccatggggccctcccagaacctcagcatttccttccagcccatccaaacactgaggcagccttggggaaccccgagctggggggttggcagcccactgcaccgcctcagggttttggggtcctgggctggggccaccatccctgatggcagaactcccacaaccacatgtatttattcctctgtcctaaaccgtcccctccttccctcacccccagcacagggggattctgagcagtgcctcttgtctgagggacatatcagtgacctcgacgttgcctttagactacagttgtgttagcctcttgcgtattggctttttcagagtcatttatgagcagaaaaaaaaaaagtaaaactttgctaatattaa

SEQ ID NO: 456752 - DNA, 1972 bp, Homo sapiens
aggggttggccctggagtctgccagccacactgggaaaacattggagcttggtctgccatcctgaactgtggttcccctgcctcccagcccggctgtgagtgctcagcgaccctgacaggctgacagttgggccatatggtgctcttcccagtctggttcctgtacagtctgctcatgaagctgttccagcgctccacgccagccatcaccctcgagagcccggacatcaagtacccgctgcggctcatcgaccgggagatcatcagccatgacacccggcgcttccgctttgccctgccgtcaccccagcacatcctgggcctccctgtcggccagcacatctacctctcggctcgaattgatggaaacctggtcgtccggccctatacacccatctccagcgatgatgacaagggcttcgtggacctggtcatcaaggtttacttcaaggacacccatcccaagtttcccgctggagggaagatgtctcagtacctggagagcatgcagattggagacaccattgagttccggggccccagtgggctgctggtctaccagggcaaagggaagttcgccatccgacctgacaaaaagtccaaccctatcatcaggacagtgaagtctgtgggcatgatcgcgggagggacaggcatcaccccgatgctgcaggtgatccgcgccatcatgaaggaccctgatgaccacactgtgtgccacctgctctttgccaaccagaccgagaaggacatcctgctgcgacctgagctggaggaactcaggaacaaacattctgcacgcttcaagctctggtacacgctggacagagcccctgaagcctgggactacggccagggcttcgtgaatgaggagatgatccgggaccaccttccacccccagaggaggagccgctggtgctgatgtgtggccccccacccatgatccagtacgcctgccttcccaacctggaccacgtgggccaccccacggagcgctgcttcgtcttctgagggccgggcacggtcacacggccacccgccccgcgcaccccacgccctgttcacgctcacccagtcacctccccacatcgcacactggggccccgggttcagcctggcctgcccgtgccctggtgaatcacctggctgagcagttcccctggagccccttcgggagcagggctgtgtcccagatgggccacggctgagccttcagagtacgtcctgcctggcacttactggtccttaccagagacgcccagccccatccctgtcctcatgacccctcgtccaccccccacacacactataaggctgagggctgccagcagccccgtctgcccaccattcccggccgtggaccatagtcgggatgtcagcagacacacatgggcagcccaaagctgcaggtgccagggcccaccccagcctcgcctgtcacccccactcccgcctcagggccaggcccaggcctcaccacctgacgctgcatgagacattgacaccagaaagccctcttgggggcactgctccctaccccagggccctggccagccgggagcttggctctcctctggctagagtgggaagagggggctggccatggggccctcccagaacctcagcatttccttccagcccatccaaacactgaggcagccttggggaaccccgagctggggggttggcagcccactgcaccgcctcagggttttggggtcctgggctggggccaccatccctgatggcagaactcccacaaccacatgtatttattcctctgtcctaaaccgtcccctccttccctcacccccagcacagggggattctgagcagtgcctcttgtctgagggacatatcagtgacctcgacgttgcctttagactacagttgtgttagcctcttgcgtattggctttttcagagtcatttatgagcagaaaaaaaaaaagtaaaactttgctaatattaa

SEQ ID NO: 456753 - DNA, 713 bp, Homo sapiens
tccgccgcctcgaggcagacccggatccagagggcgcctggacaagttgggccatatggtgctcttcccagtctggttcctgtacagtctgctcatgaagctgttccagcgctccacgccagccatcaccctcgagagcccggacatcaagtacccgctgcggctcatcgaccgggagatcatcagccatgacacccggcgcttccgctttgccctgccgtcaccccagcacatcctgggcctccctgtcggccagcacatctacctctcggctcgaattgatggaaacctggtcgtccggccctatacacccatctccagcgatgatgacaagggcttcgtggacctggtcatcaaggtttacttcaaggacacccatcccaagtttcccgctggagggaagatgtctcagtacctggagagcatgcagattggagacaccattgagttccggggccccagtgggctgctggtctaccagggcaaagggaagttcgccatccgacctgacaaaaagtccaaccctatcatcaggacagtgaagtctgtgggcatgatcgcgggagggacaggcatcaccccgatgctgcaggtgatccgcgccatcatgaaggaccctgatgaccacactgtgtgccacctgctctttgccaaccagaacagaacgagaaggacatcctgttgggaactgaattgggggaccccgggaccca

SEQ ID NO: 456754 - DNA, 2487 bp, Homo sapiens
agcggagtgacgcgggcccgggcgcgacggtctcggcggcggcggcggcggcgacagagcgagcgcggcgcggggccaccatgggggcccagctcagcacgttgggccatatggtgctcttcccagtctggttcctgtacagtctgctcatgaagctgttccagcgctccacgccagccatcaccctcgagagcccggacatcaagtacccgctgcggctcatcgaccgggagatcatcagccatgacacccggcgcttccgctttgccctgccgtcaccccagcacatcctgggcctccctgtcggccagcacatctacctctcggctcgaattgatggaaacctggtcgtccggccctatacacccatctccagcgatgatgacaagggcttcgtggacctggtcatcaaggtttacttcaaggacacccatcccaagtttcccgctggagggaagatgtctcagtacctggagagcatgcagattggagacaccattgagttccggggccccagtgggctgctggtctaccagggcaaagggaagttcgccatccgacctgacaaaaagtccaaccctatcatcaggacagtgaagtctgtgggcatgatcgcgggagggacaggcatcaccccgatgctgcaggtgatccgcgccatcatgaaggaccctgatgaccacactgtgtgccacctgctctttgccaaccagaccgagaaggacatcctgctgcgacctgagctggaggaactcaggaacaaacattctgcacgcttcaagctctggtacacgctggacagagcccctgaagcctgggactacggccagggcttcgtgaatgaggagatgatccgggaccaccttccacccccagaggaggagccgctggtgctgatgtgtggccccccacccatgatccagtacgcctgccttcccaacctggaccacgtgggccaccccacggagcgctgcttcgtcttctgagggccgggcacggtcacacggccacccgccccgcgcaccccacgccctgttcacgctcacccagtcacctccccacatcgcacactggggccccgggttcagcctggcctgcccgtgccctggtgaatcacctggctgagcagttcccctggagccccttcgggagcagggctgtgtcccagatgggccacggctgagccttcagagtacgtcctgcctggcacttactggtccttaccagagacgcccagccccatccctgtcctcatgacccctcgtccaccccccacacacactataaggctgagggctgccagcagccccgtctgcccaccattcccggccgtggaccatagtcgggatgtcagcagacacacatgggcagcccaaagctgcaggtgccagggcccaccccagcctcgcctgtcacccccactcccgcctcagggccaggcccaggcctcaccacctgacgctgcatgagacattgacaccagaaagccctcttgggggcactgctccctaccccagggccctggccagccgggagcttggctctcctctggctagagtgggaagagggggctggccatggggccctcccagaacctcagcatttccttccagcccatccaaacactgaggcagccttggggaaccccgagctggggggttggcagcccactgcaccgcctcagggttttggggtcctgggctggggccaccatccctgatggcagaactcccacaaccacatgtatttattcctctgtcctaaaccgtcccctccttccctcacccccagcacagggggattctgagcagtgcctcttgtctgagggacatatcagtgacctcgacgttgcctttagactacagttgtgttagcctcttgcgtattggctttttcagagtcatttatgagcagaaaaaaaaaaagtaaaactttgctaatattaaaaaaaaaaaaaaaaaaaaaaaaaaaagggggcggcgcgcgcgcccataaaggattctcccctcgggggcgcccaagtctttccgcgcgttccccggttttctttgttccaaggggggcccctatatatagggggggccggatttttattagcgcgcttagggcccgtgcgccggccggttttacacaacacggttcgggcgactggggagaaccacctctcgcttaccttggggaactctttcggggagagggagaccctttttcttctccggggggcggggcgaccatttcttttgggcgcccacaattataccctttaaacagagagagtttatataaaggcctctatagaggggtgacaattttataaacaattttctttaaaacgggtgttaataccgggtgtgttttaacacctattaggcggcaattttgccctggacgggctttgagagaagtttcgggcctaaccgggagaatagtgaactttctgtggaacatttttttttttccccgggggaccctggttgttaaaataac

SEQ ID NO: 456755 - DNA, 2275 bp, Homo sapiens
  misc_feature (1964)..(1964): n is a, c, g, or t
  misc_feature (1966)..(1966): n is a, c, g, or t
  misc_feature (1968)..(1968): n is a, c, g, or t
  misc_feature (1977)..(1977): n is a, c, g, or t
agcggagtgacgcgggcccgggcgcgacggtctcggcggcggcggcggcggcgacagagcgagcgcggcgcggggccaccatgggggcccagctcagcacgttgggccatatggtgctcttcccagtctggttcctgtacagtctgctcatgaagctgttccagcgctccacgccagccatcaccctcgagagcccggacatcaagtacccgctgcggctcatcgaccgggagatcatcagccatgacacccggcgcttccgctttgccctgccgtcaccccagcacatcctgggcctccctgtcggccagcacatctacctctcggctcgaattgatggaaacctggtcgtccggccctatacacccatctccagcgatgatgacaagggcttcgtggacctggtcatcaaggtttacttcaaggacacccatcccaagtttcccgctggagggaagatgtctcagtacctggagagcatgcagattggagacaccattgagttccggggccccagtgggctgctggtctaccagggcaaagggaagttcgccatccgacctgacaaaaagtccaaccctatcatcaggacagtgaagtctgtgggcatgatcgcgggagggacaggcatcaccccgatgctgcaggtgatccgcgccatcatgaaggaccctgatgaccacactgtgtgccacctgctctttgccaaccagaccgagaaggacatcctgctgcgacctgagctggaggaactcaggaacaaacattctgcacgcttcaagctctggtacacgctggacagagcccctgaagcctgggactacggccagggcttcgtgaatgaggagatgatccgggaccaccttccacccccagaggaggagccgctggtgctgatgtgtggccccccacccatgatccagtacgcctgccttcccaacctggaccacgtgggccaccccacggagcgctgcttcgtcttctgagggccgggcacggtcacacggccacccgccccgcgcaccccacgccctgttcacgctcacccagtcacctccccacatcgcacactggggccccgggttcagcctggcctgcccgtgccctggtgaatcacctggctgagcagttcccctggagccccttcgggagcagggctgtgtcccagatgggccacggctgagccttcagagtacgtcctgcctggcacttactggtccttaccagagacgcccagccccatccctgtcctcatgacccctcgtccaccccccacacacactataaggctgagggctgccagcagccccgtctgcccaccattcccggccgtggaccatagtcgggatgtcagcagacacacatgggcagcccaaagctgcaggtgccagggcccaccccagcctcgcctgtcacccccactcccgcctcagggccaggcccaggcctcaccacctgacgctgcatgagacattgacaccagaaagccctcttgggggcactgctccctaccccagggccctggccagccgggagcttggctctcctctggctagagtgggaagagggggctggccatggggccctcccagaacctcagcatttccttccagcccatccaaacactgaggcagccttggggaaccccgagctggggggttggcagcccactgcaccgcctcagggttttggggtcctgggctggggccaccatccctgatggcagaactcccacaaccacatgtatttattcctctgtcctaaaccgtcccctccttccctcacccccagcacagggggattctgagcagtgcctcttgtctgagggacatatcagtgacctcgacgttgcctttagactacagttgtgttagcctcttgcgtattggctttttcagagtcatttatgagcagaaaaaaaaaaagtaaaactttgctaatattaacacacacaaaacaaaaanananacaaacaancacaacacgcacacacaacaaaaaaaaccaccaacacacaaacgagggggggggggggcccgaaaagaatcccccggggggggccccaggtatgggggcacacccaggtttgtgcggcaaacgagggggccccaaaggggagcgcgtataaagacggggagagaggagggcgcccgcggtgacaacagcggcggcagcgcggcgcaacaacggcgccccacgagggcaccacggaggagcggagcgacacacacccggcgggggggcgccacacacgcgcgcggccagaacccacgag

SEQ ID NO: 456756 - DNA, 2217 bp, Homo sapiens
aggggttggccctggagtctgccagccacactgggaaaacattggagcttggtctgccatcctgaactgtggttcccctgcctcccagcccggctgtgagtgctcagcgaccctgacaggctgacaggtacagtctgccgggctttcctactgtccctggcagccccatgcttactctgcggcccagatcccagctctgtgtccacctgttccttctcctgggttcccttcccccacagttcccagccaagccagagccccccactgcagaacttcctccactccctcccacttcctcccggttagaacaggaccaggagggaggtgccgctcagattctggcaggaccgctggcgggcaggcaggggacagttgggccatatggtgctcttcccagtctggttcctgtacagtctgctcatgaagctgttccagcgctccacgccagccatcaccctcgagagcccggacatcaagtacccgctgcggctcatcgaccgggagatcatcagccatgacacccggcgcttccgctttgccctgccgtcaccccagcacatcctgggcctccctgtcggccagcacatctacctctcggctcgaattgatggaaacctggtcgtccggccctatacacccatctccagcgatgatgacaagggcttcgtggacctggtcatcaaggtttacttcaaggacacccatcccaagtttcccgctggagggaagatgtctcagtacctggagagcatgcagattggagacaccattgagttccggggccccagtgggctgctggtctaccagggcaaagggaagttcgccatccgacctgacaaaaagtccaaccctatcatcaggacagtgaagtctgtgggcatgatcgcgggagggacaggcatcaccccgatgctgcaggtgatccgcgccatcatgaaggaccctgatgaccacactgtgtgccacctgctctttgccaaccagaccgagaaggacatcctgctgcgacctgagctggaggaactcaggaacaaacattctgcacgcttcaagctctggtacacgctggacagagcccctgaagcctgggactacggccagggcttcgtgaatgaggagatgatccgggaccaccttccacccccagaggaggagccgctggtgctgatgtgtggccccccacccatgatccagtacgcctgccttcccaacctggaccacgtgggccaccccacggagcgctgcttcgtcttctgagggccgggcacggtcacacggccacccgccccgcgcaccccacgccctgttcacgctcacccagtcacctccccacatcgcacactggggccccgggttcagcctggcctgcccgtgccctggtgaatcacctggctgagcagttcccctggagccccttcgggagcagggctgtgtcccagatgggccacggctgagccttcagagtacgtcctgcctggcacttactggtccttaccagagacgcccagccccatccctgtcctcatgacccctcgtccaccccccacacacactataaggctgagggctgccagcagccccgtctgcccaccattcccggccgtggaccatagtcgggatgtcagcagacacacatgggcagcccaaagctgcaggtgccagggcccaccccagcctcgcctgtcacccccactcccgcctcagggccaggcccaggcctcaccacctgacgctgcatgagacattgacaccagaaagccctcttgggggcactgctccctaccccagggccctggccagccgggagcttggctctcctctggctagagtgggaagagggggctggccatggggccctcccagaacctcagcatttccttccagcccatccaaacactgaggcagccttggggaaccccgagctggggggttggcagcccactgcaccgcctcagggttttggggtcctgggctggggccaccatccctgatggcagaactcccacaaccacatgtatttattcctctgtcctaaaccgtcccctccttccctcacccccagcacagggggattctgagcagtgcctcttgtctgagggacatatcagtgacctcgacgttgcctttagactacagttgtgttagcctcttgcgtattggctttttcagagtcatttatgagcagaaaaaaaaaaagtaaaactttgctaatattaa

SEQ ID NO: 456757 - DNA, 1612 bp, Homo sapiens
agcggagtgacgcgggcccgggcgcgacggtctcggcggcggcggcggcggcgacagagcgagcgcggcgcggggccaccatgggggcccagctcagcacgttgggccatatggtgctcttcccagtctggttcctgtacagtctgctcatgaagctgttccagcgctccacgccagccatcaccctcgagagcccggacatcaagtacccgctgcggctcatcgaccgggagatcatcagccatgacacccggcgcttccgctttgccctgccgtcaccccagcacatcctgggcctccctgtcggccagcacatctacctctcggctcgaattgatggaaacctggtcgtccggccctatacacccatctccagcgatgatgacaagggcttcgtggacctggtcatcaaggtttacttcaaggacacccatcccaagtttcccgctggagggaagatgtctcagtacctggagagcatgcagattggagacaccattgagttccggggccccagtgggctgctggtctaccagggcaaagggaagttcgccatccgacctgacaaaaagtccaaccctatcatcaggacagtgaagtctgtgggcatgatcgcgggagggacaggcatcaccccgatgctgcaggtgatccgcgccatcatgaaggaccctgatgaccacactgtgtgccacctgctctttgccaaccagaccgagaaggacatcctgctgcgacctgagctggaggaactcaggaacaaacattctgcacgcttcaagctctggtacacgctggacagagcccctgaagcctgggactacggccagggcttcgtgaatgaggagatgatccgggaccaccttccacccccagaggaggagccgctggtgctgatgtgtggccccccacccatgatccagtacgcctgccttcccaacctggaccacgtgggccaccccacggagcgctgcttcgtcttctgagggccgggcacggtcacacggccacccgccccgcgcaccccacgccctgttcacgctcacccagtcacctccccacatcgcacactggggccccgggttcagcctggcctgcccgtgccctggtgaatcacctggctgagcagttcccctggagccccttcgggagcagggctgtgtcccagatgggccacggctgagccttcagagtacgtcctgcctggcacttactggtccttaccagagacgcccagccccatccctgtcctcatgacccctcgtccaccccccacacacactataaggctgagggctgccagcagccccgtctgcccaccattcccggccgtggaccatagtcgggatgtcagcagacacacatgggcagcccaaagctgcaggtgccagggcccaccccagcctcgcctgtcacccccactcccgcctcagggccaggcccaggcctcaccacctgacgctgcatgagacattgacaccagaaagctgagggacatatcagtgacctcgacgttgcctttagactacagttgtgttagcctcttgcgtattggctttttcagagtcatttatgagcagaaaaaaaaaaagtaaaactttgctaatattaa

SEQ ID NO: 456758 - DNA, 1369 bp, Homo sapiens
agcggagtgacgcgggcccgggcgcgacggtctcggcggcggcggcggcggcgacagagcgagcgcggcgcggggccaccatgggggcccagctcagcacgttgggccatatggtgctcttcccagtctggttcctgtacagtctgctcatgaagctgttccagcgctccacgccagccatcaccctcgagagcccggacatcaagtacccgctgcggctcatcgaccgggagatcatcagccatgacacccggcgcttccgctttgccctgccgtcaccccagcacatcctgggcctccctgtcggccagcacatctacctctcggctcgaattgatggaaacctggtcgtccggccctatacacccatctccagcgatgatgacaagggcttcgtggacctggtcatcaaggtttacttcaaggacacccatcccaagtttcccgctggagggaagatgtctcagtacctggagagcatgcagattggagacaccattgagttccggggccccagtgggctgctggtctaccagggcaaagggaagttcgccatccgacctgacaaaaagtccaaccctatcatcaggacagtgaagtctgtgggcatgatcgcgggagggacaggcatcaccccgatgctgcaggtgatccgcgccatcatgaaggaccctgatgaccacactgtgtgccacctgctctttgccaaccagaccgagaaggacatcctgctgcgacctgagctggaggaactcaggaacaaacattctgcacgcttcaagctctggtacacgctggacagagcccctgaagcctgggactacggccagggcttcgtgaatgaggagatgatccgggaccaccttccacccccagaggaggagccgctggtgctgatgtgtggccccccacccatgatccagtacgcctgccttcccaacctggaccacgtgggccaccccacggagcgctgcttcgtcttctgagggccgggcacggtcacacggccacccgccccgcgcaccccacgccctgttcacgctcacccagtcacctccccacatcgcacactggggccccgggttcagcctggcctgcccgtgccctggtgaatcacctggctgagcagttcccctggagccccttcgggagcagggctgtgtcccagatgggccacggctgagccttcagagtacgtcctgcctggcacttactggtccttaccagagacgcccagccccatcctgagggacatatcagtgacctcgacgttgcctttagactacagttgtgttagcctcttgcgtattggctttttcagagtcatttatgagcagaaaaaaaaaaagtaaaactttgctaatattaa

SEQ ID NO: 456759 - DNA, 2065 bp, Homo sapiens
agcggagtgacgcgggcccgggcgcgacggtctcggcggcggcggcggcggcgacagagcgagcgcggcgcggggccaccatgggggcccagctcagcacgttgggccatatggtgctcttcccagtctggttcctgtacagtctgctcatgaagctgttccagcgctccacgccagccatcaccctcgagagcccggacatcaagtacccgctgcggctcatcgaccgggagatggagaaagcaaggtgatgtctcttgctaaggccaccaggaagtagcagaggaatttaaacctggtctctctgtccacagagccccttctctgaaccacactcactgcctcatgcaagatcatcagccatgacacccggcgcttccgctttgccctgccgtcaccccagcacatcctgggcctccctgtcggccagcacatctacctctcggctcgaattgatggaaacctggtcgtccggccctatacacccatctccagcgatgatgacaagggcttcgtggacctggtcatcaaggtttacttcaaggacacccatcccaagtttcccgctggagggaagatgtctcagtacctggagagcatgcagattggagacaccattgagttccggggccccagtgggctgctggtctaccagggcaaagggaagttcgccatccgacctgacaaaaagtccaaccctatcatcaggacagtgaagtctgtgggcatgatcgcgggagggacaggcatcaccccgatgctgcaggtgatccgcgccatcatgaaggaccctgatgaccacactgtgtgccacctgctctttgccaaccagaccgagaaggacatcctgctgcgacctgagctggaggaactcaggaacaaacattctgcacgcttcaagctctggtacacgctggacagagcccctgaagcctgggactacggccagggcttcgtgaatgaggagatgatccgggaccaccttccacccccagaggaggagccgctggtgctgatgtgtggccccccacccatgatccagtacgcctgccttcccaacctggaccacgtgggccaccccacggagcgctgcttcgtcttctgagggccgggcacggtcacacggccacccgccccgcgcaccccacgccctgttcacgctcacccagtcacctccccacatcgcacactggggccccgggttcagcctggcctgcccgtgccctggtgaatcacctggctgagcagttcccctggagccccttcgggagcagggctgtgtcccagatgggccacggctgagccttcagagtacgtcctgcctggcacttactggtccttaccagagacgcccagccccatccctgtcctcatgacccctcgtccaccccccacacacactataaggctgagggctgccagcagccccgtctgcccaccattcccggccgtggaccatagtcgggatgtcagcagacacacatgggcagcccaaagctgcaggtgccagggcccaccccagcctcgcctgtcacccccactcccgcctcagggccaggcccaggcctcaccacctgacgctgcatgagacattgacaccagaaagccctcttgggggcactgctccctaccccagggccctggccagccgggagcttggctctcctctggctagagtgggaagagggggctggccatggggccctcccagaacctcagcatttccttccagcccatccaaacactgaggcagccttggggaaccccgagctggggggttggcagcccactgcaccgcctcagggttttggggtcctgggctggggccaccatccctgatggcagaactcccacaaccacatgtatttattcctctgtcctaaaccgtcccctccttccctcacccccagcacagggggattctgagcagtgcctcttgtctgagggacatatcagtgacctcgacgttgcctttagactacagttgtgttagcctcttgcgtattggctttttcagagtcatttatgagcagaaaaaaaaaaagtaaaactttgctaatattaa

SEQ ID NO: 456760 - DNA, 1725 bp, Homo sapiens
cttcggatgctggttaaagaaccacgaaatgagttgaaccctgcttccagccacaggagccttgtgtggtctcagtgtgtctctgacactgtttggcctgatggtaaagaggtctcagagctcgatgccaggcaagtggcacccatgcacagggagttgagctgctccaaggaaatgctcactgaagtggctggcagtcactcctggagctttggctcagggttgccaggaagaagtctgctgagggcccgatacattcaagagagtttgcaaccagattcgtagatgaggtagtctgaggcagaatttagctgcaggagagcagaaagaatctcgcctttggggagacataaacattttgggcctgttgcatttttagggcgcagacatcttgtccgggggacaggcatcaccccgatgctgcaggtgatccgcgccatcatgaaggaccctgatgaccacactgtgtgccacctgctctttgccaaccagaccgagaaggacatcctgctgcgacctgagctggaggaactcaggaacaaacattctgcacgcttcaagctctggtacacgctggacagagcccctgaagcctgggactacggccagggcttcgtgaatgaggagatgatccgggaccaccttccacccccagaggaggagccgctggtgctgatgtgtggccccccacccatgatccagtacgcctgccttcccaacctggaccacgtgggccaccccacggagcgctgcttcgtcttctgagggccgggcacggtcacacggccacccgccccgcgcaccccacgccctgttcacgctcacccagtcacctccccacatcgcacactggggccccgggttcagcctggcctgcccgtgccctggtgaatcacctggctgagcagttcccctggagccccttcgggagcagggctgtgtcccagatgggccacggctgagccttcagagtacgtcctgcctggcacttactggtccttaccagagacgcccagccccatccctgtcctcatgacccctcgtccaccccccacacacactataaggctgagggctgccagcagccccgtctgcccaccattcccggccgtggaccatagtcgggatgtcagcagacacacatgggcagcccaaagctgcaggtgccagggcccaccccagcctcgcctgtcacccccactcccgcctcagggccaggcccaggcctcaccacctgacgctgcatgagacattgacaccagaaagccctcttgggggcactgctccctaccccagggccctggccagccgggagcttggctctcctctggctagagtgggaagagggggctggccatggggccctcccagaacctcagcatttccttccagcccatccaaacactgaggcagccttggggaaccccgagctggggggttggcagcccactgcaccgcctcagggttttggggtcctgggctggggccaccatccctgatggcagaactcccacaaccacatgtatttattcctctgtcctaaaccgtcccctccttccctcacccccagcacagggggattctgagcagtgcctcttgtctgagggacatatcagtgacctcgacgttgcctttagactacagttgtgttagcctcttgcgtattggctttttcagagtcatttatgagcagaaaaaaaaaaagtaaaactttgctaatattaa

SEQ ID NO: 456761 - DNA, 1034 bp, Homo sapiens
tccgccgcctcgaggcagacccggatccagagggcgcctggacaagttgggccatatggtgctcttcccagtctggttcctgtacagtctgctcatgaagctgttccagcgctccacgccagccatcaccctcgccagtcacctccccacatcgcacactggggccccgggttcagcctggcctgcccgtgccctggtgaatcacctggctgagcagttcccctggagccccttcgggagcagggctgtgtcccagatgggccacggctgagccttcagagtacgtcctgcctggcacttactggtccttaccagagacgcccagccccatccctgtcctcatgacccctcgtccaccccccacacacactataaggctgagggctgccagcagccccgtctgcccaccattcccggccgtggaccatagtcgggatgtcagcagacacacatgggcagcccaaagctgcaggtgccagggcccaccccagcctcgcctgtcacccccactcccgcctcagggccaggcccaggcctcaccacctgacgctgcatgagacattgacaccagaaagccctcttgggggcactgctccctaccccagggccctggccagccgggagcttggctctcctctggctagagtgggaagagggggctggccatggggccctcccagaacctcagcatttccttccagcccatccaaacactgaggcagccttggggaaccccgagctggggggttggcagcccactgcaccgcctcagggttttggggtcctgggctggggccaccatccctgatggcagaactcccacaaccacatgtatttattcctctgtcctaaaccgtcccctccttccctcacccccagcacagggggattctgagcagtgcctcttgtctgagggacatatcagtgacctcgacgttgcctttagactacagttgtgttagcctcttgcgtattggctttttcagagtcatttatgagcagaaaaaaaaaaagtaaaactttgctaatattaa

SEQ ID NO: 456762 - DNA, 574 bp, Homo sapiens
aatattagcaaagttttactttttttttttctgctcataaatgactctgaaaaagccaatacgcaagaggctaacacaactgtagtctaaaggcaacgtcgaggtcactgatatgtcctcttgggggcactgctccctaccccagggccctggccagccgggagcttggctctcctctggctagagtgggaagagggggctggccatggggccctcccagaacctcagcatttccttccagcccatccaaacactgaggcagccttggggaaccccgagctggggggttggcagcccactgcaccgcctcagggttttggggtcctgggctggggccaccatccctgatggcagaactcccacaaccacatgtatttattcctctgtcctaaaccgtcccctccttccctcacccccagcacagggggattctgagcagtgcctcttgtctgagggacatatcagtgacctcgacgttgcctttagactacagttgtgttagcctcttgcgtattggctttttcagagtcatttatgagcagaaaaaaaaaaagtaaaactttgctaatattaa

SEQ ID NO: 456763 - DNA, 778 bp, Homo sapiens
agcggagtgacgcgggcccgggcgcgacggtctcggcggcggcggcggcggcgacagagcgagcgcggcgcggggccaccatgggggcccagctcagcacgttgggccatatggtgctcttcccagtctggttcctgtacagtctgctcatgaagctgttccagcgctccacgccagccatcaccctcgagagcccggacatcaagtacccgctgcggctcatcgaccgggagatcatcagccatgacacccggcgcttccgctttgccctgccgtcaccccagcacatcctgggcctccctgtcggccagcacatctacctctcggctcgaattgatggaaacctggtcgtccggccctatacacccatctccagcgatgatgacaagggcttcgtggacctggtcatcaaggtttacttcaaggacacccatcccaagtttcccgctggagggaagatgtctcagtacctggagagcatgcagattggagacaccattgagttccggggccccagtgggctgctggtctaccagggcaaagcatccctgatggcagaactcccacaaccacatgtatttattcctctgtcctaaaccgtcccctccttccctcacccccagcacagggggattctgagcagtgcctcttgtctgagggacatatcagtgacctcgacgttgcctttagactacagttgtgttagcctcttgcgtattggctttttcagagtcatttatgagcagaaaaaaaaaaagtaaaactttgctaatattaa

SEQ ID NO: 456764 - DNA, 928 bp, Homo sapiens
atcctcggaatagtacttgccccagggagtttccagaagggaccaggggctgtgaaaagtctaccaagggcctggttagctagggaagggctcatcagggaagatttgatgtttgagctaggctctgaggaatgaataggagtttgctggttggatgcatgcagagcaaggacatttggggcagagaggagagcatatgcgaacgcctgaagcaagatgggcttgatgttgaaagagcagagagctgggagttgggccatatggtgctcttcccagtctggttcctgtacagtctgctcatgaagctgttccagcgctccacgccagccatcaccctcgagagcccggacatcaagtacccgctgcggctcatcgaccgggagatcatcagccatgacacccggcgcttccgctttgccctgccgtcaccccagcacatcctgggcctccctgtcggccagcacatctacctctcggctcgaattgatggaaacctggtcgtccggccctatacacccatctccagcgatgatgacaagggcttcgtggacctggtcatcaaggtttacttcaaggacacccatcccaagtttcccgctggagggaagatgtctcagtacctggagagcatgcagattggagacaccattgagttccggggccccagtgggctgctggtctaccagggcaaagcatccctgatggcagaactcccacaaccacatgtatttattcctctgtcctaaaccgtcccctccttccctcacccccagcacagggggattctgagcagtgcctcttgtctgagggacatatcagtgacctcgacgttgcctttagactacagttgtgttagcctcttgcgtattggctttttcagagtcatttatgagcagaaaaaaaaaaagtaaaactttgctaatattaa

SEQ ID NO: 456765 - DNA, 887 bp, Homo sapiens
gatacgactcgagctctgtaccctagtatgaggagcgttatggagtggaagtgaaatacatggcagcccactgcaccgcctcagggttttggggtcctgggctggggccaccatccctgatggcagaactcccacaaccacatgtatttattcctctgtcctaaaccgtcccctccttccctcacccccagcacagggggattctgagcagtgcctcttgtctgagggacatatcagtgacctcgacgttgcctttagactacagttgtgttagcctcttgcgtattggctttttcagagtcatttatgagcagaaaaaaaaaaagtaaaactttgctaatattaaaaaaaaaaaaaaaaaaaaaaaaaaaagggggcggcgcgcgcgcccataaaggattctcccctcgggggcgcccaagtctttccgcgcgttccccggttttctttgttccaaggggggcccctatatatagggggggccggatttttattagcgcgcttagggcccgtgcgccggccggttttacacaacacggttcgggcgactggggagaaccacctctcgcttaccttggggaactctttcggggagagggagaccctttttcttctccggggggcggggcgaccatttcttttgggcgcccacaattataccctttaaacagagagagtttatataaaggcctctatagaggggtgacaattttataaacaattttctttaaaacgggtgttaataccgggtgtgttttaacacctattaggcggcaattttgccctggacgggctttgagagaagtttcgggcctaaccgggagaatagtgaactttctgtggaacatttttttttttccccgggggaccctggttgttaaaataac

SEQ ID NO: 456766 - DNA, 831 bp, Homo sapiens
agcggagtgacgcgggcccgggcgcgacggtctcggcggcggcggcggcggcgacagagcgagcgcggcgcggggccaccatgggggcccagctcagcacgttgggccatatggtgctcttcccagtctggttcctgtacagtctgctcatgaagctgttccagcgctccacgccagccatcaccctcgagagcccggacatcaagtacccgctgcggctcatcgaccgggagatcatcagccatgacacccggcgcttccgctttgccctgccgtcaccccagcacatcctgggcctccctgtcggccagcacatctacctctcggctcgaattgatggaaacctggtcgtccggccctatacacccatctccagcgatgatgacaagggcttcgtggacctggtcatcaaggtttacttcaaggacacccatcccaagtttcccgctggagggaagatgtctcagtacctggagagcatgcagattggagacaccattgagttccggggccccagtgggctgctggtctaccagggcaaagtgattcgggtcggaatcccttggttacacggcaggctcagagaattggagagcttgggcgtgctgggtgcagggtgcaggcccctggctctgtgtggatgggtgactctcgtcaggccagctgtccctctctgggaactgagtctccctggctgtagagggggtaagttgctggcacaggggttgcagacaggccactcctgggggccacgtctcacccactgccagcctctatttggctttctcagcatctgaaacaagcaagcaagaggacagagctgagcctccg

SEQ ID NO: 456767 - DNA, 431 bp, Homo sapiens
tggctagagtgggaagagggggctggccatggggccctcccagaacctcagcatttcctttcagctgtcctcatgacccctcgtccaccccccacacacactataaggctgagggctgccagcagccccgtctgcccaccattcccggccgtggaccatagtcgggatgtcagcagacacacatgggcagcccaaagctgcaggtgccagggcccaccccagcctcgcctgtcacccccactcccgcctcagggccaggcccaggcctcaccacctgacgctgcatgagacattgacaccagaaagctgagggacatatcagtgacctcgacgttgcctttagactacagttgtgttagcctcttgcgtattggctttttcagagtcatttatgagcagaaaaaaaaaaagtaaaactttgctaatattaa

SEQ ID NO: 456768 - DNA, 1841 bp, Homo sapiens
agcggagtgacgcgggcccgggcgcgacggtctcggcggcggcggcggcggcgacagagcgagcgcggcgcggggccaccatgggggcccagctcagcacgttgggccatatggtgctcttcccagtctggttcctgtacagtctgctcatgaagctgttccagcgctccacgccagccatcaccctcgagagcccggacatcaagtacccgctgcggctcatcgaccgggagatcatcagccatgacacccggcgcttccgctttgccctgccgtcaccccagcacatcctgggcctccctgtcggccagcacatctacctctcggctcgaattgatggaaacctggtcgtccggccctatacacccatctccagcgatgatgacaagggcttcgtggacctggtcatcaaggtttacttcaaggacacccatcccaagtttcccgctggagggaagatgtctcagtacctggagagcatgcagattggagacaccattgagttccggggccccagtgggctgctggtctaccagggcaaagggaagttcgccatccgacctgacaaaaagtccaaccctatcatcaggacagtgaagtctgtgggcatgatcgcgggagggacaggcatcaccccgatgctgcaggtgatccgcgccatcatgaaggaccctgatgaccacactgtgtgccacctgctctttgccaaccagaccgagaaggacatcctgctgcgacctgagctggaggaactcaggaacaaacattctgcacgcttcaagctctggtacacgctggacagagcccctgaagcctgggactacggccagggcttcgtgaatgaggagatgatccgggaccaccttccacccccagaggaggagccgctggtgctgatgtgtggccccccacccatgatccagtacgcctgccttcccaacctggaccacgtgggccaccccacggagcgctgcttcgtcttctgagggccgggcacggtcacacggccacccgccccgcgcaccccacgccctgttcacgctcacccagtcacctccccacatcgcacactggggccccgggttcagcctggcctgcccgtgccctggtgaatcacctggctgagcagttcccctggagccccttcgggagcagggctgtgtcccagatgggccacggctgagccttcagagtacgtcctgcctggcacttactggtccttaccagagacgcccagccccatccctgtcctcatgacccctcgtccaccccccacacacactataaggctgagggctgccagcagccccgtctgcccaccattcccggccgtggaccatagtcgggatgtcagcagacacacatgggcagcccaaagctgcaggtgccagggcccaccccagcctcgcctgtcacccccactcccgcctcagggccaggcccaggcctcaccacctgacgctgcatgagacattgacaccagaaagccctcttgggggcactgctccctaccccagggccctggccagccgggagcttggctctcctctggctagagtgggaagagggggctggccatggggccctcgtcctgggctggggccaccatccctgatggcagaactcccacaaccacatgtatttattcctctgtcctaaaccgtcccctccttccctcacccccagcacagggggattctgagcagtgcctcttgtctgagggacatatcagtgacctcgacgttgcctttagactacagttgtgttagcctcttgcgtattggctttttcagagtcatttatgagcagaaaaaaaaaaagtaaaactttgctaatattaa

SEQ ID NO: 456769 - DNA, 1707 bp, Homo sapiens
agcggagtgacgcgggcccgggcgcgacggtctcggcggcggcggcggcggcgacagagcgagcgcggcgcggggccaccatgggggcccagctcagcacgttgggccatatggtgctcttcccagtctggttcctgtacagtctgctcatgaagctgttccagcgctccacgccagccatcaccctcgagagcccggacatcaagtacccgctgcggctcatcgaccgggagatcatcagccatgacacccggcgcttccgctttgccctgccgtcaccccagcacatcctgggcctccctgtcggccagcacatctacctctcggctcgaattgatggaaacctggtcgtccggccctatacacccatctccagcgatgatgacaagggcttcgtggacctggtcatcaaggtttacttcaaggacacccatcccaagtttcccgctggagggaagatgtctcagtacctggagagcatgcagattggagacaccattgagttccggggccccagtgggctgctggtctaccagggcaaagggaagttcgccatccgacctgacaaaaagtccaaccctatcatcaggacagtgaagtctgtgggcatgatcgcgggagggacaggcatcaccccgatgctgcaggtgatccgcgccatcatgaaggaccctgatgaccacactgtgtgccacctgctctttgccaaccagaccgagaaggacatcctgctgcgacctgagctggaggaactcaggaacaaacattctgcacgcttcaagctctggtacacgctggacagagcccctgaagcctgggactacggccagggcttcgtgaatgaggagatgatccgggaccaccttccacccccagaggaggagccgctggtgctgatgtgtggccccccacccatgatccagtacgcctgccttcccaacctggaccacgtgggccaccccacggagcgctgcttcgtcttctgagggccgggcacggtcacacggccacccgccccgcgcaccccacgccctgttcacgctcacccagtcacctccccacatcgcacactggggccccgggttcagcctggcctgcccgtgccctggtgaatcacctggctgagcagttcccctggagccccttcgggagcagggctgtgtcccagatgggccacggctgagccttcagagtacgtcctgcctggcacttactggtccttaccagagacgcccagccccatccctgtcctcatgacccctcgtccaccccccacacacactataaggctgagggctgccagcagccccgtctgcccaccattcccggccgtggaccatagtcgggatccagaacctcagcatttccttccagcccatccaaacactgaggcagccttggggaaccccgagctggggggttggcagcccactgcaccgcctcagggttttggggtcctgggctggggccaccatccctgatggcagaactcccacaaccacatgtatttattcctctgtcctaaaccgtcccctccttccctcacccccagcacagggggattctgagcagtgcctcttgtctgagggacatatcagtgacctcgacgttgcctttagactacagttgtgttagcctcttgcgtattggctttttcagagtcatttatgagcagaaaaaaaaaaagtaaaactttgctaatattaa

SEQ ID NO: 456770 - DNA, 1959 bp, Homo sapiens
agcggagtgacgcgggcccgggcgcgacggtctcggcggcggcggcggcggcgacagagcgagcgcggcgcggggccaccatgggggcccagctcagcacgttgggccatatggtgctcttcccagtctggttcctgtacagtctgctcatgaagctgttccagcgctccacgccagccatcaccctcgagagcccggacatcaagtacccgctgcggctcatcgaccgggagatcatcagccatgacacccggcgcttccgctttgccctgccgtcaccccagcacatcctgggcctccctgtcggccagcacatctacctctcggctcgaattgatggaaacctggtcgtccggccctatacacccatctccagcgatgatgacaagggcttcgtggacctggtcatcaaggtttacttcaaggacacccatcccaagtttcccgctggagggaagatgtctcagtacctggagagcatgcagattggagacaccattgagttccggggccccagtgggctgctggtctaccagggcaaagggaagttcgccatccgacctgacaaaaagtccaaccctatcatcaggacagtgaagtctgtgggcatgatcgcgggagggacaggcatcaccccgatgctgcaggtgatccgcgccatcatgaaggaccctgatgaccacactgtgtgccacctgctctttgccaaccagaccgagaaggacatcctgctgcgacctgagctggaggaactcaggaacaaacattctgcacgcttcaagctctggtacacgctggacagagcccctgaagcctgggactacggccagggcttcgtgaatgaggagatgatccgggaccaccttccacccccagaggaggagccgctggtgctgatgtgtggccccccacccatgatccagtacgcctgccttcccaacctggaccacgtgggccaccccacggagcgctgcttcgtcttctgagggccgggcacggtcacacggccacccgccccgcgcaccccacgccctgttcacgctcacccagtcacctccccacatcgcacactggggccccgggttcagcctggcctgcccgtgccctggtgaatcacctggctgagcagttcccctggagccccttcgggagcagggctgtgtcccagatgggccacggctgagccttcagagtacgtcctgcctggcacttactggtccttaccagagacgcccagccccatccctgtcctcatgacccctcgtccaccccccacacacactataaggctgagtgagggacatatcagtgacctcgacgttgcctttagactacagttgtgttagcctcttgcgtattggctttttcagagtcatttatgagcagaaaaaaaaaaagtaaaactttgctaatattaaaaaaaaaaaaaaaaaaaaaaaaaaaagggggcggcgcgcgcgcccataaaggattctcccctcgggggcgcccaagtctttccgcgcgttccccggttttctttgttccaaggggggcccctatatatagggggggccggatttttattagcgcgcttagggcccgtgcgccggccggttttacacaacacggttcgggcgactggggagaaccacctctcgcttaccttggggaactctttcggggagagggagaccctttttcttctccggggggcggggcgaccatttcttttgggcgcccacaattataccctttaaacagagagagtttatataaaggcctctatagaggggtgacaattttataaacaattttctttaaaacgggtgttaataccgggtgtgttttaacacctattaggcggcaattttgccctggacgggctttgagagaagtttcgggcctaaccgggagaatagtgaactttctgtggaacatttttttttttccccgggggaccctggttgttaaaataac

SEQ ID NO: 456771 - DNA, 2001 bp, Homo sapiens
gcgacagagcgatgcgcggcgtgtggccaccatgggggcccagctcagcacgttgggccatatggtgctcgttcgccagatcgtaggttccgtggtagcatgtctggcttcagtcgaagtgcgtcgttccatgctgcgtccaacgagctagcctattcagcccttcggacgaggcctcggacgattcagagtacctcgcatgctggcttcatcggaacccggggaacgaatttgattcacggtcctatttgaagcagcgccggggctggctttttccccgggctttatgtggcccgcctttgcccggtttcaaagccccccctgaggggcaaccatttccttgggggccctcccctgtcgggccagcacatctacctctcggctcgaattgatggaaacctggtcgtccggccctatacacccatctccagcgatgatgacaagggcttcgtggacctggtcatcaaggtttacttcaaggacacccatcccaagtttcccgctggagggaagatgtctcagtacctggagagcatgcagattggagacaccattgagttccggggccccagtgggctgctggtctaccagggcaaagggaagttcgccatccgacctgacaaaaagtccaaccctatcatcaggacagtgaagtctgtgggcatgatcgcgggagggacaggcatcaccccgatgctgcaggtgatccgcgccatcatgaaggaccctgatgaccacactgtgtgccacctgctctttgccaaccagaccgagaaggacatcctgctgcgacctgagctggaggaactcaggaacaaacattctgcacgcttcaagctctggtacacgctggacagagcccctgaagcctgggactacggccagggcttcgtgaatgaggagatgatccgggaccaccttccacccccagaggaggagccgctggtgctgatgtgtggccccccacccatgatccagtacgcctgccttcccaacctggaccacgtgggccaccccacggagcgctgcttcgtcttctgagggccgggcacggtcacacggccacccgccccgcgcaccccacgccctgttcacgctcacccagtcacctccccacatcgcacactggggccccgggttcagcctggcctgcccgtgccctggtgaatcacctggctgagcagttcccctggagccccttcgggagcagggctgtgtcccagatgggccacggctgagccttcagagtacgtcctgcctggcacttactggtccttaccagagacgcccagccccatccctgtcctcatgacccctcgtccaccccccacacacactataaggctgagggctgccagcagccccgtctgcccaccattcccggccgtggaccatagtcgggatgtcagcagacacacatgggcagcccaaagctgcaggtgccagggcccaccccagcctcgcctgtcacccccactcccgcctcagggccaggcccaggcctcaccacctgacgctgcatgagacattgacaccagaaagccctcttgggggcactgctccctaccccagggccctggccagccgggagcttggctctcctctggctagagtgggaagagggggctggccatggggccctcccagaacctcagcatttccttccagcccatccaaacactgaggcagccttggggaaccccgagctggggggttggcagcccactgcaccgcctcagggttttggggtcctgggctggggccaccatccctgatggcagaactcccacaaccacatgtatttattcctctgtcctaaaccgtcccctccttccctcacccccagcacagggggattctgagcagtgcctcttgtctgagggacatatcagtgacctcgacgttgcctttagactacagttgtgttagcctcttgcgtattggctttttcagagtcatttatgagcagaaaaaaaaaaagtaaaactttgctaatattaa

SEQ ID NO: 456772 - DNA, 1646 bp, Homo sapiens
agcggagtgacgcgggcccgggcgcgacggtctcggcggcggcggcggcggcgacagagcgagcgcggcgcggggccaccatgggggcccagctcagcacgttgggccatatggtgctcttcccagtctggttcctgtacagtctgctcatgaagctgttccagcgctccacgccagccatcaccctcgagagcccggacatcaagtacccgctgcggctcatcgaccgggagatcatcagccatgacacccggcgcttccgctttgccctgccgtcaccccagcacatcctgggcctccctgtcggccagcacatctacctctcggctcgaattgatggaaacctggtcgtccggccctatacacccatctccagcgatgatgacaagggcttcgtggacctggtcatcaagaccgagaaggacatcctgctgcgacctgagctggaggaactcaggaacaaacattctgcacgcttcaagctctggtacacgctggacagagcccctgaagcctgggactacggccagggcttcgtgaatgaggagatgatccgggaccaccttccacccccagaggaggagccgctggtgctgatgtgtggccccccacccatgatccagtacgcctgccttcccaacctggaccacgtgggccaccccacggagcgctgcttcgtcttctgagggccgggcacggtcacacggccacccgccccgcgcaccccacgccctgttcacgctcacccagtcacctccccacatcgcacactggggccccgggttcagcctggcctgcccgtgccctggtgaatcacctggctgagcagttcccctggagccccttcgggagcagggctgtgtcccagatgggccacggctgagccttcagagtacgtcctgcctggcacttactggtccttaccagagacgcccagccccatccctgtcctcatgacccctcgtccaccccccacacacactataaggctgagggctgccagcagccccgtctgcccaccattcccggccgtggaccatagtcgggatgtcagcagacacacatgggcagcccaaagctgcaggtgccagggcccaccccagcctcgcctgtcacccccactcccgcctcagggccaggcccaggcctcaccacctgacgctgcatgagacattgacaccagaaagccctcttgggggcactgctccctaccccagggccctggccagccgggagcttggctctcctctggctagagtgggaagagggggctggccatggggccctcccagaacctcagcatttccttccagcccatccaaacactgaggcagccttggggaaccccgagctggggggttggcagcccactgcaccgcctcagggttttggggtcctgggctggggccaccatccctgatggcagaactcccacaaccacatgtatttattcctctgtcctaaaccgtcccctccttccctcacccccagcacagggggattctgagcagtgcctcttgtctgagggacatatcagtgacctcgacgttgcctttagactacagttgtgttagcctcttgcgtattggctttttcagagtcatttatgagcagaaaaaaaaaaagtaaaactttgctaatattaa

SEQ ID NO: 456773 - DNA, 1003 bp, Homo sapiens
tccgccgcctcgaggcagacccggatccagagggcgcctggacaagttgggccatatggtgctcttcccagtctggttcctgtacagtctgctcatgaagctgttccagcgctccacgccagccatcaccctcgcccgggttcagcctggcctgcccgtgccctggtgaatcacctggctgagcagttcccctggagccccttcgggagcagggctgtgtcccagatgggccacggctgagccttcagagtacgtcctgcctggcacttactggtccttaccagagacgcccagccccatccctgtcctcatgacccctcgtccaccccccacacacactataaggctgagggctgccagcagccccgtctgcccaccattcccggccgtggaccatagtcgggatgtcagcagacacacatgggcagcccaaagctgcaggtgccagggcccaccccagcctcgcctgtcacccccactcccgcctcagggccaggcccaggcctcaccacctgacgctgcatgagacattgacaccagaaagccctcttgggggcactgctccctaccccagggccctggccagccgggagcttggctctcctctggctagagtgggaagagggggctggccatggggccctcccagaacctcagcatttccttccagcccatccaaacactgaggcagccttggggaaccccgagctggggggttggcagcccactgcaccgcctcagggttttggggtcctgggctggggccaccatccctgatggcagaactcccacaaccacatgtatttattcctctgtcctaaaccgtcccctccttccctcacccccagcacagggggattctgagcagtgcctcttgtctgagggacatatcagtgacctcgacgttgcctttagactacagttgtgttagcctcttgcgtattggctttttcagagtcatttatgagcagaaaaaaaaaaagtaaaactttgctaatattaa

SEQ ID NO: 456774 - DNA, 458 bp, Homo sapiens
agcggagtgacgcgggcccgggcgcgacggtctcggcggcggcggcggcggcgacagagcgagcgcggcgcggggccaccatgggggcccagctcagcacgttgggccatatggtgctcttcccagtctggttcctgtacagtctgctcatgaagctgttccagcgctccacgccagccatcaccctcgagagcccggacatcaagtacccgctgcggctcatcgaccgggagatggagaaagcaaggtgatgtctcttgctaaggccaccaggaagtagcagaggaatttaaacctggtctctctgtccacagagccccttctctgaaccacactcactgcctcatgcaagatcatcagccatgacacccggcgcttccgctttgccctgccgtcaccccagcacatcctgggcctccctgtcggccagtatggttaatcctggagagtcgaccgcg

SEQ ID NO: 456775 - DNA, 388 bp, Homo sapiens
ggaccaggacctttataaggtggaaggcttgatgtcctccccagactcagctcctggtgaagctcccagccatcagccatgagggtcttgtatctcctcttctcgttcctcttcatattcctgatgcctcttccaggtgtttttggtggtataggcgatcctgttacctgccttaagagtggagccatatgtcatccagtcttttgccctagaaggtataaacaaattggcacctgtggtctccctggaacaaaatgctgcaaaaagccatgaggaggccaagaagctgctgtggctgatgcggattcagaaagggctccctcatcagagacgtgcgacatgtaaaccaaattaaactatggcgtccaaagatacgcaatctttatcc

SEQ ID NO: 456776 - DNA, 3481 bp, Homo sapiens
cgggaagcttctcagatggctcccaccctgaaagccacatgcccagccctctgggccgagcccgcccagcctggcttcccatgtgttccctgccccactcccaggtagcaacatgccgccatcctccgcacaccccaaatggcatgtgtctgccacaagctgctgttctcatctctagaggggccaggccctccctgccaccctgtgctgcaagacctgtttgtggtctctgcccccaaaggcagggacttcctccattgtttccacattcccagccctcctgcaggcttgtaggacactgtaaggacattgggtcgcagcaccacagactgactgctttggccaattaaagtacaggagcattggctggcaggttctcggcctccttccacagagctggcaccagggtctctgcagggatccagatgacgggagccaaatgagtatccctcactctgcgacctcagctgcacgttgaggacagaggctcccccacgcccatcctgggaaggggcccggagtgtgagagagaggctcccccacgcccatcctgggaaggggcccggagtgtgagagagaggctcccccacgcccatcctgggaaggggcccggagtgtgagagagaggctcccccacgcccatcctgggaaggggcccggagtgtgagagagaggctcccccacgcccatcctgggaaggggcccggagtgtgagagagaggctcccccacgcccatcctgggaaggggcccggagtgtgagagagagactcccccacgcccatcctggaaaggagcccggagtgtgagctgagtggtccgagctatacctgtggacattggtttctccattgaagagctggaggacctttacatggtgtttaaggccaagcacctggctagccagtactgggggtgcagccgcacaatggccggccgtcgggaccccagcctgccctacctggagcagtaccggattgatgccagccagttccgggaactctttgccagcctgacaccctgggcctgtggctcccacacacctctgctggcagggcgcatgttcaggctcctggacgaaaacaaggactcgctgatcaacttcaaggagttcgtgacagggatgagcgggatgtaccacggggacctgacagagaagctcaaggtgctctacaagctacaccttcccccagctctgagcccagaggaagccgagtcagccctggaggcggcccattatttcacagaggacagctcctcagaagaagcactaccacaggaagagcaagaaggaagtggaagtgaggagagaggagaggagaaggggaccagctctccggactatcggcactaccttcgaatgtgggccaaggagaaagaggctcagaaggagacgattaaggatcttcccaagatgaaccaggagcagttcattgagctgtgcaagacgctttacaacatgttcagtgaagaccccatggagcaggacctgtaccacgccatcgccaccgtggccagcctcctgctccgcatcggagaggtggggaagaagttctcagcccgcacaggcaggaagcccagggactgtgccactgaggaggacgagccaccagcacccgaactgcatcaggacgcagccagggagcttcagcccccagctgcaggagacccccaagccaaagcaggcggagacacacacctcggaacagccccacaggagagccaggtggtggtggaggggggcagcggcgagggacagggctcaccctcccagctgctgtctgacgatgaaaccaaagacgacatgtccatgtcctcctactcggtggtcagcacgggctccctgcaatgtgaagaccttgcagacgacacggtgctggtgggcggggaggcctgcagccccacagcgcgcatcggcggcaccgtcgacaccgactggtgcatctcctttgagcagatcctggcctccatcctgacggagtccgtgctggtgaacttctttgagaagagagtggacattggactcaagatcaaggaccaaaagaaagtggagagacagttcagcaccgccagtgaccatgagcagcctggagtttccggctgatgcctgcagctgtgaggcctggcccaaggtgtcatcagtggggctggcctcatctcctcctgcctttcctcccttatcagtttctctttaaaggtgtgcccctcctgctctcccaggagcagtgagttgtgagtggaaagaaggctggtgcagacccagctgccttagacagattccctgggcctgcatctcctggcgccggctgcttctgggcccaggaagaggctgtggctcccaccttccttacacctggtgggagcccgcctcgcaccagctgcacctgcctagcattagaggctctcagatctgcccttgcttgcctcatacctctgtgctccacactgcggccaggccagctgagtccctccatccgtggatgctttcctgcagctatgtggtatgggggtcattcctgcctcttgggcaccaggttggggggcatgtgcttgttgggcaccaaagtgatggaaccctcaggtgctctccgggagcctgaacctcctgactgaggaacatgggcagaacatgtttattgcacagagtgggcgctgcgcacaggcgtggctgtacacgtgctctcagctcatcatcctttccagtaactttaaaaaaacatccctcaggtcctgatatatttccttggattcatttcacttggctagaaattacactgtgctcaatgccttaataaatccctgaaagaaataaaaaccactgtgtgcaatgccttgctgtggcccccaaccactgcttaggcctcccaacttctccccaggccaagtatggggccctggctgtgttctggaagttcaagacacttagtcctccacagtgggtggaagagtgcaaggtctgccaggtcagatggagacgcagaacctgctggtgcaagctgggcaggtcctgaccaacctgcatcaggggatgccctgagctccacaggtcttcatgggcaggggttgtgggtcctggtgaaggaagtgcatcctcaggcctgggctgtagcaagctgtctgcccttgggttcaagaaccagactgtggagccaaaggtgaccgcagggggccccagggctggagccacaaggataccctcactttgcatgaggagctgaaactgaccagtgtccagtgttagcccccacatggggctgctcttgcttctactaaaagatacagcagttacccccttatccacaggggatacagtggatatctaaaaccagacccccagtggatgtctaaaaccacagataataacaaaccttatacatactgttttttcctatgcatacatacctgtgattaagtttatgaattaggcaccttaagagattgacaacaataactaataataaaatgtaacggttatactgtaa

SEQ ID NO: 456777 - DNA, 5191 bp, Homo sapiens
cgccgacggcggcgggcgcttccgcctcgcgggcctcggcccggtgcgagcggctccgcgatgtggctgagcccggaggaggtgctggtggccaatgcgctgtgggtgacggagcgggccaaccccttcttcgtgctgcagcgacgccggggccacggcaggggcggcggccttacgggtcttctcgtgggcaccctggacgtggtgctggactccagtgcccgcgtggccccttaccgcatcctgcaccagacccaggactcccaggtctactggacagtggcgtgtggttcttcccgcaaagagatcacaaaacactgggaatggctggaaaataacttgctccagacactgtccatcttcgacagtgaggaagatatcaccaccttcgtcaagggcaagatacacggaatcatcgcagaagagaacaagaacctgcagccccagggagacgaggaccccgggaagttcaaggaggctgagctgaagatgcggaagcagtttgggatgcctgagggcgagaagctggtgaattactactcctgcagctactggaagggccgcgtgccccggcagggctggctgtacctgacggtcaaccacctgtgcttctactccttcctgctggggaaggaagtgagcctcgtggtgcagtgggtggacataacgcgtctggagaagaacgccaccctgctcttccccgagagcatccgtgtggacacccgcgaccaggagctcttcttctccatgttcctcaacatcggcgagaccttcaagctcatggagcagttggccaacctggccatgcggcagctgctggacagcgagggcttcctggaggacaaggccctgcctaggcccatccggccacacaggaacatctcagccctgaagcgagacctggacgcccgagccaagaatgagtgctaccgagccacgttccggctgcccagggatgagcggctagacggccacacaagctgcaccctgtggacgccgttcaacaagctgcacatccctggccagatgttcatctccaacaactacatctgcttcgccagcaaggaggaggacgcttgccacctcatcatacccctgagggaggtgaccattgtcgaaaaagctgacagctccagcgtgctgcccagccccctgtccatcagcaccaaaagcaaaatgacattcctgtttgccaacctgaaagaccgtgatttcttggtgcagaggatctctgacttcctccagaaaacaccatccaagcagccaggcagtatcgggagcaggaaagccagtgttgtggaccctagcacagagtcttccccagctcctcaggaggggtcggagcagcccgccagcccagcctctcccctcagcagccgccagagcttctgtgcgcaggaggcgccaaccgcatcccagggcctgctgaagctcttccagaaaaactcgcccatggaggaccttggagccaagggggccaaggagaagatgaaagaggagtcatggcacatccacttcttcgagtacgggcgtggcgtgtgcatgtaccgcacagccaagacgcgggcactggtcctgaagggtatccctgagagcctccggggagagctgtggctcctcttctccggggcctggaatgagatggtgactcaccccgggtactatgctgagctggtggagaagtccaccgggaagtacagcctggccacagaggagatcgagcgagacctgcaccgctccatgcccgagcaccctgccttccagaacgagctggggattgctgccctccggcgggtgctgactgcctatgccttccgaaaccccaccatcggctactgccaggcaatgaacatcgtgacctcggtgctcctgctctatggcagtgaggaggaggccttctggctcctggtggccctgtgcgagcgcatgctgcccgactactacaacaccagggtggtgggagccctggtggaccaaggcatcttcgaagagctcacgagagacttcctgccgcagctctcggagaagatgcaggacctgggggtgatctccagcatctcgctgtcctggttcctgaccctcttcctcagcgtcatgcccttcgagagcgccgtggtcatcgtcgactgctttttctatgagggcatcaaggtgatcctgcaggtggccctggccgtcctggacgccaacatggagcagctgctgggctgcagcgacgagggcgaggccatgaccatgctgggcagatacctggataatgtggtcaacaagcagagtgtctctcctcctatcccgcacctccgtgccttgctgagcagcagcgatgacccccctgcagaggtggacatctttgagctcctgaaagtgtcctatgagaaattcagcagcctgagggccgaagacattgagcagatgcggtttaaacagaggctgaaagtgatccagtccttggaggacacggccaagaggagtgtggtccgagctatacctgtggacattggtttctccattgaagagctggaggacctttacatggtgtttaaggccaagcacctggctagccagtactgggggtgcagccgcacaatggccggccgtcgggaccccagcctgccctacctggagcagtaccggattgatgccagccagttccgggaactctttgccagcctgacaccctgggcctgtggctcccacacacctctgctggcagggcgcatgttcaggctcctggacgaaaacaaggactcgctgatcaacttcaaggagttcgtgacagggatgagcgggatgtaccacggggacctgacagagaagctcaaggtgctctacaagctacaccttcccccagctctgagcccagaggaagccgagtcagccctggaggcggcccattatttcacagaggacagctcctcagaagcatctcctctggcctcagatctggatcttttcctgccctgggaggctcaagaagcactaccacaggaagagcaagaaggaagtggaagtgaggagagaggagaggagaaggggaccagctctccggactatcggcactaccttcgaatgtgggccaaggagaaagaggctcagaaggagacgattaaggatcttcccaagatgaaccaggagcagttcattgagctgtgcaagacgctttacaacatgttcagtgaagaccccatggagcaggacctgtaccacgccatcgccaccgtggccagcctcctgctccgcatcggagaggtggggaagaagttctcagcccgcacaggcaggaagcccagggactgtgccactgaggaggacgagccaccagcacccgaactgcatcaggacgcagccagggagcttcagcccccagctgcaggagacccccaagccaaagcaggcggagacacacacctcggaacagccccacaggagagccaggtggtggtggaggggggcagcggcgagggacagggctcaccctcccagctgctgtctgacgatgaaaccaaagacgacatgtccatgtcctcctactcggtggtcagcacgggctccctgcaatgtgaagaccttgcagacgacacggtgctggtgggcggggaggcctgcagccccacagcgcgcatcggcggcaccgtcgacaccgactggtgcatctcctttgagcagatcctggcctccatcctgacggagtccgtgctggtgaacttctttgagaagagagtggacattggactcaagatcaaggaccaaaagaaagtggagagacagttcagcaccgccagtgaccatgagcagcctggagtttccggctgatgcctgcagctgtgaggcctggcccaaggtgtcatcagtggggctggcctcatctcctcctgcctttcctcccttatcagtttctctttaaaggtgtgcccctcctgctctcccaggagcagtgagttgtgagtggaaagaaggctggtgcagacccagctgccttagacagattccctgggcctgcatctcctggcgccggctgcttctgggcccaggaagaggctgtggctcccaccttccttacacctggtgggagcccgcctcgcaccagctgcacctgcctagcattagaggctctcagatctgcccttgcttgcctcatacctctgtgctccacactgcggccaggccagctgagtccctccatccgtggatgctttcctgcagctatgtggtatgggggtcattcctgcctcttgggcaccaggttggggggcatgtgcttgttgggcaccaaagtgatggaaccctcaggtgctctccgggagcctgaacctcctgactgaggaacatgggcagaacatgtttattgcacagagtgggcgctgcgcacaggcgtggctgtacacgtgctctcagctcatcatcctttccagtaactttaaaaaaacatccctcaggtcctgatatatttccttggattcatttcacttggctagaaattacactgtgctcaatgccttaataaatccctgaaagaaataaaaaccactgtgtgcaatgccttgctgtggcccccaaccactgcttaggcctcccaacttctccccaggccaagtatggggccctggctgtgttctggaagttcaagacacttagtcctccacagtgggtggaagagtgcaaggtctgccaggtcagatggagacgcagaacctgctggtgcaagctgggcaggtcctgaccaacctgcatcaggggatgccctgagctccacaggtcttcatgggcaggggttgtgggtcctggtgaaggaagtgcatcctcaggcctgggctgtagcaagctgtctgcccttgggttcaagaaccagactgtggagccaaaggtgaccgcagggggccccagggctggagccacaaggataccctcactttgcatgaggagctgaaactgaccagtgtccagtgttagcccccacatggggctgctcttgcttctactaaaagatacagcagttacccccttatccacaggggatacagtggatatctaaaaccagacccccagtggatgtctaaaaccacagataataacaaaccttatacatactgttttttcctatgcatacatacctgtgattaagtttatgaattaggcaccttaagagattgacaacaataactaataataaaatgtaacggttatactgtaa

SEQ ID NO: 456778 - DNA, 2837 bp, Homo sapiens
cgagctcgggtacccgttctaatacgactcactgttgccttcgccgctgtctgcgttagagggcggtgtcacacccttgcccttgtctgccgaggatgctctcacagagtgccgtacttctgtgccaggagcttgtgatccagctatataccctgtttctccttccttctaggtccgagctatacctgtggacattggtttctccattgaagagctggaggacctttacatggtgtttaaggccaagcacctggctagccagtactgggggtgcagccgcacaatggccggccgtcgggaccccagcctgccctacctggagcagtaccggattgatgccagccagttccgggaactctttgccagcctgacaccctgggcctgtggctcccacacacctctgctggcagggcgcatgttcaggctcctggacgaaaacaaggactcgctgatcaacttcaaggagttcgtgacagggatgagcgggatgtaccacggggacctgacagagaagctcaaggtgctctacaagctacaccttcccccagctctgagcccagaggaagccgagtcagccctggaggcggcccattatttcacagaggacagctcctcagaagaagcactaccacaggaagagcaagaaggaagtggaagtgaggagagaggagaggagaaggggaccagctctccggactatcggcactaccttcgaatgtgggccaaggagaaagaggctcagaaggagacgattaaggatcttcccaagatgaaccaggagcagttcattgagctgtgcaagacgctttacaacatgttcagtgaagaccccatggagcaggacctgtaccacgccatcgccaccgtggccagcctcctgctccgcatcggagaggtggggaagaagttctcagcccgcacaggcaggaagcccagggactgtgccactgaggaggacgagccaccagcacccgaactgcatcaggacgcagccagggagcttcagcccccagctgcaggagacccccaagccaaagcaggcggagacacacacctcggaacagccccacaggagagccaggtggtggtggaggggggcagcggcgagggacagggctcaccctcccagctgctgtctgacgatgaaaccaaagacgacatgtccatgtcctcctactcggtggtcagcacgggctccctgcaatgtgaagaccttgcagacgacacggtgctggtgggcggggaggcctgcagccccacagcgcgcatcggcggcaccgtcgacaccgactggtgcatctcctttgagcagatcctggcctccatcctgacggagtccgtgctggtgaacttctttgagaagagagtggacattggactcaagatcaaggaccaaaagaaagtggagagacagttcagcaccgccagtgaccatgagcagcctggagtttccggctgatgcctgcagctgtgaggcctggcccaaggtgtcatcagtggggctggcctcatctcctcctgcctttcctcccttatcagtttctctttaaaggtgtgcccctcctgctctcccaggagcagtgagttgtgagtggaaagaaggctggtgcagacccagctgccttagacagattccctgggcctgcatctcctggcgccggctgcttctgggcccaggaagaggctgtggctcccaccttccttacacctggtgggagcccgcctcgcaccagctgcacctgcctagcattagaggctctcagatctgcccttgcttgcctcatacctctgtgctccacactgcggccaggccagctgagtccctccatccgtggatgctttcctgcagctatgtggtatgggggtcattcctgcctcttgggcaccaggttggggggcatgtgcttgttgggcaccaaagtgatggaaccctcaggtgctctccgggagcctgaacctcctgactgaggaacatgggcagaacatgtttattgcacagagtgggcgctgcgcacaggcgtggctgtacacgtgctctcagctcatcatcctttccagtaactttaaaaaaacatccctcaggtcctgatatatttccttggattcatttcacttggctagaaattacactgtgctcaatgccttaataaatccctgaaagaaataaaaaccactgtgtgcaatgccttgctgtggcccccaaccactgcttaggcctcccaacttctccccaggccaagtatggggccctggctgtgttctggaagttcaagacacttagtcctccacagtgggtggaagagtgcaaggtctgccaggtcagatggagacgcagaacctgctggtgcaagctgggcaggtcctgaccaacctgcatcaggggatgccctgagctccacaggtcttcatgggcaggggttgtgggtcctggtgaaggaagtgcatcctcaggcctgggctgtagcaagctgtctgcccttgggttcaagaaccagactgtggagccaaaggtgaccgcagggggccccagggctggagccacaaggataccctcactttgcatgaggagctgaaactgaccagtgtccagtgttagcccccacatggggctgctcttgcttctactaaaagatacagcagttacccccttatccacaggggatacagtggatatctaaaaccagacccccagtggatgtctaaaaccacagataataacaaaccttatacatactgttttttcctatgcatacatacctgtgattaagtttatgaattaggcaccttaagagattgacaacaataactaataataaaatgtaacggttatactgtaa

SEQ ID NO: 456779 - DNA, 5243 bp, Homo sapiens
cgccgacggcggcgggcgcttccgcctcgcgggcctcggcccggtgcgagcggctccgcgatgtggctgagcccggaggaggtgctggtggccaatgcgctgtgggtgacggagcgggccaaccccttcttcgtgctgcagcgacgccggggccacggcaggggcggcggccttacgggtcttctcgtgggcaccctggacgtggtgctggactccagtgcccgcgtggccccttaccgcatcctgcaccagacccaggactcccaggtctactggacagtggcgtgtggttcttcccgcaaagagatcacaaaacactgggaatggctggaaaataacttgctccagacactgtccatcttcgacagtgaggaagatatcaccaccttcgtcaagggcaagatacacggaatcatcgcagaagagaacaagaacctgcagccccagggagacgaggaccccgggaagttcaaggaggctgagctgaagatgcggaagcagtttgggatgcctgagggcgagaagctggtgaattactactcctgcagctactggaagggccgcgtgccccggcagggctggctgtacctgacggtcaaccacctgtgcttctactccttcctgctggggaaggaagtgagcctcgtggtgcagtgggtggacataacgcgtctggagaagaacgccaccctgctcttccccgagagcatccgtgtggacacccgcgaccaggagctcttcttctccatgttcctcaacatcggcgagaccttcaagctcatggagcagttggccaacctggccatgcggcagctgctggacagcgagggcttcctggaggacaaggccctgcctaggcccatccggccacacaggaacatctcagccctgaagcgagacctggacgcccgagccaagaatgagtgctaccgagccacgttccggctgcccagggatgagcggctagacggccacacaagctgcaccctgtggacgccgttcaacaagctgcacatccctggccagatgttcatctccaacaactacatctgcttcgccagcaaggaggaggacgcttgccacctcatcatacccctgagggaggtgaccattgtcgaaaaagctgacagctccagcgtgctgcccagccccctgtccatcagcaccaaaagcaaaatgacattcctgtttgccaacctgaaagaccgtgatttcttggtgcagaggatctctgacttcctccagaaaacaccatccaagcagccaggcagtatcgggagcaggaaagccagtgttgtggaccctagcacagagtcttccccagctcctcaggaggggtcggagcagcccgccagcccagcctctcccctcagcagccgccagagcttctgtgcgcaggaggcgccaaccgcatcccagggcctgctgaagctcttccagaaaaactcgcccatggaggaccttggagccaagggggccaaggagaagatgaaagaggagtcatggcacatccacttcttcgagtacgggcgtggcgtgtgcatgtaccgcacagccaagacgcgggcactggtcctgaagggtatccctgagagcctccggggagagctgtggctcctcttctccggggcctggaatgagatggtgactcaccccgggtactatgctgagctggtggagaagtccaccgggaagtacagcctggccacagaggagatcgagcgagacctgcaccgctccatgcccgagcaccctgccttccagaacgagctggggattgctgccctccggcgggtgctgactgcctatgccttccgaaaccccaccatcggctactgccaggcaatgaacatcgtgacctcggtgctcctgctctatggcagtgaggaggaggccttctggctcctggtggccctgtgcgagcgcatgctgcccgactactacaacaccagggtggtgggagccctggtggaccaaggcatcttcgaagagctcacgagagacttcctgccgcagctctcggagaagatgcaggacctgggggtgatctccagcatctcgctgtcctggttcctgaccctcttcctcagcgtcatgcccttcgagagcgccgtggtcatcgtcgactgctttttctatgagggcatcaaggtgatcctgcaggtggccctggccgtcctggacgccaacatggagcagctgctgggctgcagcgacgagggcgaggccatgaccatgctgggcagatacctggataatgtggtcaacaagcagagtgtctctcctcctatcccgcacctccgtgccttgctgagcagcagcgatgacccccctgcagaggtggacatctttgagctcctgaaagtgtcctatgagaaattcagcagcctgagggccgaagacattgagcagatgcggtttaaacagaggctgaaagtgatccagtccttggaggacacggccaagaggagtgtggtccgagctatacctgtggacattggtttctccattgaagagctggaggacctttacatggtgtttaaggccaagcacctggctagccagtactgggggtgcagccgcacaatggccggccgtcgggaccccagcctgccctacctggagcagtaccggattgatgccagccagttccgggaactctttgccagcctgacaccctgggcctgtggctcccacacacctctgctggcagggcgcatgttcaggctcctggacgaaaacaaggactcgctgatcaacttcaaggagttcgtgacagggatgagcgggatgtaccacggggacctgacagagaagctcaaggtgctctacaagctacaccttcccccagctctgagcccagaggaagccgagtcagccctggaggcggcccattatttcacagaggacagctcctcagaagcatctcctctggcctcagatctggatcttttcctgccctgggaggctcaagaagcactaccacaggaagagcaagaaggaagtggaagtgaggagagaggagaggagaaggggaccagctctccggactatcggcactaccttcgaatgtgggccaaggagaaagaggctcagaaggagacgattaaggatcttcccaagatgaaccaggagcagttcattgagctgtgcaagacgctttacaacatgttcagtgaagaccccatggagcaggacctgtaccacgccatcgccaccgtggccagcctcctgctccgcatcggagaggtggggaagaagttctcagcccgcacaggcaggaagcccagggactgtgccactgaggaggacgagccaccagcacccgaactgcatcaggacgcagccagggagcttcagcccccagctgcaggagacccccaagccaaagcaggcggagacacacacctcggaacagccccacaggagagccaggtggtggtggaggggggcagcggcgagggacagggctcaccctcccagctgctgtctgacgatgaaaccaaagacgacatgtccatgtcctcctactcggtggtcagcacgggctccctgcaatgtgaagaccttgcagacgacacggtgctggtgggcggggaggcctgcagccccacagcgcgcatcggcggcaccgtcgacaccgactggtgcatctcctttgagcagatcctggcctccatcctgacggagtccgtgctggtgaacttctttgagaagagagtggacattggactcaagatcaaggaccaaaagaaagtggagagacagttcagcaccgccagtgaccatgagcagcctggagtttccggctgatgcctgcagctgtgaggcctggcccaaggtgtcatcagtggggctggcctcatctcctcctgcctttcctcccttatcagtttctctttaaaggtgtgcccctcctgctctcccaggagcagtgagttgtgagtggaaagaaggctggtgcagacccagctgccttagacagattccctgggcctgcatctcctggcgccggctgcttctgggcccaggaagaggctgtggctcccaccttccttacacctggtgggagcccgcctcgcaccagctgcacctgcctagcattagaggctctcagatctgcccttgcttgcctcatacctctgtgctccacactgcggccaggccagctgagtccctccatccgtggatgctttcctgcagctatgtggtatgggggtcattcctgcctcttgggcaccaggttggggggcatgtgcttgttgggcaccaaagtgatggaaccctcaggtgctctccgggagcctgaacctcctgactgaggaacatgggcagaacatgtttattgcacagagtgggcgctgcgcacaggcgtggctgtacacgtgctctcagctcatcatcctttccagtaactttaaaaaaacatccctcaggtcctgatatatttccttggattcatttcacttggctagaaattacactgtgctcaatgccttaataaatccctgaaagaaataaaaaccactgtgtgcaatgccttgctgtggcccccaaccactgcttaggcctcccaacttctccccaggccaagtatggggccctggctgtgttctggaagttcaagacacttagtcctccacagtgggtggaagagtgcaaggtctgccaggtcagatggagacgcagaacctgctggtgcaagctgggcaggtcctgaccaacctgcatcaggggatgccctgagctccacaggtcttcatgggcaggggttgtgggtcctggtgaaggaagtgcatcctcaggcctgggctgtagcaagctgtctgcccttgggttcaagaaccagactgtggagccaaaggtgaccgcagggggccccagggctggagccacaaggataccctcactttgcatgaggagctgaaactgaccagtgtccagtgttagcccccacatggggctgctcttgcttctactaaaagatacagcagttacccccttatccacaggggatacagtggatatctaaaaccagacccccagtggatgtctaaaaccacagataataacaaaccttatacatactgttttttcctatgcatacatacctgtgattaagtttatgaattaggcaccttaagagattgacaacaataactaataataaaatgtaacggttatactgtaaaaaaagaaaagaacagaagagaaaaagaacaggaaaaaaaacaacccaaagc

SEQ ID NO: 456780 - DNA, 5134 bp, Homo sapiens
cgccgacggcggcgggcgcttccgcctcgcgggcctcggcccggtgcgagcggctccgcgatgtggctgagcccggaggaggtgctggtggccaatgcgctgtgggtgacggagcgggccaaccccttcttcgtgctgcagcgacgccggggccacggcaggggcggcggccttacgggtcttctcgtgggcaccctggacgtggtgctggactccagtgcccgcgtggccccttaccgcatcctgcaccagacccaggactcccaggtctactggacagtggcgtgtggttcttcccgcaaagagatcacaaaacactgggaatggctggaaaataacttgctccagacactgtccatcttcgacagtgaggaagatatcaccaccttcgtcaagggcaagatacacggaatcatcgcagaagagaacaagaacctgcagccccagggagacgaggaccccgggaagttcaaggaggctgagctgaagatgcggaagcagtttgggatgcctgagggcgagaagctggtgaattactactcctgcagctactggaagggccgcgtgccccggcagggctggctgtacctgacggtcaaccacctgtgcttctactccttcctgctggggaaggaagtgagcctcgtggtgcagtgggtggacataacgcgtctggagaagaacgccaccctgctcttccccgagagcatccgtgtggacacccgcgaccaggagctcttcttctccatgttcctcaacatcggcgagaccttcaagctcatggagcagttggccaacctggccatgcggcagctgctggacagcgagggcttcctggaggacaaggccctgcctaggcccatccggccacacaggaacatctcagccctgaagcgagacctggacgcccgagccaagaatgagtgctaccgagccacgttccggctgcccagggatgagcggctagacggccacacaagctgcaccctgtggacgccgttcaacaagctgcacatccctggccagatgttcatctccaacaactacatctgcttcgccagcaaggaggaggacgcttgccacctcatcatacccctgagggaggtgaccattgtcgaaaaagctgacagctccagcgtgctgcccagccccctgtccatcagcaccaaaagcaaaatgacattcctgtttgccaacctgaaagaccgtgatttcttggtgcagaggatctctgacttcctccagaaaacaccatccaagcagccaggcagtatcgggagcaggaaagccagtgttgtggaccctagcacagagtcttccccagctcctcaggaggggtcggagcagcccgccagcccagcctctcccctcagcagccgccagagcttctgtgcgcaggaggcgccaaccgcatcccagggcctgctgaagctcttccagaaaaactcgcccatggaggaccttggagccaagggggccaaggagaagatgaaagaggagtcatggcacatccacttcttcgagtacgggcgtggcgtgtgcatgtaccgcacagccaagacgcgggcactggtcctgaagggtatccctgagagcctccggggagagctgtggctcctcttctccggggcctggaatgagatggtgactcaccccgggtactatgctgagctggtggagaagtccaccgggaagtacagcctggccacagaggagatcgagcgagacctgcaccgctccatgcccgagcaccctgccttccagaacgagctggggattgctgccctccggcgggtgctgactgcctatgccttccgaaaccccaccatcggctactgccaggcaatgaacatcgtgacctcggtgctcctgctctatggcagtgaggaggaggccttctggctcctggtggccctgtgcgagcgcatgctgcccgactactacaacaccagggtggtgggagccctggtggaccaaggcatcttcgaagagctcacgagagacttcctgccgcagctctcggagaagatgcaggacctgggggtgatctccagcatctcgctgtcctggttcctgaccctcttcctcagcgtcatgcccttcgagagcgccgtggtcatcgtcgactgctttttctatgagggcatcaaggtgatcctgcaggtggccctggccgtcctggacgccaacatggagcagctgctgggctgcagcgacgagggcgaggccatgaccatgctgggcagatacctggataatgtggtcaacaagcagagtgtctctcctcctatcccgcacctccgtgccttgctgagcagcagcgatgacccccctgcagaggtggacatctttgagctcctgaaagtgtcctatgagaaattcagcagcctgagggccgaagacattgagcagatgcggtttaaacagaggctgaaagtgatccagtccttggaggacacggccaagaggagtgtggtccgagctatacctgtggacattggtttctccattgaagagctggaggacctttacatggtgtttaaggccaagcacctggctagccagtactgggggtgcagccgcacaatggccggccgtcgggaccccagcctgccctacctggagcagtaccggattgatgccagccagttccgggaactctttgccagcctgacaccctgggcctgtggctcccacacacctctgctggcagggcgcatgttcaggctcctggacgaaaacaaggactcgctgatcaacttcaaggagttcgtgacagggatgagcgggatgtaccacggggacctgacagagaagctcaaggtgctctacaagctacaccttcccccagctctgagcccagaggaagccgagtcagccctggaggcggcccattatttcacagaggacagctcctcagaagcatctcctctggcctcagatctggatcttttcctgccctgggaggctcaagaagcactaccacaggaagagcaagaaggaagtggaagtgaggagagaggagaggagaaggggaccagctctccggactatcggcactaccttcgaatgtgggccaaggagaaagaggctcagaaggagacgattaaggatcttcccaagatgaaccaggagcagttcattgagctgtgcaagacgctttacaacatgttcagtgaagaccccatggagcaggacctgtaccacgccatcgccaccgtggccagcctcctgctccgcatcggagaggtggggaagaagttctcagcccgcacaggcaggaagcccagggactgtgccactgaggaggacgagccaccagcacccgaactgcatcaggacgcagccagggagcttcagcccccagctgcaggagacccccaagccaaagcaggcggagacacacacctcggaacagccccacaggagagccaggtggtggtggaggggggcagcggcgagggacagggctcaccctcccagctgctgtctgacgatgaaaccaaagacgacatgtccatgtcctcctactcggtggtcagcacgggctccctgcaatgtgaagaccttgcagacgacacggtgctggtgggcggggaggcctgcagccccacagcgcgcatcggcggcaccgtcgacaccgactggtgcatctcctttgagcagatcctggcctccatcctgacggagtccgtgctggtgaacttctttgagaagagagtggacattggactcaagatcaaggaccaaaagaaagtggagagacagttcagcaccgccagtgaccatgagcagcctggagtttccggctgatgcctgcagctgtgaggcctggcccaaggtgtcatcagtggggctggcctcatctcctcctgcctttcctcccttatcagtttctctttaaaggtgtgcccctcctgctctcccaggagcagtgagttgtgagtggaaagaaggctggtgcagacccagctgccttagacagattccctgggcctgcatctcctggcgccggctgcttctgggcccaggaagaggctgtggctcccaccttccttacacctggtgggagcccgcctcgcaccagctgcacctgcctagcattagaggctctcagatctgcccttgcttgcctcatacctctgtgctccacactgcggccaggccagctgagtccctccatccgtggatgctttcctgcagctatgtggtatgggggtcattcctgcctcttgggcaccaggttggggggcatgtgcttgttgggcaccaaagtgatggaaccctcaggtgctctccgggagcctgaacctcctgactgaggaacatgggcagaacatgtttattgcacagagtgggcgctgcgcacaggcgtggctgtacacgtgctctcagctcatcatcctttccagtaactttaaaaaaacatccctcaggtcctgatatatttccttggattcatttcacttggctagaaattacactgtgctcaatgccttaataaatccctgaaagaacaacttctccccaggccaagtatggggccctggctgtgttctggaagttcaagacacttagtcctccacagtgggtggaagagtgcaaggtctgccaggtcagatggagacgcagaacctgctggtgcaagctgggcaggtcctgaccaacctgcatcaggggatgccctgagctccacaggtcttcatgggcaggggttgtgggtcctggtgaaggaagtgcatcctcaggcctgggctgtagcaagctgtctgcccttgggttcaagaaccagactgtggagccaaaggtgaccgcagggggccccagggctggagccacaaggataccctcactttgcatgaggagctgaaactgaccagtgtccagtgttagcccccacatggggctgctcttgcttctactaaaagatacagcagttacccccttatccacaggggatacagtggatatctaaaaccagacccccagtggatgtctaaaaccacagataataacaaaccttatacatactgttttttcctatgcatacatacctgtgattaagtttatgaattaggcaccttaagagattgacaacaataactaataataaaatgtaacggttatactgtaa

SEQ ID NO: 456781 - DNA, 5403 bp, Homo sapiens
cgccgacggcggcgggcgcttccgcctcgcgggcctcggcccggtgcgagcggctccgcgatgtggctgagcccggaggaggtgctggtggccaatgcgctgtgggtgacggagcgggccaaccccttcttcgtgctgcagcgacgccggggccacggcaggggcggcggccttacgggtcttctcgtgggcaccctggacgtggtgctggactccagtgcccgcgtggccccttaccgcatcctgcaccagacccaggactcccaggtctactggacagtggcgtgtggttcttcccgcaaagagatcacaaaacactgggaatggctggaaaataacttgctccagacactgtccatcttcgacagtgaggaagatatcaccaccttcgtcaagggcaagatacacggaatcatcgcagaagagaacaagaacctgcagccccagggagacgaggaccccgggaagttcaaggaggctgagctgaagatgcggaagcagtttgggatgcctgagggcgagaagctggtgaattactactcctgcagctactggaagggccgcgtgccccggcagggctggctgtacctgacggtcaaccacctgtgcttctactccttcctgctggggaaggaagtgagcctcgtggtgcagtgggtggacataacgcgtctggagaagaacgccaccctgctcttccccgagagcatccgtgtggacacccgcgaccaggagctcttcttctccatgttcctcaacatcggcgagaccttcaagctcatggagcagttggccaacctggccatgcggcagctgctggacagcgagggcttcctggaggacaaggccctgcctaggcccatccggccacacaggaacatctcagccctgaagcgagacctggacgcccgagccaagaatgagtgctaccgagccacgttccggctgcccagggatgagcggctagacggccacacaagctgcaccctgtggacgccgttcaacaagctgcacatccctggccagatgttcatctccaacaactacatctgcttcgccagcaaggaggaggacgcttgccacctcatcatacccctgagggaggtgaccattgtcgaaaaagctgacagctccagcgtgctgcccagccccctgtccatcagcaccaaaagcaaaatgacattcctgtttgccaacctgaaagaccgtgatttcttggtgcagaggatctctgacttcctccagaaaacaccatccaagcagccaggcagtatcgggagcaggaaagccagtgttgtggaccctagcacagagtcttccccagctcctcaggaggggtcggagcagcccgccagcccagcctctcccctcagcagccgccagagcttctgtgcgcaggaggcgccaaccgcatcccagggcctgctgaagctcttccagaaaaactcgcccatggaggaccttggagccaagggggccaaggagaagatgaaagaggagtcatggcacatccacttcttcgagtacgggcgtggcgtgtgcatgtaccgcacagccaagacgcgggcactggtcctgaagggtatccctgagagcctccggggagagctgtggctcctcttctccggggcctggaatgagatggtgactcaccccgggtactatgctgagctggtggagaagtccaccgggaagtacagcctggccacagaggagatcgagcgagacctgcaccgctccatgcccgagcaccctgccttccagaacgagctggggattgctgccctccggcgggtgctgactgcctatgccttccgaaaccccaccatcggctactgccaggcaatgaacatcgtgacctcggtgctcctgctctatggcagtgaggaggaggccttctggctcctggtggccctgtgcgagcgcatgctgcccgactactacaacaccagggtggtgggagccctggtggaccaaggcatcttcgaagagctcacgagagacttcctgccgcagctctcggagaagatgcaggacctgggggtgatctccagcatctcgctgtcctggttcctgaccctcttcctcagcgtcatgcccttcgagagcgccgtggtcatcgtcgactgctttttctatgagggcatcaaggtgatcctgcaggtggccctggccgtcctggacgccaacatggagcagctgctgggctgcagcgacgagggcgaggccatgaccatgctgggcagatacctggataatgtggtcaacaagcagagtgtctctcctcctatcccgcacctccgtgccttgctgagcagcagcgatgacccccctgcagaggtggacatctttgagctcctgaaagtgtcctatgagaaattcagcagcctgagggccgaagacattgagcagatgcggtttaaacagaggctgaaagtgatccagtccttggaggacacggccaagaggagtgtggtccgagctatacctgtggacattggtttctccattgaagagctggaggacctttacatggtgtttaaggccaagcacctggctagccagtactgggggtgcagccgcacaatggccggccgtcgggaccccagcctgccctacctggagcagtaccggattgatgccagccagttccgggaactctttgccagcctgacaccctgggcctgtggctcccacacacctctgctggcagggcgcatgttcaggctcctggacgaaaacaaggactcgctgatcaacttcaaggagttcgtgacagggatgagcgggatgtaccacggggacctgacagagaagctcaaggtgctctacaagctacaccttcccccagctctgagcccagaggaagccgagtcagccctggaggcggcccattatttcacagaggacagctcctcagaagcatctcctctggcctcagatctggatcttttcctgccctgggaggctcaagaagcactaccacaggaagagcaagaaggaagtggaagtgaggagagaggagaggagaaggggaccagctctccggactatcggcactaccttcgaatgtgggccaaggagaaagaggctcagaaggagacgattaaggatcttcccaagatgaaccaggagcagttcattgagctgtgcaagacgctttacaacatgttcagtgaagaccccatggagcaggacctgtaccacgccatcgccaccgtggccagcctcctgctccgcatcggagaggtggggaagaagttctcagcccgcacaggcaggaagcccagggactgtgccactgaggaggacgagccaccagcacccgaactgcatcaggacgcagccagggagcttcagcccccagctgcaggagacccccaagccaaagcaggcggagacacacacctcggaacagccccacaggagagccaggtggtggtggaggggggcagcggcgagggacagggctcaccctcccagctgctgtctgacgatgaaaccaaagacgacatgtccatgtcctcctactcggtggtcagcacgggctccctgcaatgtgaagaccttgcagacgacacggtgctggtgggcggggaggcctgcagccccacagcgcgcatcggcggcaccgtcgacaccgactggtgcatctcctttgagcagatcctggcctccatcctgacggagtccgtgctggtgaacttctttgagaagagagtggacattggactcaagatcaaggaccaaaagaaagtggagagacagttcagcaccgccagtgaccatgagcagcctggagtttccggctgatgcctgcagctgtgaggcctggcccaaggtgtcatcagtggggctggcctcatctcctcctgcctttcctcccttatcagtttctctttaaaggtgtgcccctcctgctctcccaggagcagtgagttgtgagtggaaagaaggctggtgcagacccagctgccttagacagattccctgggcctgcatctcctggcgccggctgcttctgggcccaggaagaggctgtggctcccaccttccttacacctggtgggagcccgcctcgcaccagctgcacctgcctagcattagaggctctcagatctgcccttgcttgcctcatacctctgtgctccacactgcggccaggccagctgagtccctccatccgtggatgctttcctgcagctatgtggtatgggggtcattcctgcctcttgggcaccaggttggggggcatgtgcttgttgggcaccaaagtgatggaaccctcaggtgctctccgggagcctgaacctcctgactgaggaacatgggcagaacatgtttattgcacagagtgggcgctgcgcacaggcgtggctgtacacgtgctctcagctcatcatcctttccagtaactttaaaaaaacatccctcaggtcctgatatatttccttggattcatttcacttggctagaaattacactgtgctcaatgccttaataaatccctgaaagaaataaaaaccactgtgtgcaatgccttgctgtggcccccaaccactgcttaggcctcccaacttctccccaggccaagtatggggccctggctgtgttctggaagttcaagacacttagtcctccacagtgggtggaagagtgcaaggtctgccaggtcagatggagacgcagaacctgctggtgcaagctgggcaggtcctgaccaacctgcatcaggggatgccctgagctccacaggtcttcatgggcaggggttgtgggtcctggtgaaggaagtgcatcctcaggcctgggctgtagcaagctgtctgcccttgggttcaagaaccagactgtggagccaaaggtgaccgcagggggccccagggctggagccacaaggataccctcactttgcatgaggagctgaaactgaccagtgtccagtgttagcccccacatggggctgctcttgcttctactaaaagatacagcagttacccccttatccacaggggatacagtggatatctaaaaccagacccccagtggatgtctaaaaccacagataataacaaaccttatacatactgttttttcctatgcatacatacctgtgattaagtttatgaattaggcaccttaagagattgacaacaataactaataataaaatgtaacggttatactgtaatgaaagttgtaaatgtggtctgtctcacaatatcttcttgtactgtactcatctcttttccaggtggctgttgactctgggtaactaaagctgcagaaggtgaaactcaggtactattgtatatctctgtggctgctgtttttgttttaattaagtagctttgtttttttgtttttttgtttttttgttttttgagaccaagtcttgctctg

SEQ ID NO: 456782 - DNA, 3134 bp, Homo sapiens
cgccgacggcggcgggcgcttccgcctcgcgggcctcggcccggtgcgagcggctccgcgatgtggctgagcccggaggaggtgctggtggccaatgcgctgtgggtgacggagcgggccaaccccttcttcgtgctgcagcgacgccggggccacggcaggggcggcggccttacgggtcttctcgtgggcaccctggacgtggtgctggactccagtgcccgcgtggccccttaccgcatcctgcaccagacccaggactcccaggtctactggacagtggcgtgtggttcttcccgcaaagagatcacaaaacactgggaatggctggaaaataacttgctccagacactgtccatcttcgacagtgaggaagatatcaccaccttcgtcaagggcaagatacacggaatcatcgcagaagagaacaagaacctgcagccccagggagacgaggaccccgggaagttcaaggaggctgagctgaagatgcggaagcagtttgggatgcctgagggcgagaagctggtgaattactactcctgcagctactggaagggccgcgtgccccggcagggctggctgtacctgacggtcaaccacctgtgcttctactccttcctgctggggaaggaagtgagcctcgtggtgcagtgggtggacataacgcgtctggagaagaacgccaccctgctcttccccgagagcatccgtgtggacacccgcgaccaggagctcttcttctccatgttcctcaacatcggcgagaccttcaagctcatggagcagttggccaacctggccatgcggcagctgctggacagcgagggcttcctggaggacaaggccctgcctaggcccatccggccacacaggaacatctcagccctgaagcgagacctggacgcccgagccaagaatgagtgctaccgagccacgttccggctgcccagggatgagcggctagacggccacacaagctgcaccctgtggacgccgttcaacaagctgcacatccctggccagatgttcatctccaacaactacatctgcttcgccagcaaggaggaggacggagcagttcattgagctgtgcaagacgctttacaacatgttcagtgaagaccccatggagcaggacctgtaccacgccatcgccaccgtggccagcctcctgctccgcatcggagaggtggggaagaagttctcagcccgcacaggcaggaagcccagggactgtgccactgaggaggacgagccaccagcacccgaactgcatcaggacgcagccagggagcttcagcccccagctgcaggagacccccaagccaaagcaggcggagacacacacctcggaacagccccacaggagagccaggtggtggtggaggggggcagcggcgagggacagggctcaccctcccagctgctgtctgacgatgaaaccaaagacgacatgtccatgtcctcctactcggtggtcagcacgggctccctgcaatgtgaagaccttgcagacgacacggtgctggtgggcggggaggcctgcagccccacagcgcgcatcggcggcaccgtcgacaccgactggtgcatctcctttgagcagatcctggcctccatcctgacggagtccgtgctggtgaacttctttgagaagagagtggacattggactcaagatcaaggaccaaaagaaagtggagagacagttcagcaccgccagtgaccatgagcagcctggagtttccggctgatgcctgcagctgtgaggcctggcccaaggtgtcatcagtggggctggcctcatctcctcctgcctttcctcccttatcagtttctctttaaaggtgtgcccctcctgctctcccaggagcagtgagttgtgagtggaaagaaggctggtgcagacccagctgccttagacagattccctgggcctgcatctcctggcgccggctgcttctgggcccaggaagaggctgtggctcccaccttccttacacctggtgggagcccgcctcgcaccagctgcacctgcctagcattagaggctctcagatctgcccttgcttgcctcatacctctgtgctccacactgcggccaggccagctgagtccctccatccgtggatgctttcctgcagctatgtggtatgggggtcattcctgcctcttgggcaccaggttggggggcatgtgcttgttgggcaccaaagtgatggaaccctcaggtgctctccgggagcctgaacctcctgactgaggaacatgggcagaacatgtttattgcacagagtgggcgctgcgcacaggcgtggctgtacacgtgctctcagctcatcatcctttccagtaactttaaaaaaacatccctcaggtcctgatatatttccttggattcatttcacttggctagaaattacactgtgctcaatgccttaataaatccctgaaagaaataaaaaccactgtgtgcaatgccttgctgtggcccccaaccactgcttaggcctcccaacttctccccaggccaagtatggggccctggctgtgttctggaagttcaagacacttagtcctccacagtgggtggaagagtgcaaggtctgccaggtcagatggagacgcagaacctgctggtgcaagctgggcaggtcctgaccaacctgcatcaggggatgccctgagctccacaggtcttcatgggcaggggttgtgggtcctggtgaaggaagtgcatcctcaggcctgggctgtagcaagctgtctgcccttgggttcaagaaccagactgtggagccaaaggtgaccgcagggggccccagggctggagccacaaggataccctcactttgcatgaggagctgaaactgaccagtgtccagtgttagcccccacatggggctgctcttgcttctactaaaagatacagcagttacccccttatccacaggggatacagtggatatctaaaaccagacccccagtggatgtctaaaaccacagataataacaaaccttatacatactgttttttcctatgcatacatacctgtgattaagtttatgaattaggcaccttaagagattgacaacaataactaataataaaatgtaacggttatactgtaa

SEQ ID NO: 456783 - DNA, 5086 bp, Homo sapiens
cgccgacggcggcgggcgcttccgcctcgcgggcctcggcccggtgcgagcggctccgcgatgtggctgagcccggaggaggtgctggtggccaatgcgctgtgggtgacggagcgggccaaccccttcttcgtgctgcagcgacgccggggccacggcaggggcggcggccttacgggtcttctcgtgggcaccctggacgtggtgctggactccagtgcccgcgtggccccttaccgcatcctgcaccagacccaggactcccaggtctactggacagtggcgtgtggttcttcccgcaaagagatcacaaaacactgggaatggctggaaaataacttgctccagacactgtccatcttcgacagtgaggaagatatcaccaccttcgtcaagggcaagatacacggaatcatcgcagaagagaacaagaacctgcagccccagggagacgaggaccccgggaagttcaaggaggctgagctgaagatgcggaagcagtttgggatgcctgagggcgagaagctggtgaattactactcctgcagctactggaagggccgcgtgccccggcagggctggctgtacctgacggtcaaccacctgtgcttctactccttcctgctggggaaggaagtgagcctcgtggtgcagtgggtggacataacgcgtctggagaagaacgccaccctgctcttccccgagagcatccgtgtggacacccgcgaccaggagctcttcttctccatgttcctcaacatcggcgagaccttcaagctcatggagcagttggccaacctggccatgcggcagctgctggacagcgagggcttcctggaggacaaggccctgcctaggcccatccggccacacaggaacatctcagccctgaagcgagacctggacgcccgagccaagaatgagtgctaccgagccacgttccggctgcccagggatgagcggctagacggccacacaagctgcaccctgtggacgccgttcaacaagctgcacatccctggccagatgttcatctccaacaactacatctgcttcgccagcaaggaggaggacgcttgccacctcatcatacccctgagggaggtgaccattgtcgaaaaagctgacagctccagcgtgctgcccagccccctgtccatcagcaccaaaagcaaaatgacattcctgtttgccaacctgaaagaccgtgatttcttggtgcagaggatctctgacttcctccagaaaacaccatccaagcagccaggcagtatcgggagcaggaaagccagtgttgtggaccctagcacagagtcttccccagctcctcaggaggggtcggagcagcccgccagcccagcctctcccctcagcagccgccagagcttctgtgcgcaggaggcgccaaccgcatcccagggcctgctgaagctcttccagaaaaactcgcccatggaggaccttggagccaagggggccaaggagaagatgaaagaggagtcatggcacatccacttcttcgagtacgggcgtggcgtgtgcatgtaccgcacagccaagacgcgggcactggtcctgaagggtatccctgagagcctccggggagagctgtggctcctcttctccggggcctggaatgagatggtgactcaccccgggtactatgctgagctggtggagaagtccaccgggaagtacagcctggccacagaggagatcgagcgagacctgcaccgctccatgcccgagcaccctgccttccagaacgagctggggattgctgccctccggcgggtgctgactgcctatgccttccgaaaccccaccatcggctactgccaggcaatgaacatcgtgacctcggtgctcctgctctatggcagtgaggaggaggccttctggctcctggtggccctgtgcgagcgcatgctgcccgactactacaacaccagggtggtgggagccctggtggaccaaggcatcttcgaagagctcacgagagacttcctgccgcagctctcggagaagatgcaggacctgggggtgatctccagcatctcgctgtcctggttcctgaccctcttcctcagcgtcatgcccttcgagagcgccgtggtcatcgtcgactgctttttctatgagggcatcaaggtgatcctgcaggtggccctggccgtcctggacgccaacatggagcagctgctgggctgcagcgacgagggcgaggccatgaccatgctgggcagatacctggataatgtggtcaacaagcagagtgtctctcctcctatcccgcacctccgtgccttgctgagcagcagcgatgacccccctgcagaggtggacatctttgagctcctgaaagtgtcctatgagaaattcagcagcctgagggccgaagacattgagcagatgcggtttaaacagaggctgaaagtgatccagtccttggaggacacggccaagaggagtgtggtccgagctatacctgtggacattggtttctccattgaagagctggaggacctttacatggtgtttaaggccaagcacctggctagccagtactgggggtgcagccgcacaatggccggccgtcgggaccccagcctgccctacctggagcagtaccggattgatgccagccagttccgggaactctttgccagcctgacaccctgggcctgtggctcccacacacctctgctggcagggcgcatgttcaggctcctggacgaaaacaaggactcgctgatcaacttcaaggagttcgtgacagggatgagcgggatgtaccacggggacctgacagagaagctcaaggtgctctacaagctacaccttcccccagctctgagcccagaggaagccgagtcagccctggaggcggcccattatttcacagaggacagctcctcagaagaagcactaccacaggaagagcaagaaggaagtggaagtgaggagagaggagaggagaaggggaccagctctccggactatcggcactaccttcgaatgtgggccaaggagaaagaggctcagaaggagacgattaaggatcttcccaagatgaaccaggagcagttcattgagctgtgcaagacgctttacaacatgttcagtgaagaccccatggagcaggacctgtaccacgccatcgccaccgtggccagcctcctgctccgcatcggagaggtggggaagaagttctcagcccgcacaggcaggaagcccagggactgtgccactgaggaggacgagccaccagcacccgaactgcatcaggacgcagccagggagcttcagcccccagctgcaggagacccccaagccaaagcaggcggagacacacacctcggaacagccccacaggagagccaggtggtggtggaggggggcagcggcgagggacagggctcaccctcccagctgctgtctgacgatgaaaccaaagacgacatgtccatgtcctcctactcggtggtcagcacgggctccctgcaatgtgaagaccttgcagacgacacggtgctggtgggcggggaggcctgcagccccacagcgcgcatcggcggcaccgtcgacaccgactggtgcatctcctttgagcagatcctggcctccatcctgacggagtccgtgctggtgaacttctttgagaagagagtggacattggactcaagatcaaggaccaaaagaaagtggagagacagttcagcaccgccagtgaccatgagcagcctggagtttccggctgatgcctgcagctgtgaggcctggcccaaggtgtcatcagtggggctggcctcatctcctcctgcctttcctcccttatcagtttctctttaaaggtgtgcccctcctgctctcccaggagcagtgagttgtgagtggtcctggcgccggctgcttctgggcccaggaagaggctgtggctcccaccttccttacacctggtgggagcccgcctcgcaccagctgcacctgcctagcattagaggctctcagatctgcccttgcttgcctcatacctctgtgctccacactgcggccaggccagctgagtccctccatccgtggatgctttcctgcagctatgtggtatgggggtcattcctgcctcttgggcaccaggttggggggcatgtgcttgttgggcaccaaagtgatggaaccctcaggtgctctccgggagcctgaacctcctgactgaggaacatgggcagaacatgtttattgcacagagtgggcgctgcgcacaggcgtggctgtacacgtgctctcagctcatcatcctttccagtaactttaaaaaaacatccctcaggtcctgatatatttccttggattcatttcacttggctagaaattacactgtgctcaatgccttaataaatccctgaaagaaataaaaaccactgtgtgcaatgccttgctgtggcccccaaccactgcttaggcctcccaacttctccccaggccaagtatggggccctggctgtgttctggaagttcaagacacttagtcctccacagtgggtggaagagtgcaaggtctgccaggtcagatggagacgcagaacctgctggtgcaagctgggcaggtcctgaccaacctgcatcaggggatgccctgagctccacaggtcttcatgggcaggggttgtgggtcctggtgaaggaagtgcatcctcaggcctgggctgtagcaagctgtctgcccttgggttcaagaaccagactgtggagccaaaggtgaccgcagggggccccagggctggagccacaaggataccctcactttgcatgaggagctgaaactgaccagtgtccagtgttagcccccacatggggctgctcttgcttctactaaaagatacagcagttacccccttatccacaggggatacagtggatatctaaaaccagacccccagtggatgtctaaaaccacagataataacaaaccttatacatactgttttttcctatgcatacatacctgtgattaagtttatgaattaggcaccttaagagattgacaacaataactaataataaaatgtaacggttatactgtaa

SEQ ID NO: 456784 - DNA, 5086 bp, Homo sapiens
cgccgacggcggcgggcgcttccgcctcgcgggcctcggcccggtgcgagcggctccgcgatgtggctgagcccggaggaggtgctggtggccaatgcgctgtgggtgacggagcgggccaaccccttcttcgtgctgcagcgacgccggggccacggcaggggcggcggccttacgggtcttctcgtgggcaccctggacgtggtgctggactccagtgcccgcgtggccccttaccgcatcctgcaccagacccaggactcccaggtctactggacagtggcgtgtggttcttcccgcaaagagatcacaaaacactgggaatggctggaaaataacttgctccagacactgtccatcttcgacagtgaggaagatatcaccaccttcgtcaagggcaagatacacggaatcatcgcagaagagaacaagaacctgcagccccagggagacgaggaccccgggaagttcaaggaggctgagctgaagatgcggaagcagtttgggatgcctgagggcgagaagctggtgaattactactcctgcagctactggaagggccgcgtgccccggcagggctggctgtacctgacggtcaaccacctgtgcttctactccttcctgctggggaaggaagtgagcctcgtggtgcagtgggtggacataacgcgtctggagaagaacgccaccctgctcttccccgagagcatccgtgtggacacccgcgaccaggagctcttcttctccatgttcctcaacatcggcgagaccttcaagctcatggagcagttggccaacctggccatgcggcagctgctggacagcgagggcttcctggaggacaaggccctgcctaggcccatccggccacacaggaacatctcagccctgaagcgagacctggacgcccgagccaagaatgagtgctaccgagccacgttccggctgcccagggatgagcggctagacggccacacaagctgcaccctgtggacgccgttcaacaagctgcacatccctggccagatgttcatctccaacaactacatctgcttcgccagcaaggaggaggacgcttgccacctcatcatacccctgagggaggtgaccattgtcgaaaaagctgacagctccagcgtgctgcccagccccctgtccatcagcaccaaaagcaaaatgacattcctgtttgccaacctgaaagaccgtgatttcttggtgcagaggatctctgacttcctccagaaaacaccatccaagcagccaggcagtatcgggagcaggaaagccagtgttgtggaccctagcacagagtcttccccagctcctcaggaggggtcggagcagcccgccagcccagcctctcccctcagcagccgccagagcttctgtgcgcaggaggcgccaaccgcatcccagggcctgctgaagctcttccagaaaaactcgcccatggaggaccttggagccaagggggccaaggagaagatgaaagaggagtcatggcacatccacttcttcgagtacgggcgtggcgtgtgcatgtaccgcacagccaagacgcgggcactggtcctgaagggtatccctgagagcctccggggagagctgtggctcctcttctccggggcctggaatgagatggtgactcaccccgggtactatgctgagctggtggagaagtccaccgggaagtacagcctggccacagaggagatcgagcgagacctgcaccgctccatgcccgagcaccctgccttccagaacgagctggggattgctgccctccggcgggtgctgactgcctatgccttccgaaaccccaccatcggctactgccaggcaatgaacatcgtgacctcggtgctcctgctctatggcagtgaggaggaggccttctggctcctggtggccctgtgcgagcgcatgctgcccgactactacaacaccagggtggtgggagccctggtggaccaaggcatcttcgaagagctcacgagagacttcctgccgcagctctcggagaagatgcaggacctgggggtgatctccagcatctcgctgtcctggttcctgaccctcttcctcagcgtcatgcccttcgagagcgccgtggtcatcgtcgactgctttttctatgagggcatcaaggtgatcctgcaggtggccctggccgtcctggacgccaacatggagcagctgctgggctgcagcgacgagggcgaggccatgaccatgctgggcagatacctggataatgtggtcaacaagcagagtgtctctcctcctatcccgcacctccgtgccttgctgagcagcagcgatgacccccctgcagaggtggacatctttgagctcctgaaagtgtcctatgagaaattcagcagcctgagggccgaagacattgagcagatgcggtttaaacagaggctgaaagtgatccagtccttggaggacacggccaagaggagtgtggtccgagctatacctgtggacattggtttctccattgaagagctggaggacctttacatggtgtttaaggccaagcacctggctagccagtactgggggtgcagccgcacaatggccggccgtcgggaccccagcctgccctacctggagcagtaccggattgatgccagccagttccgggaactctttgccagcctgacaccctgggcctgtggctcccacacacctctgctggcagggcgcatgttcaggctcctggacgaaaacaaggactcgctgatcaacttcaaggagttcgtgacagggatgagcgggatgtaccacggggacctgacagagaagctcaaggtgctctacaagctacaccttcccccagctctgagcccagaggaagccgagtcagccctggaggcggcccattatttcacagaggacagctcctcagaagaagcactaccacaggaagagcaagaaggaagtggaagtgaggagagaggagaggagaaggggaccagctctccggactatcggcactaccttcgaatgtgggccaaggagaaagaggctcagaaggagacgattaaggatcttcccaagatgaaccaggagcagttcattgagctgtgcaagacgctttacaacatgttcagtgaagaccccatggagcaggacctgtaccacgccatcgccaccgtggccagcctcctgctccgcatcggagaggtggggaagaagttctcagcccgcacaggcaggaagcccagggactgtgccactgaggaggacgagccaccagcacccgaactgcatcaggacgcagccagggagcttcagcccccagctgcaggagacccccaagccaaagcaggcggagacacacacctcggaacagccccacaggagagccaggtggtggtggaggggggcagcggcgagggacagggctcaccctcccagctgctgtctgacgatgaaaccaaagacgacatgtccatgtcctcctactcggtggtcagcacgggctccctgcaatgtgaagaccttgcagacgacacggtgctggtgggcggggaggcctgcagccccacagcgcgcatcggcggcaccgtcgacaccgactggtgcatctcctttgagcagatcctggcctccatcctgacggagtccgtgctggtgaacttctttgagaagagagtggacattggactcaagatcaaggacctttccggctgatgcctgcagctgtgaggcctggcccaaggtgtcatcagtggggctggcctcatctcctcctgcctttcctcccttatcagtttctctttaaaggtgtgcccctcctgctctcccaggagcagtgagttgtgagtggaaagaaggctggtgcagacccagctgccttagacagattccctgggcctgcatctcctggcgccggctgcttctgggcccaggaagaggctgtggctcccaccttccttacacctggtgggagcccgcctcgcaccagctgcacctgcctagcattagaggctctcagatctgcccttgcttgcctcatacctctgtgctccacactgcggccaggccagctgagtccctccatccgtggatgctttcctgcagctatgtggtatgggggtcattcctgcctcttgggcaccaggttggggggcatgtgcttgttgggcaccaaagtgatggaaccctcaggtgctctccgggagcctgaacctcctgactgaggaacatgggcagaacatgtttattgcacagagtgggcgctgcgcacaggcgtggctgtacacgtgctctcagctcatcatcctttccagtaactttaaaaaaacatccctcaggtcctgatatatttccttggattcatttcacttggctagaaattacactgtgctcaatgccttaataaatccctgaaagaaataaaaaccactgtgtgcaatgccttgctgtggcccccaaccactgcttaggcctcccaacttctccccaggccaagtatggggccctggctgtgttctggaagttcaagacacttagtcctccacagtgggtggaagagtgcaaggtctgccaggtcagatggagacgcagaacctgctggtgcaagctgggcaggtcctgaccaacctgcatcaggggatgccctgagctccacaggtcttcatgggcaggggttgtgggtcctggtgaaggaagtgcatcctcaggcctgggctgtagcaagctgtctgcccttgggttcaagaaccagactgtggagccaaaggtgaccgcagggggccccagggctggagccacaaggataccctcactttgcatgaggagctgaaactgaccagtgtccagtgttagcccccacatggggctgctcttgcttctactaaaagatacagcagttacccccttatccacaggggatacagtggatatctaaaaccagacccccagtggatgtctaaaaccacagataataacaaaccttatacatactgttttttcctatgcatacatacctgtgattaagtttatgaattaggcaccttaagagattgacaacaataactaataataaaatgtaacggttatactgtaa

SEQ ID NO: 456785 - DNA, 4965 bp, Homo sapiens
cgccgacggcggcgggcgcttccgcctcgcgggcctcggcccggtgcgagcggctccgcgatgtggctgagcccggaggaggtgctggtggccaatgcgctgtgggtgacggagcgggccaaccccttcttcgtgctgcagcgacgccggggccacggcaggggcggcggccttacgggtcttctcgtgggcaccctggacgtggtgctggactccagtgcccgcgtggccccttaccgcatcctgcaccagacccaggactcccaggtctactggacagtggcgtgtggttcttcccgcaaagagatcacaaaacactgggaatggctggaaaataacttgctccagacactgtccatcttcgacagtgaggaagatatcaccaccttcgtcaagggcaagatacacggaatcatcgcagaagagaacaagaacctgcagccccagggagacgaggaccccgggaagttcaaggaggctgagctgaagatgcggaagcagtttgggatgcctgagggcgagaagctggtgaattactactcctgcagctactggaagggccgcgtgccccggcagggctggctgtacctgacggtcaaccacctgtgcttctactccttcctgctggggaaggaagtgagcctcgtggtgcagtgggtggacataacgcgtctggagaagaacgccaccctgctcttccccgagagcatccgtgtggacacccgcgaccaggagctcttcttctccatgttcctcaacatcggcgagaccttcaagctcatggagcagttggccaacctggccatgcggcagctgctggacagcgagggcttcctggaggacaaggccctgcctaggcccatccggccacacaggaacatctcagccctgaagcgagacctggacgcccgagccaagaatgagtgctaccgagccacgttccggctgcccagggatgagcggctagacggccacacaagctgcaccctgtggacgccgttcaacaagctgcacatccctggccagatgttcatctccaacaactacatctgcttcgccagcaaggaggaggacgcttgccacctcatcatacccctgagggaggtgaccattgtcgaaaaagctgacagctccagcgtgctgcccagccccctgtccatcagcaccaaaagcaaaatgacattcctgtttgccaacctgaaagaccgtgatttcttggtgcagaggatctctgacttcctccagaaaacaccatccaagcagccaggcagtatcgggagcaggaaagccagtgttgtggaccctagcacagagtcttccccagctcctcaggaggggtcggagcagcccgccagcccagcctctcccctcagcagccgccagagcttctgtgcgcaggaggcgccaaccgcatcccagggcctgctgaagctcttccagaaaaactcgcccatggaggaccttggagccaagggggccaaggagaagatgaaagaggagtcatggcacatccacttcttcgagtacgggcgtggcgtgtgcatgtaccgcacagccaagacgcgggcactggtcctgaagggtatccctgagagcctccggggagagctgtggctcctcttctccggggcctggaatgagatggtgactcaccccgggtactatgctgagctggtggagaagtccaccgggaagtacagcctggccacagaggagatcgagcgagacctgcaccgctccatgcccgagcaccctgccttccagaacgagctggggattgctgccctccggcgggtgctgactgcctatgccttccgaaaccccaccatcggctactgccaggcaatgaacatcgtgacctcggtgctcctgctctatggcagtgaggaggaggccttctggctcctggtggccctgtgcgagcgcatgctgcccgactactacaacaccagggtggtgggagccctggtggaccaaggcatcttcgaagagctcacgagagacttcctgccgcagctctcggagaagatgcaggacctgggggtgatctccagcatctcgctgtcctggttcctgaccctcttcctcagcgtcatgcccttcgagagcgccgtggtcatcgtcgactgctttttctatgagggcatcaaggtgatcctgcaggtggccctggccgtcctggacgccaacatggagcagctgctgggctgcagcgacgagggcgaggccatgaccatgctgggcagatacctggataatgtggtcaacaagcagagtgtctctcctcctatcccgcacctccgtgccttgctgagcagcagcgatgacccccctgcagaggtggacatctttgagctcctgaaagtgtcctatgagaaattcagcagcctgagggccgaagacattgagcagatgcggtttaaacagaggctgaaagtgatccagtccttggaggacacggccaagaggagtgtggtccgagctatacctgtggacattggtttctccattgaagagctggaggacctttacatggtgtttaaggccaagcacctggctagccagtactgggggtgcagccgcacaatggccggccgtcgggaccccagcctgccctacctggagcagtaccggattgatgccagccagttccgggaactctttgccagcctgacaccctgggcctgtggctcccacacacctctgctggcagggcgcatgttcaggctcctggacgaaaacaaggactcgctgatcaacttcaaggagttcgtgacagggatgagcgggatgtaccacggggacctgacagagaagctcaaggtgctctacaagctacaccttcccccagctctgagcccagaggaagccgagtcagccctggaggcggcccattatttcacagaggacagctcctcagaagaagcactaccacaggaagagcaagaaggaagtggaagtgaggagagaggagaggagaaggggaccagctctccggactatcggcactaccttcgaatgtgggccaaggagaaagaggctcagaaggagacgattaaggatcttcccaagatgaaccaggagcagttcattgagctgtgcaagacgctttacaacatgttcagtgaagaccccatggagcaggacctgtaccacgccatcgccaccgtggccagcctcctgctccgcatcggagaggtggggaagaagttctcagcccgcacaggcaggaagcccagggactgtgccactgaggaggacgagccaccagcacccgaactgcatcaggacgcagccagggagcttcagcccccagctgcaggagacccccaagccaaagcaggcggagacacacacctcggaacagccccacaggagagccaggtggtggtggaggggggcagcggcgagggacagggctcaccctcccagctgctgtctgacgatgaaaccaaagacgacattccgtgctggtgaacttctttgagaagagagtggacattggactcaagatcaaggaccaaaagaaagtggagagacagttcagcaccgccagtgaccatgagcagcctggagtttccggctgatgcctgcagctgtgaggcctggcccaaggtgtcatcagtggggctggcctcatctcctcctgcctttcctcccttatcagtttctctttaaaggtgtgcccctcctgctctcccaggagcagtgagttgtgagtggaaagaaggctggtgcagacccagctgccttagacagattccctgggcctgcatctcctggcgccggctgcttctgggcccaggaagaggctgtggctcccaccttccttacacctggtgggagcccgcctcgcaccagctgcacctgcctagcattagaggctctcagatctgcccttgcttgcctcatacctctgtgctccacactgcggccaggccagctgagtccctccatccgtggatgctttcctgcagctatgtggtatgggggtcattcctgcctcttgggcaccaggttggggggcatgtgcttgttgggcaccaaagtgatggaaccctcaggtgctctccgggagcctgaacctcctgactgaggaacatgggcagaacatgtttattgcacagagtgggcgctgcgcacaggcgtggctgtacacgtgctctcagctcatcatcctttccagtaactttaaaaaaacatccctcaggtcctgatatatttccttggattcatttcacttggctagaaattacactgtgctcaatgccttaataaatccctgaaagaaataaaaaccactgtgtgcaatgccttgctgtggcccccaaccactgcttaggcctcccaacttctccccaggccaagtatggggccctggctgtgttctggaagttcaagacacttagtcctccacagtgggtggaagagtgcaaggtctgccaggtcagatggagacgcagaacctgctggtgcaagctgggcaggtcctgaccaacctgcatcaggggatgccctgagctccacaggtcttcatgggcaggggttgtgggtcctggtgaaggaagtgcatcctcaggcctgggctgtagcaagctgtctgcccttgggttcaagaaccagactgtggagccaaaggtgaccgcagggggccccagggctggagccacaaggataccctcactttgcatgaggagctgaaactgaccagtgtccagtgttagcccccacatggggctgctcttgcttctactaaaagatacagcagttacccccttatccacaggggatacagtggatatctaaaaccagacccccagtggatgtctaaaaccacagataataacaaaccttatacatactgttttttcctatgcatacatacctgtgattaagtttatgaattaggcaccttaagagattgacaacaataactaataataaaatgtaacggttatactgtaa

SEQ ID NO: 456786 - DNA, 1261 bp, Homo sapiens
cgagctcgggtacccgttctaatacgactcactgttgccttcgccgctgtctgcgttagagggcggtgtcacacccttgcccttgtctgccgaggatgctctcacagagtgccgtacttctgtgccaggagcttgtgatccagctatataccctgtttctccttccttctaggtccgagctatacctgtggacattggtttctccattgaagagctggaggacctttacatggtgtttaaggccaagcacctggctagccagtactgggggtgcagccgcacaatggccggccgtcgggaccccagcctgccctacctggagcagtaccggattgatgccagccagttccgggaactctttgccagcctgacaccctgggcctcctgactgaggaacatgggcagaacatgtttattgcacagagtgggcgctgcgcacaggcgtggctgtacacgtgctctcagctcatcatcctttccagtaactttaaaaaaacatccctcaggtcctgatatatttccttggattcatttcacttggctagaaattacactgtgctcaatgccttaataaatccctgaaagaaataaaaaccactgtgtgcaatgccttgctgtggcccccaaccactgcttaggcctcccaacttctccccaggccaagtatggggccctggctgtgttctggaagttcaagacacttagtcctccacagtgggtggaagagtgcaaggtctgccaggtcagatggagacgcagaacctgctggtgcaagctgggcaggtcctgaccaacctgcatcaggggatgccctgagctccacaggtcttcatgggcaggggttgtgggtcctggtgaaggaagtgcatcctcaggcctgggctgtagcaagctgtctgcccttgggttcaagaaccagactgtggagccaaaggtgaccgcagggggccccagggctggagccacaaggataccctcactttgcatgaggagctgaaactgaccagtgtccagtgttagcccccacatggggctgctcttgcttctactaaaagatacagcagttacccccttatccacaggggatacagtggatatctaaaaccagacccccagtggatgtctaaaaccacagataataacaaaccttatacatactgttttttcctatgcatacatacctgtgattaagtttatgaattaggcaccttaagagattgacaacaataactaataataaaatgtaacggttatactgtaa

SEQ ID NO: 456787 - DNA, 3540 bp, Homo sapiens
  misc_feature (3268)..(3268): n is a, c, g, or t
  misc_feature (3520)..(3520): n is a, c, g, or t
cgccgacggcggcgggcgcttccgcctcgcgggcctcggcccggtgcgagcggctccgcgatgtggctgagcccggaggaggtgctggtggccaatgcgctgtgggtgacggagcgggccaaccccttcttcgtgctgcagcgacgccggggccacggcaggggcggcggccttacgggtcttctcgtgggcaccctggacgtggtgctggactccagtgcccgcgtggccccttaccgcatcctgcaccagacccaggactcccaggtctactggacagtggcgtgtggttcttcccgcaaagagatcacaaaacactgggaatggctggaaaataacttgctccagacactgtccatcttcgacagtgaggaagatatcaccaccttcgtcaagggcaagatacacggaatcatcgcagaagagaacaagaacctgcagccccagggagacgaggaccccgggaagttcaaggaggctgagctgaagatgcggaagcagtttgggatgcctgagggcgagaagctggtgaattactactcctgcagctactggaagggccgcgtgccccggcagggctggctgtacctgacggtcaaccacctgtgcttctactccttcctgctggggaaggaagtgagcctcgtggtgcagtgggtggacataacgcgtctggagaagaacgccaccctgctcttccccgagagcatccgtgtggacacccgcgaccaggagctcttcttctccatgttcctcaacatcggcgagaccttcaagctcatggagcagttggccaacctggccatgcggcagctgctggacagcgagggcttcctggaggacaaggccctgcctaggcccatccggccacacaggaacatctcagccctgaagcgagacctggacgcccgagccaagaatgagtgctaccgagccacgttccggctgcccagggatgagcggctagacggccacacaagctgcaccctgtggacgccgttcaacaagctgcacatccctggccagatgttcatctccaacaactacatctgcttcgccagcaaggaggaggacgcttgccacctcatcatacccctgagggaggtgaccattgtcgaaaaagctgacagctccagcgtgctgcccagccccctgtccatcagcaccaaaagcaaaatgacattcctgtttgccaacctgaaagaccgtgatttcttggtgcagaggatctctgacttcctccagaaaacaccatccaagcagccaggcagtatcgggagcaggaaagccagtgttgtggaccctagcacagagtcttccccagctcctcaggaggggtcggagcagcccgccagcccagcctctcccctcagcagccgccagagcttctgtgcgcaggaggcgccaaccgcatcccagggcctgctgaagctcttccagaaaaactcgcccatggaggaccttggagccaagggggccaaggagaagatgaaagaggagtcatggcacatccacttcttcgagtacgggcgtggcgtgtgcatgtaccgcacagccaagacgcgggcactggtcctgaagggtatccctgagagcctccggggagagctgtggctcctcttctccggggcctggaatgagatggtgactcaccccgggtactatgctgagctggtggagaagtccaccgggaagtacagcctggccacagaggagatcgagcgagacctgcaccgctccatgcccgagcaccctgccttccagaacgagctggggattgctgccctccggcgggtgctgactgcctatgccttccgaaaccccaccatcggctactgccaggcaatgaacatcgtgacctcggtgctcctgctctatggcagtgaggaggaggccttctggctcctggtggccctgtgcgagcgcatgctgcccgactactacaacaccagggtggtgggagccctggtggaccaaggcatcttcgaagagctcacgagagacttcctgccgcagctctcggagaagatgcaggacctgggggtgatctccagcatctcgctgtcctggttcctgaccctcttcctcagcgtcatgcccttcgagagcgccgtggtcatcgtcgactgctttttctatgagggcatcaaggtgatcctgcaggtggccctggccgtcctggacgccaacatggagcagctgctgggctgcagcgacgagggcgaggccatgaccatgctgggcagatacctggataatgtggtcaacaagcagagtgtctctcctcctatcccgcacctccgtgccttgctgagcagcagcgatgacccccctgcagaggtggacatctttgagctcctgaaagtgtcctatgagaaattcagcagcctgagggccgaagacattgagcagatgcggtttaaacagaggctgaaagtgatccagtccttggaggacacggccaagaggagtgtggtccgagctatacctgtggacattggtttctccattgaagagctggaggacctttacatggtgtttaaggccaagcacctggctagccagtactgggggtgcagccgcacaatggccggccgtcgggaccccagcctgccctacctggagcagtaccggattgatgccagccagttccgggaactctttgccagcctgacaccctgggcctgtggctcccacacacctctgctggcagggcgcatgttcaggctcctggacgaaaacaaggactcgctgatcaacttcaaggagttcgtgacagggatgagcgggatgtaccacggggacctgacagagaagctcaaggtgctctacaagctacaccttcccccagctctgagcccagaggaagccgagtcagccctggaggcggcccattatttcacagaggacagctcctcagaagaagcactaccacaggaagagcaagaaggaagtggaagtgaggagagaggagaggagaaggggaccagctctccggactatcggcactaccttcgaatgtgggccaaggagaaagaggctcagaaggagacgattaaggatcttcccaagatgaaccaggagcagttcattgagctgtgcaagacgctttacaacatgttcagtgaagaccccatggagcaggacctgtaccacgccatcgccaccgtggccagcctcctgctccgcatcggagagtctccgtcgaatagttcgacggagactctcaccaaattccagggaccactgggtgagagaggaataaggnccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttangtggctctgggaatgggaga

SEQ ID NO: 456788 - DNA, 1877 bp, Homo sapiens
cgccgacggcggcgggcgcttccgcctcgcgggcctcggcccggtgcgagcggctccgcgatgtggctgagcccggaggaggtgctggtggccaatgcgctgtgggtgacggagcgggccaaccccttcttcgtgctgcagcgacgccggggccacggcaggggcggcggccttacgggtcttctcgtgggcaccctggacgtggtgctggactccagtgcccgcgtggccccttaccgcatcctgcaccagacccaggactcccaggtctactggacagtggcgtgtggttcttcccgcaaagagatcacaaaacactgggaatggctggaaaataacttgctccagacactgtccatcttcgacagtgaggaagatatcaccaccttcgtcaagggcaagatacacggaatcatcgcagaagagaacaagaacctgcagccccagggagacgaggaccccgggaagttcaaggaggctgagctgaagatgcggaagcagtttgggatgcctgagggcgagaagctggtgaattactactcctgcagctactggaagggccgcgtgccccggcagggctggctgtacctgacggtcaaccacctgtgcttctactccttcctgctggggaaggaagtgagcctcgtggtgcagtgggtggacataacgcgtctggagaagaacgccaccctgctcttccccgagagcatccgtgtggacacccgcgaccaggagctcttcttctccatgttcctcaacatcggcgagaccttcaagctcatggagcagttggccaacctggccatgcggcagctgctggacagcgagggcttcctggaggacaaggccctgcctaggcccatccggccacacaggaacatctcagccctgaagcgagacctggacgcccgagccaagaatgagtgctaccgagccacgttccggctgcccagggatgagcggctagacggccacacaagctgcaccctgtggacgccgttcaacaagctgcacatccctggccagatgttcatctccaacaactacatctgcttcgccagcaaggaggaggacgcttgccacctcatcatacccctgagggaggtgaccattgtcgaaaaagctgacagctccagcgtgctgcccagccccctgtccatcagcaccaaaagcaaaatgacattcctgtttgccaacctgaaagaccgtgatttcttggtgcagaggatctctgacttcctccagaaaacaccatccaagcagccaggcagtatcgggagcaggaaagccagtgttgtggaccctagcacagagtcttccccagctcctcaggaggggtcggagcagcccgccagcccagcctctcccctcagcagccgccagagcttctgtgcgcaggaggcgccaaccgcatcccagggcctgctgaagctcttccagaaaaactcgcccatggaggaccttggagccaagggggaagtgcatcctcaggcctgggctgtagcaagctgtctgcccttgggttcaagaaccagactgtggagccaaaggtgaccgcagggggccccagggctggagccacaaggataccctcactttgcatgaggagctgaaactgaccagtgtccagtgttagcccccacatggggctgctcttgcttctactaaaagatacagcagttacccccttatccacaggggatacagtggatatctaaaaccagacccccagtggatgtctaaaaccacagataataacaaaccttatacatactgttttttcctatgcatacatacctgtgattaagtttatgaattaggcaccttaagagattgacaacaataactaataataaaatgtaacggttatactgtaa

SEQ ID NO: 456789 - DNA, 2182 bp, Homo sapiens
cgccgacggcggcgggcgcttccgcctcgcgggcctcggcccggtgcgagcggctccgcgatgtggctgagcccggaggaggtgctggtggccaatgcgctgtgggtgacggagcgggccaaccccttcttcgtgctgcagcgacgccggggccacggcaggggcggcggccttacgggtcttctcgtgggcaccctggacgtggtgctggactccagtgcccgcgtggccccttaccgcatcctgcaccagacccaggactcccaggtctactggacagtggcgtgtggttcttcccgcaaagagatcacaaaacactgggaatggctggaaaataacttgctccagacactgtccatcttcgacagtgaggaagatatcaccaccttcgtcaagggcaagatacacggaatcatcgcagaagagaacaagaacctgcagccccagggagacgaggaccccgggaagttcaaggaggctgagctgaagatgcggaagcagtttgggatgcctgagggcgagaagctggtgaattactactcctgcagctactggaagggccgcgtgccccggcagggctggctgtacctgacggtcaaccacctgtgcttctactccttcctgctggggaaggaagtgagcctcgtggtgcagtgggtggacataacgcgtctggagaagaacgccaccctgctcttccccgagagcatccgtgtggacacccgcgaccaggagctcttcttctccatgttcctcaacatcggcgagaccttcaagctcatggagcagttggccaacctggccatgcggcagctgctggacagcgagggcttcctggaggacaaggccctgcctaggcccatccggccacacaggaacatctcagccctgaagcgagacctggacgcccgagccaagaatgagtgctaccgagccacgttccggctgcccagggatgagcggctagacggccacacaagctgcaccctgtggacgccgttcaacaagctgcacatccctggccagatgttcatctccaacaactacatctgcttcgccagcaaggaggaggacgcttgccacctcatcatacccctgagggaggtgaccattgtcgaaaaagctgacagctccagcgtgctgcccagccccctgtccatcagcaccaaaagcaaaatgacattcctgtttgccaacctgaaagaccgtgatttcttggtgcagaggatctctgacttcctccagaaaacaccatccaagcagccaggcagtatcgggagcaggaaagccagtgttgtggaccctagcacagagccacacacccggtactcctcactcctgctgggcccattgcccatgaggaaccttctctggctgtcctttctgcattgctgctgcactcagagcaaagccacactgtggaggcctgtacacttcggctttgttcccatgaccttccctgccaggcgttcaggctgaagttcttgacggtagaactgcagtatcactattgtaccagcaaacttaacaagaattccttaatatcaccaaatattgtattcacacttccccgtgtgcaagtgtacttttcacggtttgattatttgaactgaggcagacgaaagtcacacatgtcactcttggttgataggtctcttaaatctgtttaatctacgggcttctgctccacctagctctcgtttattcttccacaatatttttttgaaggaatcggtcacttgtgccatagagtctctcatcgtctggttttgctgattgcatccgctgcaggcgtttagcaagctcctgtgtctcttgtttaagttggttgagcggtgagaccgagagccgtgatcacattcaggctcagctgattttggttctggcaggtccgcctgtgggcaggcttgaggtgctgtttattcccaacaagagatgtctggcaaccagccacctctctatgctactgtcagtcattgagaatatgcctggatccagcggccagtggccagcggcatgctcattccattcctcctttcgtctgggagctgaaattctcccaaagagggaagctgaccccaggcacagttcatagaggaaaggtggaatacatgttttactctttcctcttactcaccagttgtcaaaataatgatgagttggttttctagtgtcttccaca

SEQ ID NO: 456790 - DNA, 1848 bp, Homo sapiens
gagctcagtggccgcctcccctgggaccacccagccttccctcttcccagcactcacccctgctgactgtgctcagctggtgcatccctcgtccgtctccctgccaggccttgggctctgcagaggtgcccactgaaagcttgtcctgtgccctctacacctcagaggggttcagagccaagctccaggacccctgctgtcaaaaagtgttccctgggaacaagtgcagggaacagtcctgcaagcaagggactgcttgccctgctttcggacagccttctgagagccagtgaaggccagcagctgggctgaacactacatcatcctcagaaccaccctgcacagccggtgtgctccccgccatcgacaggaaaaacgggcccttagaggcacaggcaacttgctcggggttaggtgcagcgggtggcagagtcagaatgtgaggacagttgggccactcactgcattgtgcccaggagaggacagctgcatgacagtctgccattcacaaagcatgcccagctgcagggcctgagatgcagacacccaaaagagttctttcaccttctcaggtgaccattgtcgaaaaagctgacagctccagcgtgctgcccagccccctgtccatcagcaccaaaagcaaaatgacattcctgtttgccaacctgaaagaccgtgatttcttggtgcagaggatctctgacttcctccagaaaacaccatccaagcagccaggcagtatcgggagcaggaaagccagtgttgtggaccctagcacagaggtgagaagccccttgggagcagcagggtcgagttgggcccaggaagagccagggcatccatcagcctccccgctggagcctgaccccatggttccggctgtgggcctccgcctaggggtggatgtgtcagagctggcaagagacccctagcccagacccacactgcccagcaacatcacagcctctctgcacccccagccacacacccggtactcctcactcctgctgggcccattgcccatgaggaaccttctctggctgtcctttctgcattgctgctgcactcagagcaaagccacactgtggaggcctgtacacttcggctttgttcccatgaccttccctgccaggcgttcaggctgaagttcttgacggtagaactgcagtatcactattgtaccagcaaacttaacaagaattccttaatatcaccaaatattgtattcacacttccccgtgtgcaagtgtacttttcacggtttgattatttgaactgaggcagacgaaagtcacacatgtcactcttggttgataggtctcttaaatctgtttaatctacgggcttctgctccacctagctctcgtttattcttccacaatatttttttgaaggaatcggtcacttgtgccatagagtctctcatcgtctggttttgctgattgcatccgctgcaggcgtttagcaagctcctgtgtctcttgtttaagttggttgagcggtgagaccgagagccgtgatcacattcaggctcagctgattttggttctggcaggtccgcctgtgggcaggcttgaggtgctgtttattcccaacaagagatgtctggcaaccagccacctctctatgctactgtcagtcattgagaatatgcctggatccagcggccagtggccagcggcatgctcattccattcctcctttcgtctgggagctgaaattctcccaaagagggaagctgaccccaggcacagttcatagaggaaaggtggaatacatgttttactctttcctcttactcaccagttgtcaaaataatgatgagttggttttctagtgtcttccaca

SEQ ID NO: 456791 - DNA, 473 bp, Homo sapiens
ctacaacaccagggtggtgggtgagtgtccccgggtgctgcctcgcctgggtctccaggtgcctgctggttccatgagggtggcagcccttcccaggccaagctccaggcttcacgtgggttccctaggagttagagggtagtattacacattcggtggtttataaaagtcccctcagagcctaaattcctatccatctaacttcctgtcaactttttgattatggaaaatttcaaacatcaaaactagagagtatatatcccccatgtaacctgatgctcaactttactgaactcatatccagtgaaatctgttatgaagtggaaatggacttgcaagagtgtttaattaggttcatatttaagcatgttatcctgtccttcccctgctgtctggtgtttggagttaccgctcttggggtccttcagagctgcgtctattcacaatcatcaggatgggacagagtcattgag

SEQ ID NO: 456792 - DNA, 5140 bp, Homo sapiens
cgccgacggcggcgggcgcttccgcctcgcgggcctcggcccggtgcgagcggctccgcgatgtggctgagcccggaggaggtgctggtggccaatgcgctgtgggtgacggagcgggccaaccccttcttcgtgctgcagcgacgccggggccacggcaggggcggcggccttacgggtcttctcgtgggcaccctggacgtggtgctggactccagtgcccgcgtggccccttaccgcatcctgcaccagacccaggactcccaggtctactggacagtggcgtgtggttcttcccgcaaagagatcacaaaacactgggaatggctggaaaataacttgctccagacactgtccatcttcgacagtgaggaagatatcaccaccttcgtcaagggcaagatacacggaatcatcgcagaagagaacaagaacctgcagccccagggagacgaggaccccgggaagttcaaggaggctgagctgaagatgcggaagcagtttgggatgcctgagggcgagaagctggtgaattactactcctgcagctactggaagggccgcgtgccccggcagggctggctgtacctgacggtcaaccacctgtgcttctactccttcctgctggggaaggaagtgagcctcgtggtgcagtgggtggacataacgcgtctggagaagaacgccaccctgctcttccccgagagcatccgtgtggacacccgcgaccaggagctcttcttctccatgttcctcaacatcggcgagaccttcaagctcatggagcagttggccaacctggccatgcggcagctgctggacagcgagggcttcctggaggacaaggccctgcctaggcccatccggccacacaggaacatctcagccctgaagcgagacctggacgcccgagccaagaatgagtgctaccgagccacgttccggctgcccagggatgagcggctagacggccacacaagctgcaccctgtggacgccgttcaacaagctgcacatccctggccagatgttcatctccaacaactacatctgcttcgccagcaaggaggaggacgcttgccacctcatcatacccctgagggaggtgaccattgtcgaaaaagctgacagctccagcgtgctgcccagccccctgtccatcagcaccaaaagcaaaatgacattcctgtttgccaacctgaaagaccgtgatttcttggtgcagaggatctctgacttcctccagaaaacaccatccaagcagccaggcagtatcgggagcaggaaagccagtgttgtggaccctagcacagagtcttccccagctcctcaggaggggtcggagcagcccgccagcccagcctctcccctcagcagccgccagagcttctgtgcgcaggaggcgccaaccgcatcccagggcctgctgaagctcttccagaaaaactcgcccatggaggaccttggagccaagggggccaaggagaagatgaaagaggagtcatggcacatccacttcttcgagtacgggcgtggcgtgtgcatgtaccgcacagccaagacgcgggcactggtcctgaagggtatccctgagagcctccggggagagctgtggctcctcttctccggggcctggaatgagatggtgactcaccccgggtactatgctgagctggtggagaagtccaccgggaagtacagcctggccacagaggagatcgagcgagacctgcaccgctccatgcccgagcaccctgccttccagaacgagctggggattgctgccctccggcgggtgctgactgcctatgccttccgaaaccccaccatcggctactgccaggcaatgaacatcgtgacctcggtgctcctgctctatggcagtgaggaggaggccttctggctcctggtggccctgtgcgagcgcatgctgcccgactactacaacaccagggtggtgggagccctggtggaccaaggcatcttcgaagagctcacgagagacttcctgccgcagctctcggagaagatgcaggacctgggggtgatctccagcatctcgctgtcctggttcctgaccctcttcctcagcgtcatgcccttcgagagcgccgtggtcatcgtcgactgctttttctatgagggcatcaaggtgatcctgcaggtggccctggccgtcctggacgccaacatggagcagctgctgggctgcagcgacgagggcgaggccatgaccatgctgggcagatacctggataatgtggtcaacaagcagagtgtctctcctcctatcccgcacctccgtgccttgctgagcagcagcgatgacccccctgcagaggtggacatctttgagctcctgaaagtgtcctatgagaaattcagcagcctgagggccgaagacattgagcagatgcggtttaaacagaggctgaaagtgatccagtccttggaggacacggccaagaggagtgtggtccgagctatacctgtggacattggtttctccattgaagagctggaggacctttacatggtgtttaaggccaagcacctggctagccagtactgggggtgcagccgcacaatggccggccgtcgggaccccagcctgccctacctggagcagtaccggattgatgccagccagttccgggaactctttgccagcctgacaccctgggcctgtggctcccacacacctctgctggcagggcgcatgttcaggctcctggacgaaaacaaggactcgctgatcaacttcaaggagttcgtgacagggatgagcgggatgtaccacggggacctgacagagaagctcaaggtgctctacaagctacaccttcccccagctctgagcccagaggaagccgagtcagccctggaggcggcccattatttcacagaggacagctcctcagaagaagcactaccacaggaagagcaagaaggaagtggaagtgaggagagaggagaggagaaggggaccagctctccggactatcggcactaccttcgaatgtgggccaaggagaaagaggctcagaaggagacgattaaggatcttcccaagatgaaccaggagcagttcattgagctgtgcaagacgctttacaacatgttcagtgaagaccccatggagcaggacctgtaccacgccatcgccaccgtggccagcctcctgctccgcatcggagaggtggggaagaagttctcagcccgcacaggcaggaagcccagggactgtgccactgaggaggacgagccaccagcacccgaactgcatcaggacgcagccagggagcttcagcccccagctgcaggagacccccaagccaaagcaggcggagacacacacctcggaacagccccacaggagagccaggtggtggtggaggggggcagcggcgagggacagggctcaccctcccagctgctgtctgacgatgaaaccaaagacgacatgtccatgtcctcctactcggtggtcagcacgggctccctgcaatgtgaagaccttgcagacgacacggtgctggtgggcggggaggcctgcagccccacagcgcgcatcggcggcaccgtcgacaccgactggtgcatctcctttgagcagatcctggcctccatcctgacggagtccgtgctggtgaacttctttgagaagagagtggacattggactcaagatcaaggaccaaaagaaagtggagagacagttcagcaccgccagtgaccatgagcagcctggagtttccggctgatgcctgcagctgtgaggcctggcccaaggtgtcatcagtggggctggcctcatctcctcctgcctttcctcccttatcagtttctctttaaaggtgtgcccctcctgctctcccaggagcagtgagttgtgagtggaaagaaggctggtgcagacccagctgccttagacagattccctgggcctgcatctcctggcgccggctgcttctgggcccaggaagaggctgtggctcccaccttccttacacctggtgggagcccgcctcgcaccagctgcacctgcctagcattagaggctctcagatctgcccttgcttgcctcatacctctgtgctccacactgcggccaggccagctgagtccctccatccgtggatgctttcctgcagctatgtggtatgggggtcattcctgcctcttgggcaccaggttggggggcatgtgcttgttgggcaccaaagtgatggaaccctcaggtgctctccgggagcctgaacctcctgactgaggaacatgggcagaacatgtttattgcacagagtgggcgctgcgcacaggcgtggctgtacacgtgctctcagctcatcatcctttccagtaactttaaaaaaacatccctcaggtcctgatatatttccttggattcatttcacttggctagaaattacactgtgctcaatgccttaataaatccctgaaagaaataaaaaccactgtgtgcaatgccttgctgtggcccccaaccactgcttaggcctcccaacttctccccaggccaagtatggggccctggctgtgttctggaagttcaagacacttagtcctccacagtgggtggaagagtgcaaggtctgccaggtcagatggagacgcagaacctgctggtgcaagctgggcaggtcctgaccaacctgcatcaggggatgccctgagctccacaggtcttcatgggcaggggttgtgggtcctggtgaaggaagtgcatcctcaggcctgggctgtagcaagctgtctgcccttgggttcaagaaccagactgtggagccaaaggtgaccgcagggggccccagggctggagccacaaggataccctcactttgcatgaggagctgaaactgaccagtgtccagtgttagcccccacatggggctgctcttgcttctactaaaagatacagcagttacccccttatccacaggggatacagtggatatctaaaaccagacccccagtggatgtctaaaaccacagataataacaaaccttatacatactgttttttcctatgcatacatacctgtgattaagtttatgaattaggcaccttaagagattgacaacaataactaataataaaatgtaacggttatactgtaa

SEQ ID NO: 456793 - DNA, 4395 bp, Homo sapiens
cgccgacggcggcgggcgcttccgcctcgcgggcctcggcccggtgcgagcggctccgcgatgtggctgagcccggaggaggtgctggtggccaatgcgctgtgggtgacggagcgggccaaccccttcttcgtgctgcagcgacgccggggccacggcaggggcggcggccttacgggtcttctcgtgggcaccctggacgtggtgctggactccagtgcccgcgtggccccttaccgcatcctgcaccagacccaggactcccaggtctactggacagtggcgtgtggttcttcccgcaaagagatcacaaaacactgggaatggctggaaaataacttgctccagacactgtccatcttcgacagtgaggaagatatcaccaccttcgtcaagggcaagatacacggaatcatcgcagaagagaacaagaacctgcagccccagggagacgaggaccccgggaagttcaaggaggctgagctgaagatgcggaagcagtttgggatgcctgagggcgagaagctggtgaattactactcctgcagctactggaagggccgcgtgccccggcagggctggctgtacctgacggtcaaccacctgtgcttctactccttcctgctggggaaggaagtgagcctcgtggtgcagtgggtggacataacgcgtctggagaagaacgccaccctgctcttccccgagagcatccgtgtggacacccgcgaccaggagctcttcttctccatgttcctcaacatcggcgagaccttcaagctcatggagcagttggccaacctggccatgcggcagctgctggacagcgagggcttcctggaggacaaggccctgcctaggcccatccggccacacaggaacatctcagccctgaagcgagacctggacgcccgagccaagaatgagtgctaccgagccacgttccggctgcccagggatgagcggctagacggccacacaagctgcaccctgtggacgccgttcaacaagctgcacatccctggccagatgttcatctccaacaactacatctgcttcgccagcaaggaggaggacgcttgccacctcatcatacccctgagggaggtgaccattgtcgaaaaagctgacagctccagcgtgctgcccagccccctgtccatcagcaccaaaagcaaaatgacattcctgtttgccaacctgaaagaccgtgatttcttggtgcagaggatctctgacttcctccagaaaacaccatccaagcagccaggcagtatcgggagcaggaaagccagtgttgtggaccctagcacagagtcttccccagctcctcaggaggggtcggagcagcccgccagcccagcctctcccctcagcagccgccagagcttctgtgcgcaggaggcgccaaccgcatcccagggcctgctgaagctcttccagaaaaactcgcccatggaggaccttggagccaagggggccaaggagaagatgaaagaggagtcatggcacatccacttcttcgagtacgggcgtggcgtgtgcatgtaccgcacagccaagacgcgggcactggtcctgaagggtatccctgagagcctccggggagagctgtggctcctcttctccggggcctggaatgagatggtgactcaccccgggtactatgctgagctggtggagaagtccaccgggaagtacagcctggccacagaggagatcgagcgagacctgcaccgctccatgcccgagcaccctgccttccagaacgagctggggattgctgccctccggcgggtgctgactgcctatgccttccgaaaccccaccatcggctactgccaggcaatgaacatcgtgacctcggtgctcctgctctatggcagtgaggaggaggccttctggctcctggtggccctgtgcgagcgcatgctgcccgactatgtggctcccacacacctctgctggcagggcgcatgttcaggctcctggacgaaaacaaggactcgctgatcaacttcaaggagttcgtgacagggatgagcgggatgtaccacggggacctgacagagaagctcaaggtgctctacaagctacaccttcccccagctctgagcccagaggaagccgagtcagccctggaggcggcccattatttcacagaggacagctcctcagaagaagcactaccacaggaagagcaagaaggaagtggaagtgaggagagaggagaggagaaggggaccagctctccggactatcggcactaccttcgaatgtgggccaaggagaaagaggctcagaaggagacgattaaggatcttcccaagatgaaccaggagcagttcattgagctgtgcaagacgctttacaacatgttcagtgaagaccccatggagcaggacctgtaccacgccatcgccaccgtggccagcctcctgctccgcatcggagaggtggggaagaagttctcagcccgcacaggcaggaagcccagggactgtgccactgaggaggacgagccaccagcacccgaactgcatcaggacgcagccagggagcttcagcccccagctgcaggagacccccaagccaaagcaggcggagacacacacctcggaacagccccacaggagagccaggtggtggtggaggggggcagcggcgagggacagggctcaccctcccagctgctgtctgacgatgaaaccaaagacgacatgtccatgtcctcctactcggtggtcagcacgggctccctgcaatgtgaagaccttgcagacgacacggtgctggtgggcggggaggcctgcagccccacagcgcgcatcggcggcaccgtcgacaccgactggtgcatctcctttgagcagatcctggcctccatcctgacggagtccgtgctggtgaacttctttgagaagagagtggacattggactcaagatcaaggaccaaaagaaagtggagagacagttcagcaccgccagtgaccatgagcagcctggagtttccggctgatgcctgcagctgtgaggcctggcccaaggtgtcatcagtggggctggcctcatctcctcctgcctttcctcccttatcagtttctctttaaaggtgtgcccctcctgctctcccaggagcagtgagttgtgagtggaaagaaggctggtgcagacccagctgccttagacagattccctgggcctgcatctcctggcgccggctgcttctgggcccaggaagaggctgtggctcccaccttccttacacctggtgggagcccgcctcgcaccagctgcacctgcctagcattagaggctctcagatctgcccttgcttgcctcatacctctgtgctccacactgcggccaggccagctgagtccctccatccgtggatgctttcctgcagctatgtggtatgggggtcattcctgcctcttgggcaccaggttggggggcatgtgcttgttgggcaccaaagtgatggaaccctcaggtgctctccgggagcctgaacctcctgactgaggaacatgggcagaacatgtttattgcacagagtgggcgctgcgcacaggcgtggctgtacacgtgctctcagctcatcatcctttccagtaactttaaaaaaacatccctcaggtcctgatatatttccttggattcatttcacttggctagaaattacactgtgctcaatgccttaataaatccctgaaagaaataaaaaccactgtgtgcaatgccttgctgtggcccccaaccactgcttaggcctcccaacttctccccaggccaagtatggggccctggctgtgttctggaagttcaagacacttagtcctccacagtgggtggaagagtgcaaggtctgccaggtcagatggagacgcagaacctgctggtgcaagctgggcaggtcctgaccaacctgcatcaggggatgccctgagctccacaggtcttcatgggcaggggttgtgggtcctggtgaaggaagtgcatcctcaggcctgggctgtagcaagctgtctgcccttgggttcaagaaccagactgtggagccaaaggtgaccgcagggggccccagggctggagccacaaggataccctcactttgcatgaggagctgaaactgaccagtgtccagtgttagcccccacatggggctgctcttgcttctactaaaagatacagcagttacccccttatccacaggggatacagtggatatctaaaaccagacccccagtggatgtctaaaaccacagataataacaaaccttatacatactgttttttcctatgcatacatacctgtgattaagtttatgaattaggcaccttaagagattgacaacaataactaataataaaatgtaacggttatactgtaa

SEQ ID NO: 456794 - DNA, 2459 bp, Homo sapiens
  misc_feature (26)..(26): n is a, c, g, or t
  misc_feature (30)..(30): n is a, c, g, or t
  misc_feature (45)..(45): n is a, c, g, or t
gggggggagaacgaactataggctanggtngaggccgggtgttgngctcctggacgaaaacaaggactcgctgatcaacttcaaggagttcgtgacagggatgagcgggatgtaccacggggacctgacagagaagctcaaggtgctctacaagctacaccttcccccagctctgagcccagaggaagccgagtcagccctggaggcggcccattatttcacagaggacagctcctcagaagaagcactaccacaggaagagcaagaaggaagtggaagtgaggagagaggagaggagaaggggaccagctctccggactatcggcactaccttcgaatgtgggccaaggagaaagaggctcagaaggagacgattaaggatcttcccaagatgaaccaggagcagttcattgagctgtgcaagacgctttacaacatgttcagtgaagaccccatggagcaggacctgtaccacgccatcgccaccgtggccagcctcctgctccgcatcggagaggtggggaagaagttctcagcccgcacaggcaggaagcccagggactgtgccactgaggaggacgagccaccagcacccgaactgcatcaggacgcagccagggagcttcagcccccagctgcaggagacccccaagccaaagcaggcggagacacacacctcggaacagccccacaggagagccaggtggtggtggaggggggcagcggcgagggacagggctcaccctcccagctgctgtctgacgatgaaaccaaagacgacatgtccatgtcctcctactcggtggtcagcacgggctccctgcaatgtgaagaccttgcagacgacacggtgctggtgggcggggaggcctgcagccccacagcgcgcatcggcggcaccgtcgacaccgactggtgcatctcctttgagcagatcctggcctccatcctgacggagtccgtgctggtgaacttctttgagaagagagtggacattggactcaagatcaaggaccaaaagaaagtggagagacagttcagcaccgccagtgaccatgagcagcctggagtttccggctgatgcctgcagctgtgaggcctggcccaaggtgtcatcagtggggctggcctcatctcctcctgcctttcctcccttatcagtttctctttaaaggtgtgcccctcctgctctcccaggagcagtgagttgtgagtggaaagaaggctggtgcagacccagctgccttagacagattccctgggcctgcatctcctggcgccggctgcttctgggcccaggaagaggctgtggctcccaccttccttacacctggtgggagcccgcctcgcaccagctgcacctgcctagcattagaggctctcagatctgcccttgcttgcctcatacctctgtgctccacactgcggccaggccagctgagtccctccatccgtggatgctttcctgcagctatgtggtatgggggtcattcctgcctcttgggcaccaggttggggggcatgtgcttgttgggcaccaaagtgatggaaccctcaggtgctctccgggagcctgaacctcctgactgaggaacatgggcagaacatgtttattgcacagagtgggcgctgcgcacaggcgtggctgtacacgtgctctcagctcatcatcctttccagtaactttaaaaaaacatccctcaggtcctgatatatttccttggattcatttcacttggctagaaattacactgtgctcaatgccttaataaatccctgaaagaaataaaaaccactgtgtgcaatgccttgctgtggcccccaaccactgcttaggcctcccaacttctccccaggccaagtatggggccctggctgtgttctggaagttcaagacacttagtcctccacagtgggtggaagagtgcaaggtctgccaggtcagatggagacgcagaacctgctggtgcaagctgggcaggtcctgaccaacctgcatcaggggatgccctgagctccacaggtcttcatgggcaggggttgtgggtcctggtgaaggaagtgcatcctcaggcctgggctgtagcaagctgtctgcccttgggttcaagaaccagactgtggagccaaaggtgaccgcagggggccccagggctggagccacaaggataccctcactttgcatgaggagctgaaactgaccagtgtccagtgttagcccccacatggggctgctcttgcttctactaaaagatacagcagttacccccttatccacaggggatacagtggatatctaaaaccagacccccagtggatgtctaaaaccacagataataacaaaccttatacatactgttttttcctatgcatacatacctgtgattaagtttatgaattaggcaccttaagagattgacaacaataactaataataaaatgtaacggttatactgtaa

SEQ ID NO: 456795 - DNA, 2640 bp, Homo sapiens
ggcacagcaggcgcgggtggaaggggtcattagggttcccctgagttctagcaggaacattccccagagttctagcaggaactatagaattcgttagtcctcagactggtctatagccctcatcattgttcacgtcaaaaccagcatgttgagacttgtattcatttgaaaaaaggaattgagggtttggcggcctttattttaacctgaccaagtgagggaatgctcaggcccttttgctctggtgccatagggcggggctgggcgggccaggcaggaggtgtggcatgggagacctgctccccagggcctggcctggggctggctgtacagaaacacagactacatctcaaggaccccaggagcttgcagtcccaacagcagaatgttattcatgttctttttatttttgcgtttgtccagaagcactaccacaggaagagcaagaaggaagtggaagtgaggagagaggagaggagaaggggaccagctctccggactatcggcactaccttcgaatgtgggccaaggagaaagaggctcagaaggagacgattaaggatcttcccaagatgaaccaggagcagttcattgagctgtgcaagacgctttacaacatgttcagtgaagaccccatggagcaggacctgtaccacgccatcgccaccgtggccagcctcctgctccgcatcggagaggtggggaagaagttctcagcccgcacaggcaggaagcccagggactgtgccactgaggaggacgagccaccagcacccgaactgcatcaggacgcagccagggagcttcagcccccagctgcaggagacccccaagccaaagcaggcggagacacacacctcggaacagccccacaggagagccaggtggtggtggaggggggcagcggcgagggacagggctcaccctcccagctgctgtctgacgatgaaaccaaagacgacatgtccatgtcctcctactcggtggtcagcacgggctccctgcaatgtgaagaccttgcagacgacacggtgctggtgggcggggaggcctgcagccccacagcgcgcatcggcggcaccgtcgacaccgactggtgcatctcctttgagcagatcctggcctccatcctgacggagtccgtgctggtgaacttctttgagaagagagtggacattggactcaagatcaaggaccaaaagaaagtggagagacagttcagcaccgccagtgaccatgagcagcctggagtttccggctgatgcctgcagctgtgaggcctggcccaaggtgtcatcagtggggctggcctcatctcctcctgcctttcctcccttatcagtttctctttaaaggtgtgcccctcctgctctcccaggagcagtgagttgtgagtggaaagaaggctggtgcagacccagctgccttagacagattccctgggcctgcatctcctggcgccggctgcttctgggcccaggaagaggctgtggctcccaccttccttacacctggtgggagcccgcctcgcaccagctgcacctgcctagcattagaggctctcagatctgcccttgcttgcctcatacctctgtgctccacactgcggccaggccagctgagtccctccatccgtggatgctttcctgcagctatgtggtatgggggtcattcctgcctcttgggcaccaggttggggggcatgtgcttgttgggcaccaaagtgatggaaccctcaggtgctctccgggagcctgaacctcctgactgaggaacatgggcagaacatgtttattgcacagagtgggcgctgcgcacaggcgtggctgtacacgtgctctcagctcatcatcctttccagtaactttaaaaaaacatccctcaggtcctgatatatttccttggattcatttcacttggctagaaattacactgtgctcaatgccttaataaatccctgaaagaaataaaaaccactgtgtgcaatgccttgctgtggcccccaaccactgcttaggcctcccaacttctccccaggccaagtatggggccctggctgtgttctggaagttcaagacacttagtcctccacagtgggtggaagagtgcaaggtctgccaggtcagatggagacgcagaacctgctggtgcaagctgggcaggtcctgaccaacctgcatcaggggatgccctgagctccacaggtcttcatgggcaggggttgtgggtcctggtgaaggaagtgcatcctcaggcctgggctgtagcaagctgtctgcccttgggttcaagaaccagactgtggagccaaaggtgaccgcagggggccccagggctggagccacaaggataccctcactttgcatgaggagctgaaactgaccagtgtccagtgttagcccccacatggggctgctcttgcttctactaaaagatacagcagttacccccttatccacaggggatacagtggatatctaaaaccagacccccagtggatgtctaaaaccacagataataacaaaccttatacatactgttttttcctatgcatacatacctgtgattaagtttatgaattaggcaccttaagagattgacaacaataactaataataaaatgtaacggttatactgtaa

SEQ ID NO: 456796 - DNA, 5146 bp, Homo sapiens
cgccgacggcggcgggcgcttccgcctcgcgggcctcggcccggtgcgagcggctccgcgatgtggctgagcccggaggaggtgctggtggccaatgcgctgtgggtgacggagcgggccaaccccttcttcgtgctgcagcgacgccggggccacggcaggggcggcggccttacgggtcttctcgtgggcaccctggacgtggtgctggactccagtgcccgcgtggccccttaccgcatcctgcaccagacccaggactcccaggtctactggacagtggcgtgtggttcttcccgcaaagagatcacaaaacactgggaatggctggaaaataacttgctccagacactgtccatcttcgacagtgaggaagatatcaccaccttcgtcaagggcaagatacacggaatcatcgcagaagagaacaagaacctgcagccccagggagacgaggaccccgggaagttcaaggaggctgagctgaagatgcggaagcagtttgggatgcctgagggcgagaagctggtgaattactactcctgcagctactggaagggccgcgtgccccggcagggctggctgtacctgacggtcaaccacctgtgcttctactccttcctgctggggaaggaagtgagcctcgtggtgcagtgggtggacataacgcgtctggagaagaacgccaccctgctcttccccgagagcatccgtgtggacacccgcgaccaggagctcttcttctccatgttcctcaacatcggcgagaccttcaagctcatggagcagttggccaacctggccatgcggcagctgctggacagcgagggcttcctggaggacaaggccctgcctaggcccatccggccacacaggaacatctcagccctgaagcgagacctggacgcccgagccaagaatgagtgctaccgagccacgttccggctgcccagggatgagcggctagacggccacacaagctgcaccctgtggacgccgttcaacaagctgcacatccctggccagatgttcatctccaacaactacatctgcttcgccagcaaggaggaggacgcttgccacctcatcatacccctgagggaggtgaccattgtcgaaaaagctgacagctccagcgtgctgcccagccccctgtccatcagcaccaaaagcaaaatgacattcctgtttgccaacctgaaagaccgtgatttcttggtgcagaggatctctgacttcctccagaaaacaccatccaagcagccaggcagtatcgggagcaggaaagccagtgttgtggaccctagcacagagtcttccccagctcctcaggaggggtcggagcagcccgccagcccagcctctcccctcagcagccgccagagcttctgtgcgcaggaggcgccaaccgcatcccagggcctgctgaagctcttccagaaaaactcgcccatggaggaccttggagccaagggggccaaggagaagatgaaagaggagtcatggcacatccacttcttcgagtacgggcgtggcgtgtgcatgtaccgcacagccaagacgcgggcactggtcctgaagggtatccctgagagcctccggggagagctgtggctcctcttctccggggcctggaatgagatggtgactcaccccgggtactatgctgagctggtggagaagtccaccgggaagtacagcctggccacagaggagatcgagcgagacctgcaccgctccatgcccgagcaccctgccttccagaacgagctggggattgctgccctccggcgggtgctgactgcctatgccttccgaaaccccaccatcggctactgccaggcaatgaacatcgtgacctcggtgctcctgctctatggcagtgaggaggaggccttctggctcctggtggccctgtgcgagcgcatgctgcccgactactacaacaccagggtggtgggagccctggtggaccaaggcatcttcgaagagctcacgagagacttcctgccgcagctctcggagaagatgcaggacctgggggtgatctccagcatctcgctgtcctggttcctgaccctcttcctcagcgtcatgcccttcgagagcgccgtggtcatcgtcgactgctttttctatgagggcatcaaggtgatcctgcaggtggccctggccgtcctggacgccaacatggagcagctgctgggctgcagcgacgagggcgaggccatgaccatgctgggcagatacctggataatgtggtcaacaagcagagtgtctctcctcctatcccgcacctccgtgccttgctgagcagcagcgatgacccccctgcagaggtggacatctttgagctcctgaaagtgtcctatgagaaattcagcagcctgagggccgaagacattgagcagatgcggtttaaacagaggctgaaagtgatccagtccttggaggacacggccaagaggagtgtggtccgagctatacctgtggacattggtttctccattgaagagctggaggacctttacatggtgtttaaggccaagcacctggctagccagtactgggggtgcagccgcacaatggccggccgtcgggaccccagcctgccctacctggagcagtaccggattgatgccagccagttccgggaactctttgccagcctgacaccctgggcctgtggctcccacacacctctgctggcagggcgcatgttcaggctcctggacgaaaacaaggactcgctgatcaacttcaaggagttcgtgacagggatgagcgggatgtaccacggggacctgacagagaagctcaaggtgctctacaagctacaccttcccccagctctgagcccagaggaagccgagtcagccctggaggcggcccattatttcacagaggacagctcctcagaagcatctcctctggcctcagatctggatcttttcctgccctgggaggctcaagaagcactaccacaggaagagcaagaaggaagtggaagtgaggagagaggagaggagaaggggaccagctctccggactatcggcactaccttcgaatgtgggccaaggagaaagaggctcagaaggagacgattaaggatcttcccaagatgaaccaggagcagttcattgagctgtgcaagacgctttacaacatgttcagtgaagaccccatggagcaggacctgtaccacgccatcgccaccgtggccagcctcctgctccgcatcggagaggtggggaagaagttctcagcccgcacaggcaggaagcccagggactgtgccactgaggaggacgagccaccagcacccgaactgcatcaggacgcagccagggagcttcagcccccagctgcaggagacccccaagccaaagcaggcggagacacacacctcggaacagccccacaggagagccaggtggtggtggaggggggcagcggcgagggacagggctcaccctcccagctgctgtctgacgatgaaaccaaagacgacatgtccatgtcctcctactcggtggtcagcacgggctccctgcaatgtgaagaccttgcagacgacacggtgctggtgggcggggaggcctgcagccccacagcgcgcatcggcggcaccgtcgacaccgactggtgcatctcctttgagcagatcctggcctccatcctgacggagtccgtgctggtgaacttctttgagaagagagtggacattggactcaagatcaaggaccaaaagaaagtggagagacagttcagcaccgccagtgaccatgagcagcctggagtttccggctgatgcctgcagctgtgaggcctggcccaaggtgtcatcagtggggctggcctcatctcctcctgcctttcctcccttatcagtttctctttaaaggtgtgcccctcctgctctcccaggagcagtgagttgtgagtggaaagaaggctggtgcagacccagctgccttagacagattccctgggcctgcatctcctggcgccggctgcttctgggcccaggaagaggctgtggctcccaccttccttacacctggtgggagcccgcctcgcaccagctgcacctgcctagcattagaggctctcagatctgcccttgcttgcctcatacctctgtgctccacactgcggccaggccagctgagtccctccatccgtggatgctttcctgcagctatgtggtatgggggtcattcctgcctcttgggcaccaggttggggggcatgtgcttgttgggcaccaaagtgatggaaccctcaggtgctctccgggagcctgaacctcctgactgaggaacatgggcagaacatgtttattgcacagagtgggcgctgcgcacaggcgtggctgtacacgtgctctcagctcatcatcctttccagtaactttaaaaaaacatccctcaggtcctgatatatttccttggattcatttcacttggctagaaattacactgtgctcaatgccttaataaatccctgaaagaaataaaaaccactgtgtgcaatgccttgctgtggcccccaaccactgcttaggcctcccaacttctccccaggccaagtatggggccctggctgtgttctggaagttcaagacacttagtcctccacagtgggtggaagagtgcaaggtctgccaggtcagatggagacgcagaacctgctggtgcaagctgggcaggtcctgaccaacctgcatcaggggatgccctgagctccacaggtcttcatgggcaggggttgtgggtcctggtgaaggaagtgcatcctcaggcctgggctgtagcaagctgtctgcccttgggttcaagaaccagactgtggagccaaaggtgaccgcagggggccccagggctggagccacaaggataccctcactttgcatgaggagctgaaactgaccagtgtccagtgttagcccccacatggggctgctcttgcttctactaaaagatacagcagttacccccttatccacaggggatacagtggatatctaaaaccagacccccagtggatgtctaaaaccacaggtatgtatgcacaggaaaaaacagtatgtataaggtttgttattatctgtggttttagacatccactgggggtcgtcgacg

SEQ ID NO: 456797 - DNA, 2209 bp, Homo sapiens
gtctcacatgacaaagattaatctctttcctcctaacctgcagaggagaaggggaccagctctccggactatcggcactaccttcgaatgtgggccaaggagaaagaggctcagaaggagacgattaaggatcttcccaagatgaaccaggagcagttcattgagctgtgcaagacgctttacaacatgttcagtgaagaccccatggagcaggacctgtaccacgccatcgccaccgtggccagcctcctgctccgcatcggagaggtggggaagaagttctcagcccgcacaggcaggaagcccagggactgtgccactgaggaggacgagccaccagcacccgaactgcatcaggacgcagccagggagcttcagcccccagctgcaggagacccccaagccaaagcaggcggagacacacacctcggaacagccccacaggagagccaggtggtggtggaggggggcagcggcgagggacagggctcaccctcccagctgctgtctgacgatgaaaccaaagacgacatgtccatgtcctcctactcggtggtcagcacgggctccctgcaatgtgaagaccttgcagacgacacggtgctggtgggcggggaggcctgcagccccacagcgcgcatcggcggcaccgtcgacaccgactggtgcatctcctttgagcagatcctggcctccatcctgacggagtccgtgctggtgaacttctttgagaagagagtggacattggactcaagatcaaggaccaaaagaaagtggagagacagttcagcaccgccagtgaccatgagcagcctggagtttccggctgatgcctgcagctgtgaggcctggcccaaggtgtcatcagtggggctggcctcatctcctcctgcctttcctcccttatcagtttctctttaaaggtgtgcccctcctgctctcccaggagcagtgagttgtgagtggaaagaaggctggtgcagacccagctgccttagacagattccctgggcctgcatctcctggcgccggctgcttctgggcccaggaagaggctgtggctcccaccttccttacacctggtgggagcccgcctcgcaccagctgcacctgcctagcattagaggctctcagatctgcccttgcttgcctcatacctctgtgctccacactgcggccaggccagctgagtccctccatccgtggatgctttcctgcagctatgtggtatgggggtcattcctgcctcttgggcaccaggttggggggcatgtgcttgttgggcaccaaagtgatggaaccctcaggtgctctccgggagcctgaacctcctgactgaggaacatgggcagaacatgtttattgcacagagtgggcgctgcgcacaggcgtggctgtacacgtgctctcagctcatcatcctttccagtaactttaaaaaaacatccctcaggtcctgatatatttccttggattcatttcacttggctagaaattacactgtgctcaatgccttaataaatccctgaaagaaataaaaaccactgtgtgcaatgccttgctgtggcccccaaccactgcttaggcctcccaacttctccccaggccaagtatggggccctggctgtgttctggaagttcaagacacttagtcctccacagtgggtggaagagtgcaaggtctgccaggtcagatggagacgcagaacctgctggtgcaagctgggcaggtcctgaccaacctgcatcaggggatgccctgagctccacaggtcttcatgggcaggggttgtgggtcctggtgaaggaagtgcatcctcaggcctgggctgtagcaagctgtctgcccttgggttcaagaaccagactgtggagccaaaggtgaccgcagggggccccagggctggagccacaaggataccctcactttgcatgaggagctgaaactgaccagtgtccagtgttagcccccacatggggctgctcttgcttctactaaaagatacagcagttacccccttatccacaggggatacagtggatatctaaaaccagacccccagtggatgtctaaaaccacagataataacaaaccttatacatactgttttttcctatgcatacatacctgtgattaagtttatgaattaggcaccttaagagattgacaacaataactaataataaaatgtaacggttatactgtaa

SEQ ID NO: 456798 - DNA, 5044 bp, Homo sapiens
cgccgacggcggcgggcgcttccgcctcgcgggcctcggcccggtgcgagcggctccgcgatgtggctgagcccggaggaggtgctggtggccaatgcgctgtgggtgacggagcgggccaaccccttcttcgtgctgcagcgacgccggggccacggcaggggcggcggccttacgggtcttctcgtgggcaccctggacgtggtgctggactccagtgcccgcgtggccccttaccgcatcctgcaccagacccaggactcccaggtctactggacagtggcgtgtggttcttcccgcaaagagatcacaaaacactgggaatggctggaaaataacttgctccagacactgtccatcttcgacagtgaggaagatatcaccaccttcgtcaagggcaagatacacggaatcatcgcagaagagaacaagaacctgcagccccagggagacgaggaccccgggaagttcaaggaggctgagctgaagatgcggaagcagtttgggatgcctgagggcgagaagctggtgaattactactcctgcagctactggaagggccgcgtgccccggcagggctggctgtacctgacggtcaaccacctgtgcttctactccttcctgctggggaaggaagtgagcctcgtggtgcagtgggtggacataacgcgtctggagaagaacgccaccctgctcttccccgagagcatccgtgtggacacccgcgaccaggagctcttcttctccatgttcctcaacatcggcgagaccttcaagctcatggagcagttggccaacctggccatgcggcagctgctggacagcgagggcttcctggaggacaaggccctgcctaggcccatccggccacacaggaacatctcagccctgaagcgagacctggacgcccgagccaagaatgagtgctaccgagccacgttccggctgcccagggatgagcggctagacggccacacaagctgcaccctgtggacgccgttcaacaagctgcacatccctggccagatgttcatctccaacaactacatctgcttcgccagcaaggaggaggacgcttgccacctcatcatacccctgagggaggtgaccattgtcgaaaaagctgacagctccagcgtgctgcccagccccctgtccatcagcaccaaaagcaaaatgacattcctgtttgccaacctgaaagaccgtgatttcttggtgcagaggatctctgacttcctccagaaaacaccatccaagcagccaggcagtatcgggagcaggaaagccagtgttgtggaccctagcacagagtcttccccagctcctcaggaggggtcggagcagcccgccagcccagcctctcccctcagcagccgccagagcttctgtgcgcaggaggcgccaaccgcatcccagggcctgctgaagctcttccagaaaaactcgcccatggaggaccttggagccaagggggccaaggagaagatgaaagaggagtcatggcacatccacttcttcgagtacgggcgtggcgtgtgcatgtaccgcacagccaagacgcgggcactggtcctgaagggtatccctgagagcctccggggagagctgtggctcctcttctccggggcctggaatgagatggtgactcaccccgggtactatgctgagctggtggagaagtccaccgggaagtacagcctggccacagaggagatcgagcgagacctgcaccgctccatgcccgagcaccctgccttccagaacgagctggggattgctgccctccggcgggtgctgactgcctatgccttccgaaaccccaccatcggctactgccaggcaatgaacatcgtgacctcggtgctcctgctctatggcagtgaggaggaggccttctggctcctggtggccctgtgcgagcgcatgctgcccgactactacaacaccagggtggtgggagccctggtggaccaaggcatcttcgaagagctcacgagagacttcctgccgcagctctcggagaagatgcaggacctgggggtgatctccagcatctcgctgtcctggttcctgaccctcttcctcagcgtcatgcccttcgagagcgccgtggtcatcgtcgactgctttttctatgagggcatcaaggtgatcctgcaggtggccctggccgtcctggacgccaacatggagcagctgctgggctgcagcgacgagggcgaggccatgaccatgctgggcagatacctggataatgtggtcaacaagcagagtgtctctcctcctatcccgcacctccgtgccttgctgagcagcagcgatgacccccctgcagaggtggacatctttgagctcctgaaagtgtcctatgagaaattcagcagcctgagggccgaagacattgagcagatgcggtttaaacagaggctgaaagtgatccagtccttggaggacacggccaagaggagtgtggtccgagctatacctgtggacattggtttctccattgaagagctggaggacctttacatggtgtttaaggccaagcacctggctagccagtactgggggtgcagccgcacaatggccggccgtcgggaccccagcctgccctacctggagcagtaccggattgatgccagccagttccgggaactctttgccagcctgacaccctgggcctgtggctcccacacacctctgctggcagggcgcatgttcaggctcctggacgaaaacaaggactcgctgatcaacttcaaggagttcgtgacagggatgagcgggatgtaccacggggacctgacagagaagctcaaggtgctctacaagctacaccttcccccagctctgagcccagaggaagccgagtcagccctggaggcggcccattatttcacagaggacagctcctcagaagaagcactaccacaggaagagcaagaaggaagtggaagtgaggagagaggagaggagaaggggaccagctctccggactatcggcactaccttcgaatgtgggccaaggagaaagaggctcagaaggagacgattaaggatcttcccaagatgaaccaggagcagttcattgagctgtgcaagacgctttacaacatgttcagtgaagaccccatggagcaggacctgtaccacgccatcgccaccgtggccagcctcctgctccgcatcggagaggtggggaagaagttctcagcccgcacaggcaggaagcccagggactgtgccactgaggaggacgagccaccagcacccgaactgcatcaggacgcagccagggagcttcagcccccagctgcaggagacccccaagccaaagcaggcggagacacacacctcggaacagccccacaggagagccaggtggtggtggaggggggcagcggcgagggacagggctcaccctcccagctgctgtctgacgatgaaaccaaagacgacatgtccatgtcctcctactcggtggtcagcacgggctccctgcaatgtgaagaccttgcagacgacacggtgctggtgggcggggaggcctgcagccccacagcgcgcatcggcggcaccgtcgacaccgactggtgcatctcctttgagcagatcctggcctccatcctgacggagtccgtgctggtgaacttctttgagaagagagtggacattggactcaagatcaaggaccaaaagaaagtggagagacagttcagcaccgccagtgaccatgagcagcctggagtttccggctgatgcctgcagctgtgaggcctggcccaaggtgtcatcagtggggctggcctcatctcctcctgcctttcctcccttatcagtttctctttaaaggtgtgcccctcctgctctcccaggagcagtgagttgtgagtggaaagaaggctggtgcagacccagctgccttagacagattccctgggcctgcatctcctggcgccggctgcttctgggcccaggaagaggctgtggctcccaccttccttacacctggtgggagcccgcctcgcaccagctgcacctgcctagcattagaggctctcagatctgcccttgcttgcctcttgggcaccaggttggggggcatgtgcttgttgggcaccaaagtgatggaaccctcaggtgctctccgggagcctgaacctcctgactgaggaacatgggcagaacatgtttattgcacagagtgggcgctgcgcacaggcgtggctgtacacgtgctctcagctcatcatcctttccagtaactttaaaaaaacatccctcaggtcctgatatatttccttggattcatttcacttggctagaaattacactgtgctcaatgccttaataaatccctgaaagaaataaaaaccactgtgtgcaatgccttgctgtggcccccaaccactgcttaggcctcccaacttctccccaggccaagtatggggccctggctgtgttctggaagttcaagacacttagtcctccacagtgggtggaagagtgcaaggtctgccaggtcagatggagacgcagaacctgctggtgcaagctgggcaggtcctgaccaacctgcatcaggggatgccctgagctccacaggtcttcatgggcaggggttgtgggtcctggtgaaggaagtgcatcctcaggcctgggctgtagcaagctgtctgcccttgggttcaagaaccagactgtggagccaaaggtgaccgcagggggccccagggctggagccacaaggataccctcactttgcatgaggagctgaaactgaccagtgtccagtgttagcccccacatggggctgctcttgcttctactaaaagatacagcagttacccccttatccacaggggatacagtggatatctaaaaccagacccccagtggatgtctaaaaccacagataataacaaaccttatacatactgttttttcctatgcatacatacctgtgattaagtttatgaattaggcaccttaagagattgacaacaataactaataataaaatgtaacggttatactgtaa

SEQ ID NO: 456799 - DNA, 4990 bp, Homo sapiens
cgccgacggcggcgggcgcttccgcctcgcgggcctcggcccggtgcgagcggctccgcgatgtggctgagcccggaggaggtgctggtggccaatgcgctgtgggtgacggagcgggccaaccccttcttcgtgctgcagcgacgccggggccacggcaggggcggcggccttacgggtcttctcgtgggcaccctggacgtggtgctggactccagtgcccgcgtggccccttaccgcatcctgcaccagacccaggactcccaggtctactggacagtggcgtgtggttcttcccgcaaagagatcacaaaacactgggaatggctggaaaataacttgctccagacactgtccatcttcgacagtgaggaagatatcaccaccttcgtcaagggcaagatacacggaatcatcgcagaagagaacaagaacctgcagccccagggagacgaggaccccgggaagttcaaggaggctgagctgaagatgcggaagcagtttgggatgcctgagggcgagaagctggtgaattactactcctgcagctactggaagggccgcgtgccccggcagggctggctgtacctgacggtcaaccacctgtgcttctactccttcctgctggggaaggaagtgagcctcgtggtgcagtgggtggacataacgcgtctggagaagaacgccaccctgctcttccccgagagcatccgtgtggacacccgcgaccaggagctcttcttctccatgttcctcaacatcggcgagaccttcaagctcatggagcagttggccaacctggccatgcggcagctgctggacagcgagggcttcctggaggacaaggccctgcctaggcccatccggccacacaggaacatctcagccctgaagcgagacctggacgcccgagccaagaatgagtgctaccgagccacgttccggctgcccagggatgagcggctagacggccacacaagctgcaccctgtggacgccgttcaacaagctgcacatccctggccagatgttcatctccaacaactacatctgcttcgccagcaaggaggaggacgcttgccacctcatcatacccctgagggaggtgaccattgtcgaaaaagctgacagctccagcgtgctgcccagccccctgtccatcagcaccaaaagcaaaatgacattcctgtttgccaacctgaaagaccgtgatttcttggtgcagaggatctctgacttcctccagaaaacaccatccaagcagccaggcagtatcgggagcaggaaagccagtgttgtggaccctagcacagagtcttccccagctcctcaggaggggtcggagcagcccgccagcccagcctctcccctcagcagccgccagagcttctgtgcgcaggaggcgccaaccgcatcccagggcctgctgaagctcttccagaaaaactcgcccatggaggaccttggagccaagggggccaaggagaagatgaaagaggagtcatggcacatccacttcttcgagtacgggcgtggcgtgtgcatgtaccgcacagccaagacgcgggcactggtcctgaagggtatccctgagagcctccggggagagctgtggctcctcttctccggggcctggaatgagatggtgactcaccccgggtactatgctgagctggtggagaagtccaccgggaagtacagcctggccacagaggagatcgagcgagacctgcaccgctccatgcccgagcaccctgccttccagaacgagctggggattgctgccctccggcgggtgctgactgcctatgccttccgaaaccccaccatcggctactgccaggcaatgaacatcgtgacctcggtgctcctgctctatggcagtgaggaggaggccttctggctcctggtggccctgtgcgagcgcatgctgcccgactactacaacaccagggtggtgggagccctggtggaccaaggcatcttcgaagagctcacgagagacttcctgccgcagctctcggagaagatgcaggacctgggggtgatctccagcatctcgctgtcctggttcctgaccctcttcctcagcgtcatgcccttcgagagcgccgtggtcatcgtcgactgctttttctatgagggcatcaaggtgatcctgcaggtggccctggccgtcctggacgccaacatggagcagctgctgggctgcagcgacgagggcgaggccatgaccatgctgggcagatacctggataatgtggtcaacaagcagagtgtctctcctcctatcccgcacctccgtgccttgctgagcagcagcgatgacccccctgcagaggtggacatctttgagctcctgaaagtgtcctatgagaaattcagcagcctgagggccgaagacattgagcagatgcggtttaaacagaggctgaaagtgatccagtccttggaggacacggccaagaggagtgtggtccgagctatacctgtggacattggtttctccattgaagagctggaggacctttacatggtgtttaaggccaagcacctggctagccagtactgggggtgcagccgcacaatggccggccgtcgggaccccagcctgccctacctggagcagtaccggattgatgccagccagttccgggaactctttgccagcctgacaccctgggcctgtggctcccacacacctctgctggcagggcgcatgttcaggctcctggacgaaaacaaggactcgctgatcaacttcaaggagttcgtgacagggatgagcgggatgtaccacggggacctgacagagaagctcaaggtgctctacaagctacaccttcccccagctctgagcccagaggaagccgagtcagccctggaggcggcccattatttcacagaggacagctcctcagaagaagcactaccacaggaagagcaagaaggaagtggaagtgaggagagaggagaggagaaggggaccagctctccggactatcggcactaccttcgaatgtgggccaaggagaaagaggctcagaaggagacgattaaggatcttcccaagatgaaccaggagcagttcattgagctgtgcaagacgctttacaacatgttcagtgaagaccccatggagcaggacctgtaccacgccatcgccaccgtggccagcctcctgctccgcatcggagaggtggggaagaagttctcagcccgcacaggcaggaagcccagggactgtgccactgaggaggacgagccaccagcacccgaactgcatcaggacgcagccagggagcttcagcccccagctgcaggagacccccaagccaaagcaggcggagacacacacctcggaacagccccacaggagagccaggtggtggtggaggggggcagcggcgagggacagggctcaccctcccagctgctgtctgacgatgaaaccaaagacgacatgtccatgtcctcctactcggtggtcagcacgggctccctgcaatgtgaagaccttgcagacgacacggtgctggtgggcggggaggcctgcagccccacagcgcgcatcggcggcaccgtcgacaccgactggtgcatctcctttgagcagatcctggcctccatcctgacggagtccgtgctggtgaacttctttgagaagagagtggacattggactcaagatcaaggacctttccggctgatgcctgcagctgtgaggcctggcccaaggtgtcatcagtggggctggcctcatctcctcctgcctttcctcccttatcagtttctctttaaaggtgtgcccctcctgctctcccaggagcagtgagttgtgagtggaaagaaggctggtgcagacccagctgccttagacagattccctgggcctgcatctcctggcgccggctgcttctgggcccaggaagaggctgtggctcccaccttccttacacctggtgggagcccgcctcgcaccagctgcacctgcctagcattagaggctctcagatctgcccttgcttgcctcttgggcaccaggttggggggcatgtgcttgttgggcaccaaagtgatggaaccctcaggtgctctccgggagcctgaacctcctgactgaggaacatgggcagaacatgtttattgcacagagtgggcgctgcgcacaggcgtggctgtacacgtgctctcagctcatcatcctttccagtaactttaaaaaaacatccctcaggtcctgatatatttccttggattcatttcacttggctagaaattacactgtgctcaatgccttaataaatccctgaaagaaataaaaaccactgtgtgcaatgccttgctgtggcccccaaccactgcttaggcctcccaacttctccccaggccaagtatggggccctggctgtgttctggaagttcaagacacttagtcctccacagtgggtggaagagtgcaaggtctgccaggtcagatggagacgcagaacctgctggtgcaagctgggcaggtcctgaccaacctgcatcaggggatgccctgagctccacaggtcttcatgggcaggggttgtgggtcctggtgaaggaagtgcatcctcaggcctgggctgtagcaagctgtctgcccttgggttcaagaaccagactgtggagccaaaggtgaccgcagggggccccagggctggagccacaaggataccctcactttgcatgaggagctgaaactgaccagtgtccagtgttagcccccacatggggctgctcttgcttctactaaaagatacagcagttacccccttatccacaggggatacagtggatatctaaaaccagacccccagtggatgtctaaaaccacagataataacaaaccttatacatactgttttttcctatgcatacatacctgtgattaagtttatgaattaggcaccttaagagattgacaacaataactaataataaaatgtaacggttatactgtaa

SEQ ID NO: 456800 - DNA, 2380 bp, Homo sapiens
cgccgacggcggcgggcgcttccgcctcgcgggcctcggcccggtgcgagcggctccgcgatgtggctgagcccggaggaggtgctggtggccaatgcgctgtgggtgacggagcgggccaaccccttcttcgtgctgcagcgacgccggggccacggcaggggcggcggccttacgggtcttctcgtgggcaccctggacgtggtgctggactccagtgcccgcgtggccccttaccgcatcctgcaccagacccaggactcccaggtctactggacagtggcgtgtggttcttcccgcaaagagatcacaaaacactgggaatggctggaaaataacttgctccagacactgtccatcttcgacagtgaggaagatatcaccaccttcgtcaagggcaagatacacggaatcatcgcagaagagaacaagaacctgcagccccagggagacgaggaccccgggaagttcaaggaggctgagctgaagatgcggaagcagtttgggatgcctgagggcgagaagctggtgaattactactcctgcagctactggaagggccgcgtgccccggcagggctggctgtacctgacggtcaaccacctgtgcttctactccttcctgctggggaaggaagtgagcctcgtggtgcagtgggtggacataacgcgtctggagaagaacgccaccctgctcttccccgagagcatccgtgtggacacccgcgaccaggagctcttcttctccatgttcctcaacatcggcgagaccttcaagctcatggagcagttggccaacctggccatgcggcagctgctggacagcgagggcttcctggaggacaaggccctgcctaggcccatccggccacacaggaacatctcagccctgaagcgagacctggacgcccgagccaagaatgagtgctaccgagccacgttccggctgcccagggatgagcggctagacggccacacaagctgcaccctgtggacgccgttcaacaagctgcacatccctggccagatgttcatctccaacaactacatctgcttcgccagcaaggaggaggacgcttgccacctcatcatacccctgagggaggtgaccattgtcgaaaaagctgacagctccagcgtgctgcccagccccctgtccatcagcaccaaaagcaaaatgacattcctgtttgccaacctgaaagaccgtgatttcttggtgcagaggatctctgacttcctccagaaaacaccatccaagcagccaggcagtatcgggagcaggaaagccagtgttgtggaccctagcacagaggtgagaagccccttgggagcagcagggtcgagttgggcccaggaagagccagggcatccatcagcctccccgctggagcctgaccccatggttccggctgtgggcctccgcctaggggtggatgtgtcagagctggcaagagacccctagcccagacccacactgcccagcaacatcacagcctctctgcacccccagccacacacccggtactcctcactcctgctgggcccattgcccatgaggaaccttctctggctgtcctttctgcattgctgctgcactcagagcaaagccacactgtggaggcctgtacacttcggctttgttcccatgaccttccctgccaggcgttcaggctgaagttcttgacggtagaactgcagtatcactattgtaccagcaaacttaacaagaattccttaatatcaccaaatattgtattcacacttccccgtgtgcaagtgtacttttcacggtttgattatttgaactgaggcagacgaaagtcacacatgtcactcttggttgataggtctcttaaatctgtttaatctacgggcttctgctccacctagctctcgtttattcttccacaatatttttttgaaggaatcggtcacttgtgccatagagtctctcatcgtctggttttgctgattgcatccgctgcaggcgtttagcaagctcctgtgtctcttgtttaagttggttgagcggtgagaccgagagccgtgatcacattcaggctcagctgattttggttctggcaggtccgcctgtgggcaggcttgaggtgctgtttattcccaacaagagatgtctggcaaccagccacctctctatgctactgtcagtcattgagaatatgcctggatccagcggccagtggccagcggcatgctcattccattcctcctttcgtctgggagctgaaattctcccaaagagggaagctgaccccaggcacagttcatagaggaaaggtggaatacatgttttactctttcctcttactcaccagttgtcaaaataatgatgagttggttttctagtgtcttccaca

SEQ ID NO: 456801 - DNA, 1182 bp, Homo sapiens
cgccgacggcggcgggcgcttccgcctcgcgggcctcggcccggtgcgagcggctccgcgatgtggctgagcccggaggaggtgctggtggccaatgcgctgtgggtgacggagcgggccaaccccttcttcgtgctgcagcgacgccggggccacggcaggggcggcggccttacgggtcttctcgtgggcaccctggacgtggtgctggactccagtgcccgcgtggccccttaccgcatcctgcaccagacccaggactcccaggtctactggacagtggcgtgtggttcttcccgcaaagagatcacaaaacactgggaatggctggaaaataacttgctccagacactgtccatcttcgacagtgaggaagatatcaccaccttcgtcaagggcaagatacacggaatcatcgcagaagagaacaagaacctgcagccccagggagacgaggaccccgggaagttcaaggaggctgagctgaagatgcggaagcagtttgggatgcctgagggcgagaagctggtgaattactactcctgcagctactggaagggccgcgtgccccggcagggctggctgtacctgacggtcaaccacctgtgcttctactccttcctgctggggaaggaagtgagcctcgtggtgcagtgggtggacataacgcgtctggagaagaacgccaccctgctcttccccgagagcatccgtgtggacacccgcgaccaggagctcttcttctccatgttcctcaacatcggcgagaccttcaagctcatggagcagttggccaacctggccatgcggcagctgctggacagcgagggcttcctggaggacaaggccctgcctaggcccatccggccacacaggaacatctcagccctgaagcgagacctggacgcccgagccaagaatgagtgctaccgagccacgttccggctgcccagggatgagcggctagacggccacacaagctgcaccctgtggacgccgttcaacaagctgcacatccctggccagatgttcatctccaacaactacatctgcttcgccagcaaggaggaggacgcttgccacctcatcatacccctgagggaggtgaccattgtcgaaaaagctgactatccagcgtgctgcccttcccccgtagtcataagggatcgtctagatcacccg

SEQ ID NO: 456802 - DNA, 374 bp, Homo sapiens
tgccctgttactgcccccaaagtaccagaagaaggacagagacagctggcacccgtgtctccccaggggcctggaatgagatggtgactcaccccgggtactatgctgagctggtggagaagtccaccgggaagtacagcctggccacagaggagatcgagcgagacctgcaccgctccatgcccgagcaccctgccttccagaacgagctggggattgctgccctccggcgggtgctgactgcctatgccttccgaaaccccaccatcggctactgccaggtaaggggcctgacaggggcccagagacagcatctgccaccagaggttcacaggagcaggtccctgtggtcccaggcctgtgtggtgaccctg

SEQ ID NO: 456803 - DNA, 2007 bp, Homo sapiens
gtggagggaacacgtgcagtgccgtggtgtggggatctcggcccctctctctgggttcgtcgtggttgagatgattacctcggacgtctacggaaacgagcgggcgcattgttgtccgcttgtgtgtgtgtgtgtgtgtgtgtgtgtgcgcgtacattgattactatccatttctttagtcaacgctctccacttcctgatttctgctttaaggaaaactgtgaactttctgcttcatgtatcagttttaaagcagcccaggcaaagatcatctacagattctaggaattctctcccctgaaatcaaaacctggaagacttttttttcttattttagttgagaagtttcataaactgctcaaggattagttttccaggactctgcggaggaacggcaggaagaacctcagagagggcagaggtgacttcaaagtgctggggactccgtcctgagggtcacttggccctgagcccctgcgtgcccttgcggaagcccagaagcttcttcctgctgcacctcccgtttccgctgctgctgacgtttatgcatttcatgatggggtccaacaagaacacctgacttgggtgaagttgtgcaatattggaggctgactgtagggctgggcagctgggagacaggctcatggctcatggctcatggctcagggcggtgcctgccctgggccgggacccccctccccaccccccacctaggctttttgggttttgttcaaggaaggtaaagtgagaggtttaggtcagtgtttttaagtttttgttttttttttaaagcaaatcctgtatatgtatctacatgggagacaggtagacactacttatttgttacattttgtactacacgtttgtgttccaggtttcagcttccctcgctcctgttgttaagaagcgtccctgtcagcacaggtgtgcattgaggaaggggccccagggccttcgctccctcagcactggggtggaggcggcaggaaggggcggcccttacctggcaggtctgggcgcacctttagcaggtggactccgtggggctccaccagccagaagcctttggaaggcaacgaaggcaatgctgctccctgagtccagtccccgcccccaaacccagcccaggtgccttcagctacttcggcttcttaaaccctgcagtgttaaacagaggcattgagaaaggggaaaggcgggtatttttaaaagccaaagattgacccagttacttgagggtagggaggcgggcccagtgcaggaggctgcatccctggcctgctggtgcccaccgggggctgtgcctgtgccgggccgcagggaagctggctgcccccattcctgctgctgctgctgctgctgctctgtggctgtttcaaagactgggcgaaaggctgtccggagggcagaccaggtgccttgccgcagagaaaacaccaaagtctcctgttcgctcataaagaagtttttgggatgggagagaatccagaccatcttggggcagccaggcccttgccttcatttttacagaggtagcacaattgattccaacacaaaactccttcccctttttaaaatgatttctgttctaatgccatagatcaaaggcctcagaaaccattgtgtgtttcctctttgaagcaatgacaagcactttactttcacggtggtttttgttttttcttattgctgtggaacctcttttggaggacgttaaaggcgtgttttacttgtttttttaagagtgtgtgatgtgtgttttgtagatttcttgacagtgctgtaatacagacggcaatgcaatagcctatttaaagacactacgtgatctgattgagatgtacatagtttttttttttaccataactgaattattttatctcttatgttaacatgagaaatgtatgccaaatgattagttgatgtatgttttttaatttaatatttaaataaaatatttggaaggaaaaaaccttgactttttcccttcctctctctctcatctct

SEQ ID NO: 456804 - DNA, 1967 bp, Homo sapiens
gtggagggaacacgtgcagtgccgtggtgtggggatctcggcccctctctctgggttcgtcgtggttgagatgattacctcggacgtctacggaaacgagcgggcgcattgttgtccgcttgtgtgtgtgtgtgtgtgtgtgtgtgtgcgcgtacattgattactatccatttctttagtcaacgctctccacttcctgatttctgctttaaggaaaactgtgaactttctgcttcatgtatcagttttaaagcagcccaggcaaagatcatctacagattctaggaattctctcccctgaaatcaaaacctggaagacttttttttcttattttagttgagaagtttcataaactgctcaaggattagttttccaggactctgcggaggaacggcaggaagaacctcagagagggcagaggtgacttcaaagtgctggggactccgtcctgagggtcacttggccctgagcccctgcgtgcccttgcggaagcccagaagcttcttcctgctgcacctcccgtttccgctgctgctgacgtttatgcatttcatgatggggtccaacaagaacacctgacttgggtgaagttgtgcaatattggaggctgactgtagggctgggcagctgggagacaggctcatggctcatggctcatggctcagggcggtgcctgccctgggccgggacccccctccccaccccccacctaggctttttgggttttgttcaaggaaggtaaagtgagaggtttaggtcagtgtttttaagtttttgttttttttttaaagcaaatcctgtatatgtatctacatgggagacaggtagacactacttatttgttacattttgtactacacgtttgtgttccaggtttcagcttccctcgctcctgttgttaagaagcgtccctgtcagcacaggtgtgcattgaggaaggggccccagggccttcgctccctcagcactggggtggaggcggcaggaaggggcggcccttacctggcaggtctgggcgcacctttagcaggtggactccgtggggctccaccagccagaagcctttggaaggcaacgaaggcaatgctgctccctgagtccagtccccgcccccaaacccagcccaggtgccttcagctacttcggcttcttaaaccctgcagtgttaaacagaggcattgagaaaggggaaaggcgggtatttttaaaagccaaagattgacccagttacttgagggtagggaggcgggcccagtgcaggaggctgcatccctggcctgctggtgcccaccgggggctgtgcctgtgccgggccgcagggaagctggctgcccccattcctgctgctgctgctgctgctgctctgtggctgtttcaaagactgggcgaaaggctgtccggagggcagaccaggtgccttgccgcagagaaaacaccaaagtctcctgttcgctcataaagaagtttttgggatgggagagaatccagaccatcttggggcagccaggcccttgccttcatttttacagaggtagcacaattgattccaacacaaaactccttcccctttttaaaatgatttctgttctaatgccatagatcaaaggcctcagaaaccattgtgtgtttcctctttgaagcaatgacaagcactttactttcacggtggtttttgttttttcttattgctgtggaacctcttttggaggacgttaaaggcgtgttttacttgtttttttaagagtgtgtgatgtgtgttttgtagatttcttgacagtgctgtaatacagacggcaatgcaatagcctatttaaagacactacgtgatctgattgagatgtacatagtttttttttttaccataactgaattattttatctcttatgttaacatgagaaatgtatgccaaatgattagttgatgtatgttttttaatttaatatttaaataaaatatttggaagga

SEQ ID NO: 456805 - DNA, 2083 bp, Homo sapiens
gttgcggtaggtgcataactgtatattctctggaggtaagatacctagaagtgggatggcggggtcgtgcgtaaatgcagattggtaagattcttaagtgtagacttataagaaaatgtcaaggtggtttccaaagtggctgtagcattctgcattcctaaaagccagtacgagtttttatttttattttttttgttgtgtgtgtgtgtgtgtgtgtgtgtgtgcgcgtacattgattactatccatttctttagtcaacgctctccacttcctgatttctgctttaaggaaaactgtgaactttctgcttcatgtatcagttttaaagcagcccaggcaaagatcatctacagattctaggaattctctcccctgaaatcaaaacctggaagacttttttttcttattttagttgagaagtttcataaactgctcaaggattagttttccaggactctgcggaggaacggcaggaagaacctcagagagggcagaggtgacttcaaagtgctggggactccgtcctgagggtcacttggccctgagcccctgcgtgcccttgcggaagcccagaagcttcttcctgctgcacctcccgtttccgctgctgctgacgtttatgcatttcatgatggggtccaacaagaacacctgacttgggtgaagttgtgcaatattggaggctgactgtagggctgggcagctgggagacaggctcatggctcatggctcatggctcagggcggtgcctgccctgggccgggacccccctccccaccccccacctaggctttttgggttttgttcaaggaaggtaaagtgagaggtttaggtcagtgtttttaagtttttgttttttttttaaagcaaatcctgtatatgtatctacatgggagacaggtagacactacttatttgttacattttgtactacacgtttgtgttccaggtttcagcttccctcgctcctgttgttaagaagcgtccctgtcagcacaggtgtgcattgaggaaggggccccagggccttcgctccctcagcactggggtggaggcggcaggaaggggcggcccttacctggcaggtctgggcgcacctttagcaggtggactccgtggggctccaccagccagaagcctttggaaggcaacgaaggcaatgctgctccctgagtccagtccccgcccccaaacccagcccaggtgccttcagctacttcggcttcttaaaccctgcagtgttaaacagaggcattgagaaaggggaaaggcgggtatttttaaaagccaaagattgacccagttacttgagggtagggaggcgggcccagtgcaggaggctgcatccctggcctgctggtgcccaccgggggctgtgcctgtgccgggccgcagggaagctggctgcccccattcctgctgctgctgctgctgctgctctgtggctgtttcaaagactgggcgaaaggctgtccggagggcagaccaggtgccttgccgcagagaaaacaccaaagtctcctgttcgctcataaagaagtttttgggatgggagagaatccagaccatcttggggcagccaggcccttgccttcatttttacagaggtagcacaattgattccaacacaaaactccttcccctttttaaaatgatttctgttctaatgccatagatcaaaggcctcagaaaccattgtgtgtttcctctttgaagcaatgacaagcactttactttcacggtggtttttgttttttcttattgctgtggaacctcttttggaggacgttaaaggcgtgttttacttgtttttttaagagtgtgtgatgtgtgttttgtagatttcttgacagtgctgtaatacagacggcaatgcaatagcctatttaaagacactacgtgatctgattgagatgtacatagtttttttttttaccataactgaattattttatctcttatgttaacatgagaaatgtatgccaaatgattagttgatgtatgttttttaatttaatatttaaataaaatatttggaaggaaaaaaccttgactttttcccttcctctctctctcatctct

SEQ ID NO: 456806 - DNA, 1954 bp, Homo sapiens
gtggagggaacacgtgcagtgccgtggtgtggggatctcggcccctctctctgggttcgtcgtggttgagatgattacctcggacgtctacggaaacgagcgggcgcattgttgtccgcttgtgtgtgtgtgtgtgtgtgtgtgtgtgcgcgtacattgattactatccatttctttagtcaacgctctccacttcctgatttctgctttaaggaaaactgtgaactttctgcttcatgtatcagttttaaagcagcccaggcaaagatcatctacagattctaggaattctctcccctgaaatcaaaacctggaagacttttttttcttattttagttgagaagtttcataaactgctcaaggattagttttccaggactctgcggaggaacggcaggaagaacctcagagagggcagaggtgacttcaaagtgctggggactccgtcctgagggtcacttggccctgagcccctgcgtgcccttgcggaagcccagaagcttcttcctgctgcacctcccgtttccgctgctgctgacgtttatgcatttcatgatggggtccaacaagaacacctgacttgggtgaagttgtgcaatattggaggctgactgtagggctgggcagctgggagacaggctcatggctcatggctcatggctcagggcggtgcctgccctgggccgggacccccctccccaccccccacctaggctttttgggttttgttcaaggaaggtaaagtgagaggtttaggtcagtgtttttaagtttttgttttttttttaaagcaaatcctgtatatgtatctacatgggagacaggtagacactacttatttgttacattttgtactacacgtttgtgttccaggtttcagcttccctcgctcctgttgttaagaagcgtccctgtcagcacaggtgtgcattgaggaaggggccccagggccttcgctccctcagcactggggtggaggcggcaggaaggggcggcccttacctggcaggtctgggcgcacctttagcaggtggactccgtggggctccaccagccagaagcctttggaaggcaacgaaggcaatgctgctccctgagtccagtccccgcccccaaacccagcccaggtgccttcagctacttcggcttcttaaaccctgcagtgttaaacagaggcattgagaaaggggaaaggcgggtatttttaaaagccaaagattgacccagttacttgagggtagggaggcgggcccagtgcaggaggctgcatccctggcctgctggtgcccaccgggggctgtgcctgtgccgggccgcagggaagctggctgcccccattcctgctgctgctgctgctgctgctctgtggctgtttcaaagactgggcgaaaggctgtccggagggcagaccaggtgccttgccgcagagaaaacaccaaagtctcctgttcgctcataaagaagtttttgggatgggagagaatccagaccatcttggggcagccaggcccttgccttcatttttacagaggtagcacaattgattccaacacaaaactccttcccctttttaaaatgatttctgttctaatgccatagatcaaaggcctcagaaaccattgtgtgtttcctctttgaagcaatgacaagcactttactttcacggtggtttttgttttttcttattgctgtggaacctcttttggaggacgttaaaggcgtgttttacttgtttttttaagagtgtgtgatgtgtgttttgtagatttcttgacagtgctgtaatacagacggcaatgcaatagcctatttaaagacactacgtgatctgattgagatgtacatagtttttttttttaccataactgaattattttatctcttatgttaacatgtccccgtacatcgttagaagcttgaattcgagcagtagtagtagtagtaggcggccgc

SEQ ID NO: 456807 - DNA, 1687 bp, Homo sapiens
ctccattaggaattcactgttagaaatctgatcttttctcctctgttgagctttacttgggcattttattgatttgatatcacttagtagaaacccattcaacaaaaggtatctcttcaggccactagtcaatacagcattttttatttgctgagatttttacttctattttgccccacatcagctggtaagttttataagtaagcaaaaagtaggagctatagacaataaggaagcagaatgaacctctgcaattcatatttatgtatgatttcacttggagtgggaggagatgttttttttccccatctttgaataagtagaaaaacatctcacgtaacctggggtggtggtggtgaattttcagctgaagggaatccttcctcgtgaagctcactgctatcctgttaatctagcattttacttttgtggtaagattctgggtggaaagggaaaatgaaatgatacagcatctcaaacataggca[450 bp omitted]aatctctcttggtatgctgctgagttggtgggacctgggcaattacaagggaggtcactgcacccccaggcagttcccagcaagtgttttttccaatttcactgacattctttccgggctcaactcaatttgttttcaacttctctatggcaattgatgactgactgtgtaattcagcaggatctcctgtgaagtgcttcttccccagttgaataggagctggtgtttgtctaagcctctgcttatgcatgaggtataatgctttttatatgttatataatgctcttacgcgttagctatctgaatgatagatttaataaaatatacctcataatattatggggaaaggatgacgactgttatagagaggaacttgggagtatcacttctgtaatccttatctaacctgaatctgttagcaggaaactgaaaaggcctgtgtatgacaatgagataaacaattttaatctcttagcaatgtcaagtggaaaatctaactacctgccagtagtttaagaaatggctaagagattttgttgggcacaaataatcctgagacccagattgctgagccaagggtaggaaaattggttttgctatgtgttacagctgggaagtgagaaggtcactgtttgacaaactactaaaaaaaccttatggattaaacattcgccagtgtaggggacattttgaatgtgttataattgatattttagtctatatgcggccgctgaacgctttttcttttac

SEQ ID NO: 456808 - DNA, 1651 bp, Homo sapiens
  misc_feature (1625)..(1625): n is a, c, g, or t
  misc_feature (1636)..(1636): n is a, c, g, or t
  misc_feature (1643)..(1643): n is a, c, g, or t
ctccattaggaattcactgttagaaatctgatcttttctcctctgttgagctttacttgggcattttattgatttgatatcacttagtagaaacccattcaacaaaaggtatctcttcaggccactagtcaatacagcattttttatttgctgagatttttacttctattttgccccacatcagctggtaagttttataagtaagcaaaaagtaggagctatagacaataaggaagcagaatgaacctctgcaattcatatttatgtatgatttcacttggagtgggaggagatgttttttttccccatctttgaataagtagaaaaacatctcacgtaacctggggtggtggtggtgaattttcagctgaagggaatccttcctcgtgaagctcactgctatcctgttaatctagcattttacttttgtggtaagattctgggtggaaagggaaaatgaaatgatacagcatctcaaacataggca[450 bp omitted]aatctctcttggtatgctgctgagttggtgggacctgggcaattacaagggaggtcactgcacccccaggcagttcccagcaagtgttttttccaatttcactgacattctttccgggctcaactcaatttgttttcaacttctctatggcaattgatgactgactgtgtaattcagcaggatctcctgtgaagtgcttcttccccagttgaataggagctggtgtttgtctaagcctctgcttatgcatgaggtataatgctttttatatgttatataatgctcttacgcgttagctatctgaatgatagatttaataaaatatacctcataatattatggggaaaggatgacgactgttatagagaggaacttgggagtatcacttctgtaatccttatctaacctgaatctgttagcaggaaactgaaaaggcctgtgtatgacaatgagataaacaattttaatctcttagcaatgtcaagtggaaaatctaactacctgccagtagtttaagaaatggctaagagattttgttgggcacaaataatcctgagacccagattgctgagccaagggtaggaaaattggttttgctatgtgttacagctgggaagtgagaaggtcactgtttgacaaactactaaaaaaaccttatggattaaacattcgccagtgtaggggacanatattactctnaagcggncccgttgt

SEQ ID NO: 456809 - DNA, 229 bp, Homo sapiens
atggatgtttgtagtaacgaagatataaaagctgacttactgaaacttcaccagattgtatgagaaagaaaaatatgtgttcaaactgggacctaatttgataaccatagtttgttaaaattaaaagtattaattttcaaattacaaagtattacatacaatagaaaatacaaataaaaagggcatttaaaaacccgccctgtaatcagtattaccactttggtatata

SEQ ID NO: 456810 - DNA, 2650 bp, Homo sapiens
agctgccagagggcggggccgcaggagggcggggcgcgagcgagagctgggagaaggcagtgagcgagcaggcggcaggcacggtccgtgcggagcaggcgagcgagcgggaagacgcagccaccttcctcaccagccagcccacagcggtttgttccccttctcgggagtgcgccaatgcctgggccgacccaaaccctgtccccaaatggcgagaacaacaacgacatcatccaggataataacgggaccatcattcctttccggaagcacacagtgcgcggggagcgttcctacagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtacattcattaaaacttgcccttgaaggcgtggaaaaggaaagggatttctactttgggaagttgagagagatcgagctactctgccaagaacacgggcaggaaaatgatgacctcgtgcagagactaatggacatcctgtatgcttcagaagaacacgagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactgttgcatatgccagccactgcgcttggttcccattttctttgccaaggtgtattagcggacggccctctggccacctacccgagagatcgtagggtcacatacatccaacttcaccacttggctgcttgagattggttctgctcttttcttcatttctttccagaacaactctttcccaccccaacaccactgccaccacccctctttttatcctggtgtgaaacaatggtaatttgatatatggtatttatattggcatttttcaacccagtgtcactagatgtcacacacatttgtggtgctttgatgtttgcaagtctaacctctgaacataaatttggtcaaataattggaacaaagggaaacagatacttgatatgaaagccataatgacggtgacttgtgtcgtgggggaaaacataaggtcattttctccctctactcacaatactaaagggaaaaaatggattcaaagctaggatttcagggcccagcagtgttcctccatcagcatgttagacaactacacagtatgttgttagttttgaaagacattcactcaaggaaaacaccatctcaactttgcccgctcaccatgtcccttgcccccatgtagcccatttcccaggttatgctcttttctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaataacagcacagaaaaatctatgactcccaatatcttctagaataaagaattttccctctttaacacaagggccctccttgtcattgaccttagctaaaccatggcaattcataaatagaggaaacattaatgaattaaaagcattccttattttttaactaatatttgtacattttcttagtctctttccaagtctttgcctcttttttttctttatttttattttttcctttgacagatggtatcccttcctggatcattcatttcaccttggtttctaactttaggtttactttcacttgttatttgacttagcaggtgcaacaaaaacaagaaacaaatgtgcccaccccactttccgcttaactgaaaagcttaaaataaatttctgaattatgtatcctg

SEQ ID NO: 456811 - DNA, 2614 bp, Homo sapiens
ctagaattcagcggccgctgaattctagcgagcaggcggcaggcacggtccgtgcggagcaggcgagcgagcgggaagacgcagccaccttcctcaccagccagcccacagcggtttgttccccttctcgggagtgcgccaatgcctgggccgacccaaaccctgtccccaaatggcgagaacaacaacgacatcatccaggataataacgggaccatcattcctttccggaagcacacagtgcgcggggagcgttcctacagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtacattcattaaaacttgcccttgaaggcgtggaaaaggaaagggatttctactttgggaagttgagagagatcgagctactctgccaagaacacgggcaggaaaatgatgacctcgtgcagagactaatggacatcctgtatgcttcagaagaacacgagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactgttgcatatgccagccactgcgcttggttcccattttctttgccaaggtgtattagcggacggccctctggccacctacccgagagatcgtagggtcacatacatccaacttcaccacttggctgcttgagattggttctgctcttttcttcatttctttccagaacaactctttcccaccccaacaccactgccaccacccctctttttatcctggtgtgaaacaatggtaatttgatatatggtatttatattggcatttttcaacccagtgtcactagatgtcacacacatttgtggtgctttgatgtttgcaagtctaacctctgaacataaatttggtcaaataattggaacaaagggaaacagatacttgatatgaaagccataatgacggtgacttgtgtcgtgggggaaaacataaggtcattttctccctctactcacaatactaaagggaaaaaatggattcaaagctaggatttcagggcccagcagtgttcctccatcagcatgttagacaactacacagtatgttgttagttttgaaagacattcactcaaggaaaacaccatctcaactttgcccgctcaccatgtcccttgcccccatgtagcccatttcccaggttatgctcttttctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaataacagcacagaaaaatctatgactcccaatatcttctagaataaagaattttccctctttaacacaagggccctccttgtcattgaccttagctaaaccatggcaattcataaatagaggaaacattaatgaattaaaagcattccttattttttaactaatatttgtacattttcttagtctctttccaagtctttgcctcttttttttctttatttttattttttcctttgacagatggtatcccttcctggatcattcatttcaccttggtttctaactttaggtttactttcacttgttatttgacttagcaggtgcaacaaaaacaagaaacaaatgtgcccaccccactttccgcttaactgaaaagcttaaaataaatttctgaattatgtatcctg

SEQ ID NO: 456812 - DNA, 548 bp, Homo sapiens
cgactagcccgacagtccccgactagcccgacagtccccgactagcccgacactccccagccttctcagttataaacatgctggccagatctcttagcctgcaaagagaactttccccagtcaccatagaccattctccttcctgaaggcttggggcagaccattcgtttatttagagaagagctatacattcttctttctggtcccatcttaaacgtcttctgttgtgctgcaccccagatggtgtctcagatgctttggggaatctttaacagctgaatttgagtcagtcctcttaggctgcacctccagcctctgcagatcccccctcatttcccatggatggtgggaccccattattctctcatctcggcattcagggaacactttccttagcggcccctggtcacatgtcatcgggctgggcaggaagcgtccctgggtgcgtgctccacttctccctctcaggaagcccagtttcatccttagtaccccccctcgtgcccgctgtcgggctagtcggggggatctctagagtacttagcaat

SEQ ID NO: 456813 - DNA, 4269 bp, Homo sapiens
agctgccagagggcggggccgcaggagggcggggcgcgagcgagagctgggagaaggcagtgagcgagcaggcggcaggcacggtccgtgcggagcaggcgagcgagcgggaagacgcagccaccttcctcaccagccagcccacagcggtttgttccccttctcgggagtgcgccaatgcctgggccgacccaaaccctgtccccaaatggcgagaacaacaacgacatcatccaggataataacgggaccatcattcctttccggaagcacacagtgcgcggggagcgttcctacagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtacattcattaaaacttgcccttgaaggcgtggaaaaggaaagggatttctactttgggaagttgagagagatcgagctactctgccaagaacacgggcaggaaaatgatgacctcgtgcagagactaatggacatcctgtatgcttcagaagaacacgagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactgttgcatatgccagccactgcgcttggttcccattttctttgccaaggtgtattagcggacggccctctggccacctacccgagagatcgtagggtcacatacatccaacttcaccacttggctgcttgagattggttctgctcttttcttcatttctttccagaacaactctttcccaccccaacaccactgccaccacccctctttttatcctggtgtgaaacaatggtaatttgatatatggtatttatattggcatttttcaacccagtgtcactagatgtcacacacatttgtggtgctttgatgtttgcaagtctaacctctgaacataaatttggtcaaataattggaacaaagggaaacagatacttgatatgaaagccataatgacggtgacttgtgtcgtgggggaaaacataaggtcattttctccctctactcacaatactaaagggaaaaaatggattcaaagctaggatttcagggcccagcagtgttcctccatcagcatgttagacaactacacagtatgttgttagttttgaaagacattcactcaaggaaaacaccatctcaactttgcccgctcaccatgtcccttgcccccatgtagcccatttcccaggttatgctcttttctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaataacagcacagaaaaatctatgactcccaatatcttctagaataaagaattttccctctttaacacaagggccctccttgtcattgaccttagctaaaccatggcaattcataaatagaggaaacattaatgaattaaaagcattccttattttttaactaatatttgtacattttcttagtctctttccaagtctttgcctcttttttttctttatttttattttttcctttgacagatggtatcccttcctggatcattcatttcaccttggtttctaactttaggtttactttcacttgttatttgacttagcaggtgcaacaaaaacaagaaacaaatgtgcccaccccactttccgcttaactgaaaagcttaaaataaatttctgaattatgtatcctgaagctttgaaatttctttattaatcgatgaaatatgaattctaaattctagcattgaagcttttcaccaaaagaagtctctccaaaataaatcttttgcagcaaagtgatatttattgagttatgtggaaaagatggcttgtatttttcagattattacaacacactgtgcagaattagacagatgttccgtggtgtttggtttccctttcttctctctcctgctcactctgcattatagcagcagcttatttctctaaggctggacagcctggctctcggcagtgacgtcctcccacacctggtcacaagtagtagtggctgtgctatacccagcatcatgcttaacagcgtgttgcccttctgagcctgttgtactcactgatctctttaaaaacaaaaaatagctcttgtaaaaggtcacaataactctatgcacctgatactgcagtggttcctaggccattcttcatctgctctggacatctcagtcatacccaatgctcagtggatcatgaccaaactcctgtcatgtggatgcacgtgagtgggtagcagggagtcaggatcctgccttctccagcaaccccttactgctgtataacttgcataagcctccctggtgactcttgcaggaaccactccattgccctccagctccccagccttctcagttataaacatgctggccagatctcttagcctgcaaagagaactttccccagtcaccatagaccattctccttcctgaaggcttggggcagaccattcgtttatttagagaagagctatacattcttctttctggtcccatcttaaacgtcttctgttgtgctgcaccccagatggtgtctcagatgctttggggaatctttaacagctgaatttgagtcagtcctcttaggctgcacctccagcctctgcagatcccccctcatttcccatggatggtgggaccccattattctctcatctcggcattcagggaacactttccttagcggcccctggtcacatgtcatcgggctgggcaggaagcgtccctgggtgcgtgctccacttctccctctcaggaagcccagtttcatccttagtaccccccctcgtgcccgctgtcggctggttatagcacttccactgctactgtcagataggaagtgatcgaagcagggggcaaagagaaagcccatatttgttctaagcagaaaagcaggaaaaaaaaaaaaaaaaaaagaaagaaaaacacctgttgacctgagagaagtaaattccagaagggaaccaagaactcttcccttccctggtgagtatttccattattccgttaaggtttaatatgcattcagattacttttactaaataggacaccataaagcttttgttatatattaaatgtaaactgaaaggaatgtaaacatatgtattgttaattataaatatagataagtaatgacataatagatgaaaaagtcttattcagatgtatcacattcattttacattacccacctattgtcgcatggtagaatagttttttgtctctgaatatgtgaataacttgacttgcattgatctttttacatatttaataaaaaaaaaagtatatgttaaaaaaaaaa

SEQ ID NO: 456814 - DNA, 4091 bp, Homo sapiens
agcggaaaaacaaagcccccagctgtcagcagaggaaggaggcgacagcgccggagcagtgtcctgtttcccagaggaacagttcatttcaacagccagggagaaagcctggatgctcaagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtacattcattaaaacttgcccttgaaggcgtggaaaaggaaagggatttctactttgggaagttgagagagatcgagctactctgccaagaacacgggcaggaaaatgatgacctcgtgcagagactaatggacatcctgtatgcttcagaagaacacgagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactgttgcatatgccagccactgcgcttggttcccattttctttgccaaggtgtattagcggacggccctctggccacctacccgagagatcgtagggtcacatacatccaacttcaccacttggctgcttgagattggttctgctcttttcttcatttctttccagaacaactctttcccaccccaacaccactgccaccacccctctttttatcctggtgtgaaacaatggtaatttgatatatggtatttatattggcatttttcaacccagtgtcactagatgtcacacacatttgtggtgctttgatgtttgcaagtctaacctctgaacataaatttggtcaaataattggaacaaagggaaacagatacttgatatgaaagccataatgacggtgacttgtgtcgtgggggaaaacataaggtcattttctccctctactcacaatactaaagggaaaaaatggattcaaagctaggatttcagggcccagcagtgttcctccatcagcatgttagacaactacacagtatgttgttagttttgaaagacattcactcaaggaaaacaccatctcaactttgcccgctcaccatgtcccttgcccccatgtagcccatttcccaggttatgctcttttctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaataacagcacagaaaaatctatgactcccaatatcttctagaataaagaattttccctctttaacacaagggccctccttgtcattgaccttagctaaaccatggcaattcataaatagaggaaacattaatgaattaaaagcattccttattttttaactaatatttgtacattttcttagtctctttccaagtctttgcctcttttttttctttatttttattttttcctttgacagatggtatcccttcctggatcattcatttcaccttggtttctaactttaggtttactttcacttgttatttgacttagcaggtgcaacaaaaacaagaaacaaatgtgcccaccccactttccgcttaactgaaaagcttaaaataaatttctgaattatgtatcctgaagctttgaaatttctttattaatcgatgaaatatgaattctaaattctagcattgaagcttttcaccaaaagaagtctctccaaaataaatcttttgcagcaaagtgatatttattgagttatgtggaaaagatggcttgtatttttcagattattacaacacactgtgcagaattagacagatgttccgtggtgtttggtttccctttcttctctctcctgctcactctgcattatagcagcagcttatttctctaaggctggacagcctggctctcggcagtgacgtcctcccacacctggtcacaagtagtagtggctgtgctatacccagcatcatgcttaacagcgtgttgcccttctgagcctgttgtactcactgatctctttaaaaacaaaaaatagctcttgtaaaaggtcacaataactctatgcacctgatactgcagtggttcctaggccattcttcatctgctctggacatctcagtcatacccaatgctcagtggatcatgaccaaactcctgtcatgtggatgcacgtgagtgggtagcagggagtcaggatcctgccttctccagcaaccccttactgctgtataacttgcataagcctccctggtgactcttgcaggaaccactccattgccctccagctccccagccttctcagttataaacatgctggccagatctcttagcctgcaaagagaactttccccagtcaccatagaccattctccttcctgaaggcttggggcagaccattcgtttatttagagaagagctatacattcttctttctggtcccatcttaaacgtcttctgttgtgctgcaccccagatggtgtctcagatgctttggggaatctttaacagctgaatttgagtcagtcctcttaggctgcacctccagcctctgcagatcccccctcatttcccatggatggtgggaccccattattctctcatctcggcattcagggaacactttccttagcggcccctggtcacatgtcatcgggctgggcaggaagcgtccctgggtgcgtgctccacttctccctctcaggaagcccagtttcatccttagtaccccccctcgtgcccgctgtcggctggttatagcacttccactgctactgtcagataggaagtgatcgaagcagggggcaaagagaaagcccatatttgttctaagcagaaaagcaggaaaaaaaaaaaaaaaaaaagaaagaaaaacacctgttgacctgagagaagtaaattccagaagggaaccaagaactcttcccttccctggtgagtatttccattattccgttaaggtttaatatgcattcagattacttttactaaataggacaccataaagcttttgttatatattaaatgtaaactgaaaggaatgtaaacatatgtattgttaattataaatatagataagtaatgacataatagatgaaaaagtcttattcagatgtatcacattcattttacattacccacctattgtcgcatggtagaatagttttttgtctctgaatatgtgaataacttgacttgcattgatctttttacatatttaataaaaaaaaaagtatatgttaaaaaaaaaa

SEQ ID NO: 456815 - DNA, 4029 bp, Homo sapiens
agcggaaaaacaaagcccccagctgtcagcagaggaaggaggcgacagcgccggagcagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtacattcattaaaacttgcccttgaaggcgtggaaaaggaaagggatttctactttgggaagttgagagagatcgagctactctgccaagaacacgggcaggaaaatgatgacctcgtgcagagactaatggacatcctgtatgcttcagaagaacacgagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactgttgcatatgccagccactgcgcttggttcccattttctttgccaaggtgtattagcggacggccctctggccacctacccgagagatcgtagggtcacatacatccaacttcaccacttggctgcttgagattggttctgctcttttcttcatttctttccagaacaactctttcccaccccaacaccactgccaccacccctctttttatcctggtgtgaaacaatggtaatttgatatatggtatttatattggcatttttcaacccagtgtcactagatgtcacacacatttgtggtgctttgatgtttgcaagtctaacctctgaacataaatttggtcaaataattggaacaaagggaaacagatacttgatatgaaagccataatgacggtgacttgtgtcgtgggggaaaacataaggtcattttctccctctactcacaatactaaagggaaaaaatggattcaaagctaggatttcagggcccagcagtgttcctccatcagcatgttagacaactacacagtatgttgttagttttgaaagacattcactcaaggaaaacaccatctcaactttgcccgctcaccatgtcccttgcccccatgtagcccatttcccaggttatgctcttttctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaataacagcacagaaaaatctatgactcccaatatcttctagaataaagaattttccctctttaacacaagggccctccttgtcattgaccttagctaaaccatggcaattcataaatagaggaaacattaatgaattaaaagcattccttattttttaactaatatttgtacattttcttagtctctttccaagtctttgcctcttttttttctttatttttattttttcctttgacagatggtatcccttcctggatcattcatttcaccttggtttctaactttaggtttactttcacttgttatttgacttagcaggtgcaacaaaaacaagaaacaaatgtgcccaccccactttccgcttaactgaaaagcttaaaataaatttctgaattatgtatcctgaagctttgaaatttctttattaatcgatgaaatatgaattctaaattctagcattgaagcttttcaccaaaagaagtctctccaaaataaatcttttgcagcaaagtgatatttattgagttatgtggaaaagatggcttgtatttttcagattattacaacacactgtgcagaattagacagatgttccgtggtgtttggtttccctttcttctctctcctgctcactctgcattatagcagcagcttatttctctaaggctggacagcctggctctcggcagtgacgtcctcccacacctggtcacaagtagtagtggctgtgctatacccagcatcatgcttaacagcgtgttgcccttctgagcctgttgtactcactgatctctttaaaaacaaaaaatagctcttgtaaaaggtcacaataactctatgcacctgatactgcagtggttcctaggccattcttcatctgctctggacatctcagtcatacccaatgctcagtggatcatgaccaaactcctgtcatgtggatgcacgtgagtgggtagcagggagtcaggatcctgccttctccagcaaccccttactgctgtataacttgcataagcctccctggtgactcttgcaggaaccactccattgccctccagctccccagccttctcagttataaacatgctggccagatctcttagcctgcaaagagaactttccccagtcaccatagaccattctccttcctgaaggcttggggcagaccattcgtttatttagagaagagctatacattcttctttctggtcccatcttaaacgtcttctgttgtgctgcaccccagatggtgtctcagatgctttggggaatctttaacagctgaatttgagtcagtcctcttaggctgcacctccagcctctgcagatcccccctcatttcccatggatggtgggaccccattattctctcatctcggcattcagggaacactttccttagcggcccctggtcacatgtcatcgggctgggcaggaagcgtccctgggtgcgtgctccacttctccctctcaggaagcccagtttcatccttagtaccccccctcgtgcccgctgtcggctggttatagcacttccactgctactgtcagataggaagtgatcgaagcagggggcaaagagaaagcccatatttgttctaagcagaaaagcaggaaaaaaaaaaaaaaaaaaagaaagaaaaacacctgttgacctgagagaagtaaattccagaagggaaccaagaactcttcccttccctggtgagtatttccattattccgttaaggtttaatatgcattcagattacttttactaaataggacaccataaagcttttgttatatattaaatgtaaactgaaaggaatgtaaacatatgtattgttaattataaatatagataagtaatgacataatagatgaaaaagtcttattcagatgtatcacattcattttacattacccacctattgtcgcatggtagaatagttttttgtctctgaatatgtgaataacttgacttgcattgatctttttacatatttaataaaaaaaaaagtatatgttaaaaaaaaaa

SEQ ID NO: 456816 - DNA, 3802 bp, Homo sapiens
agctgccagagggcggggccgcaggagggcggggcgcgagcgagagctgggagaaggcagtgagcgagcaggcggcaggcacggtccgtgcggagcaggcgagcgagcgggaagacgcagccaccttcctcaccagccagcccacagcggtttgttccccttctcgggagtgcgccaatgcctgggccgacccaaaccctgtccccaaatggcgagaacaacaacgacatcatccaggataataacgggaccatcattcctttccggaagcacacagtgcgcggggagcgttcctacagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtacattcattaaaacttgcccttgaaggcgtggaaaaggaaagggatttctactttgggaagttgagagagatcgagctactctgccaagaacacgggcaggaaaatgatgacctcgtgcagagactaatggacatcctgtatgcttcagaagaacacgagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactgttgcatatgccagccactgcgcttggttcccattttctttgccaaggtgtattagcggacggccctctggccacctacccgagagatcgtagggtcacatacatccaacttcaccacttggctgcttgagattggttctgctcttttcttcatttctttccagaacaactctttcccaccccaacaccactgccaccacccctctttttatcctggtgtgaaacaatggtaatttgatatatggtatttatattggcatttttcaacccagtgtcactagatgtcacacacatttgtggtgctttgatgtttgcaagtctaacctctgaacataaatttggtcaaataattggaacaaagggaaacagatacttgatatgaaagccataatgacggtgacttgtgtcgtgggggaaaacataaggtcattttctccctctactcacaatactaaagggaaaaaatggattcaaagctaggatttcagggcccagcagtgttcctccatcagcatgttagacaactacacagtatgttgttagttttgaaagacattcactcaaggaaaacaccatctcaactttgcccgctcaccatgtcccttgcccccatgtagcccatttcccaggttatgctcttttctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaataacagcacagaaaaatctatgactcccaatatcttctagaataaagaattttccctctttaacacaagggccctccttgtcattgaccttagctaaaccatggcaattcataaatagaggaaacattaatgaattaaaagcattccttattttttaactaatatttgtacattttcttagtctctttccaagtctttgcctcttttttttctttatttttattttttcctttgacagatggtatcccttcctggatcattcatttcaccttggtttctaactttaggtttactttcacttgttatttgacttagcaggtgcaacaaaaacaagaaacaaatgtgcccaccccactttccgcttaactgaaaagcttaaaataaatttctgaattatgtatcctgaagctttgaaatttctttattaatcgatgaaatatgaattctaaattctagcattgaagcttttcaccaaaagaagtctctccaaaataaatcttttgcagcaaagtgatatttattgagttatgtggaaaagatggcttgtatttttcagattattacaacacactgtgcagaattagacagatgttccgtggtgtttggtttccctttcttctctctcctgctcactctgcattatagcagcagcttatttctctaaggctggacagcctggctctcggcagtgacgtcctcccacacctggtcacaagtagtagtggctgtgctatacccagcatcatgcttaacagcgtgttgcccttctgagcctgttgtactcactgatctctttaaaaacaaaaaatagctcttgtaaaaggtcacaataactctatgcacctgatactgcagtggttcctaggccattcttcatctgctctggacatctcagtcatacccaatgctcagtggatcatgaccaaactcctgtcatgtggatgcacgtgagtgggtagcagggagtcaggatcctgccttctccagcaaccccttactgctgtataacttgcataagcctccctggtgactcttgcaggaaccactccattgccctccagctccccagccttctcagttataaacatgctggccagatctcttagcctgcaaagagaactttccccagtcaccatagaccattctccttcctgaaggcttggggcagaccattcgtttatttagagaagagctatacattcttctttctggtcccatcttaaacgtcttctgttgtgctgcaccccagatggtgtctcagatgctttggggaatctttaacagctgaatttgagtcagtcctcttaggctgcacctccagcctctgcagatcccccctcatttcccatggatggtgggaccccattattctctcatctcggcattcagggaacactttccttagcggcccctggtcacatgtcatcgggctgggcaggaagcgtccctgggtgcgtgctccacttctccctctcaggaagcccagtttcatccttagtaccccccctcgtgcccgctgtcgggctagtcggggggatctctagagtacttagcaat

SEQ ID NO: 456817 - DNA, 2757 bp, Homo sapiens
agctgccagagggcggggccgcaggagggcggggcgcgagcgagagctgggagaaggcagtgagcgagcaggcggcaggcacggtccgtgcggagcaggcgagcgagcgggaagacgcagccaccttcctcaccagccagcccacagcggtttgttccccttctcgggagtgcgccaatgcctgggccgacccaaaccctgtccccaaatggcgagaacaacaacgacatcatccaggataataacgggaccatcattcctttccggaagcacacagtgcgcggggagcgttcctacagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtacattcattaaaacttgcccttgaaggcgtggaaaaggaaagggatttctactttgggaagttgagagagatcgagctactctgccaagaacacgggcaggaaaatgatgacctcgtgcagagactaatggacatcctgtatgcttcagaagaacacgagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactgttgcatatgccagccactgcgcttggttcccattttctttgccaaggtgtattagcggacggccctctggccacctacccgagagatcgtagggtcacatacatccaacttcaccacttggctgcttgagattggttctgctcttttcttcatttctttccagaacaactctttcccaccccaacaccactgccaccacccctctttttatcctggtgtgaaacaatggtaatttgatatatggtatttatattggcatttttcaacccagtgtcactagatgtcacacacatttgtggtgctttgatgtttgcaagtctaacctctgaacataaatttggtcaaataattggaacaaagggaaacagatacttgatatgaaagccataatgacggtgacttgtgtcgtgggggaaaacataaggtcattttctccctctactcacaatactaaagggaaaaaatggattcaaagctaggatttcagggcccagcagtgttcctccatcagcatgttagacaactacacagtatgttgttagttttgaaagacattcactcaaggaaaacaccatctcaactttgcccgctcaccatgtcccttgcccccatgtagcccatttcccaggttatgctcttttctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaataacagcacagaaaaatctatgactcccaatatcttctagaataaagaattttccctctttaacacaagggccctccttgtcattgaccttagctaaaccatggcaattcataaatagaggaaacattaatgaattaaaagcattccttattttttaaaaaaaaaaaaaaaaaaaagggaaaacaaaaatacaaaaaagaaaaaaaaaaaggttgccggccggcctgccgggcacagagaaaaagattctaaaacccccttcggtgggggggccgcggcgacccaagtaggttagtggtacaactggcgccaaaagcgcggtaccaaaaggaagaccgcgcggcccagtgagacactggtggttgggttttccaccacaaataaaaaggcccgcgggcggcacacagcgggcgttccgcgaaacaactccagagtggggtccgagggcgaaaccggggccctactacacagggcgccaacccgagcccagataaaaataggcgggccgagca

SEQ ID NO: 456818 - DNA, 756 bp, Homo sapiens
agctgccagagggcggggccgcaggagggcggggcgcgagcgagagctgggagaaggcagtgagcgagcaggcggcaggcacggtccgtgcggagcaggcgagcgagcgggaagacgcagccaccttcctcaccagccagcccacagcggtttgttccccttctcgggagtgcgccaatgcctgggccgacccaaaccctgtccccaaatggcgagaacaacaacgacatcatccaggataataacgggaccatcattcctttccggaagcacacagtgcgcggggagcgttcctacagttggggaatggcggtcaatgtgtattctacctcgataacccaagagactatgagcagacatgacatcattgcatgggttaatgacatagtatctttaaactacacaaaagtggaacagctttgttcaggtaagacatattcttttaagtgtttacctaaatatttacagtctgtcatgtggaatgtgattttatgaaccacagctgctatattttgggtaggaaaaagtatatattgctattggcatgtaattaaagggggaaaaactcagatataactaaaggacgtattgggaaaagtgtttatgagcatccaggagcacaagcagagccacacggacacgtattggaaaggtctcttgcttgagcttcgtaatgcctttcactggctcctagcctcttctctgtcatcccatctgccatcacacttgcctcctgaaaacaccaattggttctta

SEQ ID NO: 456819 - DNA, 883 bp, Homo sapiens
ctagaattcagcggccgctgaattctagcgagcaggcggcaggcacggtccgtgcggagcaggcgagcgagcgggaagacgcagccaccttcctcaccagccagcccacagcggtttgttccccttctcgggagtgcgccaatgcctgggccgacccaaaccctgtccccaaatggcgagaacaacaacgacatcatccaggataataacgggaccatcattcctttccggaagcacacagtgcgcggggagcgttcctacaggtaatggggctggcacgagagcagcgccggggaccgccgtgagggcgcgcggaaatccagcccgttatataatggagcagacactgcctgcgacccctgctgcaggcatgcatttgtgaaggcggttgtgattatttggtatctgtttccatgtgtcatgttgggtttgcattgaggctccgcgactgcagatggaaagcattttgtgaataggtttgctgccttcgaggggtctccctccatctctttccttccacactgataaaaatgcatgctgttttcccccgctgtccaaagggagacaggcagtagcacttcctttcctccttcccttttagattttaaaggagccattaggtagcagtgccaaaaggcagaaaacgggagggtggggagaaaaacgtttgcgcttaacctggagagtgtgcaggaaagatggaatcctctagattaagctgcagtctgtgatgttaaaccgccagattgatggagctttgtaagaattctgctcgctgattggtgcagggattgacagcagaggtgatagtgtcagacattcaccaaaattttctccatagaaccctaggtttattagaaagagactggactgcaaaggactt

SEQ ID NO: 456820 - DNA, 448 bp, Homo sapiens
ctgctgaaatatttatactccttctatatgggaagggatcactggaggtatctcttatatgttgttgtaagctcttttcatatcattcattttctatgtatctaaaacacacttttaatattgccagtatttatcatttattctgattgctttcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtaatgcatcagctctggccacgcctctaggagcagtgacgtgtgtaagaggtagggggcctaggatcccctaggactggggtaagggagggaagggtaaggaagaatccttggtttcaagtaagtgagaataaaaagaattgttcgaagac

SEQ ID NO: 456821 - DNA, 1282 bp, Homo sapiens
  misc_feature (1280)..(1281): n is a, c, g, or t
agcggaaaaacaaagcccccagctgtcagcagaggaaggaggcgacagcgccggagcagtgtcctgtttcccagaggaacagttcatttcaacagccagggagaaagcctggatgctcaagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtaatgcatcagctctggccacgcctctaggagcagtgacgtgtgtaagaggtagggggcctaggatcccctaggactggggtaagggagggaagggtaaggaagaatccttggtttcaagtaagtgagaataaaaagaattgttcgaagacaaaatcagtagcccatgatgaataaaaagtgttagtcacaaatctcaaagctgtacattaagatggggcagatggctcagccttgctgcagacttcaggctaccttcccctcccctgctcctcagggctgtcaagagctccaggctagaccgttgcccatcctgcccacttctggccattctagatagtgctgcattagggtgagtctgcctccctctctttttaaaggctgggtcagggttagtctgtctccctcccactctcttcttttttcccttcttcctttctttcttcagctattagtagttgagcttattctatatgaaagatattacgcttaatgctggtaatataaaggtagtaaaatagataccttccnnc

SEQ ID NO: 456822 - DNA, 4207 bp, Homo sapiens
agctgccagagggcggggccgcaggagggcggggcgcgagcgagagctgggagaaggcagtgagcgagcaggcggcaggcacggtccgtgcggagcaggcgagcgagcgggaagacgcagccaccttcctcaccagccagcccacagcggtttgttccccttctcgggagtgcgccaatgcctgggccgacccaaaccctgtccccaaatggcgagaacaacaacgacatcatccaggataataacgggaccatcattcctttccggaagcacacagtgcgcggggagcgttcctacagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtacattcattaaaacttgcccttgaaggcgtggaaaaggaaagggatttctactttgggaagttgagagagatcgagctactctgccaagaacacgggcaggaaaatgatgacctcgtgcagagactaatggacatcctgtatgcttcagaagaacacgagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactgttgcatatgccagccactgcgcttggttcccattttctttgccaaggtgtattagcggacggccctctggccacctacccgagagatcgtagggtcacatacatccaacttcaccacttggctgcttgagattggttctgctcttttcttcatttctttccagaacaactctttcccaccccaacaccactgccaccacccctctttttatcctggtgtgaaacaatggtaatttgatatatggtatttatattggcatttttcaacccagtgtcactagatgtcacacacatttgtggtgctttgatgtttgcaagtctaacctctgaacataaatttggtcaaataattggaacaaagggaaacagatacttgatatgaaagccataatgacggtgacttgtgtcgtgggggaaaacataaggtcattttctccctctactcacaatactaaagggaaaaaatggattcaaagctaggatttcagggcccagcagtgttcctccatcagcatgttagacaactacacagtatgttgttagttttgaaagacattcactcaaggaaaacaccatctcaactttgcccgctcaccatgtcccttgcccccatgtagcccatttcccaggttatgctcttttctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaataacagcacagaaaaatctatgactcccaatatcttctagaataaagaattttccctctttaacacaagggccctccttgtcattgaccttagctaaaccatggcaattcataaatagaggaaacattaatgaattaaaagcattccttattttttaactaatatttgtacattttcttagtctctttccaagtctttgcctcttttttttctttatttttattttttcctttgacagatggtatcccttcctggatcattcatttcaccttggtttctaactttaggtttactttcacttgttatttgacttagcaggtgcaacaaaaacaagaaacaaatgtgcccaccccactttccgcttaactgaaaagcttaaaataaatttctgaattatgtatcctgaagctttgaaatttctttattaatcgatgaaatatgaattctaaattctagcattgaagcttttcaccaaaagaagtctctccaaaataaatcttttgcagcaaagtgatatttattgagttatgtggaaaagatggcttgtatttttcagattattacaacacactgtgcagaattagacagatgttccgtggtgtttggtttccctttcttctctctcctgctcactctgcattatagcagcagcttatttctctaaggctggacagcctggctctcggcagtgacgtcctcccacacctggtcacaagtagtagtggctgtgctatacccagcatcatgcttaacagcgtgttgcccttctgagcctgttgtactcactgatctctttaaaaacaaaaaatagctcttgtaaaaggtcacaataactctatgcacctgatactgcagtggttcctaggccattcttcatctgctctggacatctcagtcatacccaatgctcagtggatcatgaccaaactcctgtcatgtggatgcacgtgagtgggtagcagggagtcaggatcctgccttctccagcaaccccttactgctgtataacttgcataagcctccctggtgactcttgcaggaaccactccattgccctccagctccccagccttctcagttataaacatgctggccagatctcttagcctgcaaagagaactttccccagtcaccatagaccattctccttcctgaaggcttggggcagaccattcgtttatttagagaagagctatacattcttctttctggtcccatcttaaacgtcttctgttgtgctgcaccccagatggtgtctcagatgctttggggaatctttaacagctgaatttgagtcagtcctcttaggctgcacctccagcctctgcagatcccccctcatttcccatggatggtgggaccccattattctctcatctcggcattcagggaacactttccttagcggcccctggtcacatgtcatcgggctgggcaggaagcgtccctgggtgcgtgctccacttctccctctcaggaagcccagtttcatccttagtaccccccctcgtgcccgctgtcggctggttatagcacttccactgctactgtcagataggaagtgatcgaagcagggggcaaagagaaagcccatatttgttctaagcagaaaagcaggaggaaccaagaactcttcccttccctggtgagtatttccattattccgttaaggtttaatatgcattcagattacttttactaaataggacaccataaagcttttgttatatattaaatgtaaactgaaaggaatgtaaacatatgtattgttaattataaatatagataagtaatgacataatagatgaaaaagtcttattcagatgtatcacattcattttacattacccacctattgtcgcatggtagaatagttttttgtctctgaatatgtgaataacttgacttgcattgatctttttacatatttaataaaaaaaaaagtatatgttaaaaaaaaaa

SEQ ID NO: 456823 - DNA, 4213 bp, Homo sapiens
agcggatagtatcgaccctggggccgcgctgcgaggcggaggttcggtcccagctggggtgaagtgtgcagaccggttgcgattgtggtcagacgcagcacctacttctaatctgaggacccgcgatttacacttttgctgaataggacactgtggaatgaaacagaacagagatcaaaagtgtcctgtttcccagaggaacagttcatttcaacagccagggagaaagcctggatgctcaagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtacattcattaaaacttgcccttgaaggcgtggaaaaggaaagggatttctactttgggaagttgagagagatcgagctactctgccaagaacacgggcaggaaaatgatgacctcgtgcagagactaatggacatcctgtatgcttcagaagaacacgagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactgttgcatatgccagccactgcgcttggttcccattttctttgccaaggtgtattagcggacggccctctggccacctacccgagagatcgtagggtcacatacatccaacttcaccacttggctgcttgagattggttctgctcttttcttcatttctttccagaacaactctttcccaccccaacaccactgccaccacccctctttttatcctggtgtgaaacaatggtaatttgatatatggtatttatattggcatttttcaacccagtgtcactagatgtcacacacatttgtggtgctttgatgtttgcaagtctaacctctgaacataaatttggtcaaataattggaacaaagggaaacagatacttgatatgaaagccataatgacggtgacttgtgtcgtgggggaaaacataaggtcattttctccctctactcacaatactaaagggaaaaaatggattcaaagctaggatttcagggcccagcagtgttcctccatcagcatgttagacaactacacagtatgttgttagttttgaaagacattcactcaaggaaaacaccatctcaactttgcccgctcaccatgtcccttgcccccatgtagcccatttcccaggttatgctcttttctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaataacagcacagaaaaatctatgactcccaatatcttctagaataaagaattttccctctttaacacaagggccctccttgtcattgaccttagctaaaccatggcaattcataaatagaggaaacattaatgaattaaaagcattccttattttttaactaatatttgtacattttcttagtctctttccaagtctttgcctcttttttttctttatttttattttttcctttgacagatggtatcccttcctggatcattcatttcaccttggtttctaactttaggtttactttcacttgttatttgacttagcaggtgcaacaaaaacaagaaacaaatgtgcccaccccactttccgcttaactgaaaagcttaaaataaatttctgaattatgtatcctgaagctttgaaatttctttattaatcgatgaaatatgaattctaaattctagcattgaagcttttcaccaaaagaagtctctccaaaataaatcttttgcagcaaagtgatatttattgagttatgtggaaaagatggcttgtatttttcagattattacaacacactgtgcagaattagacagatgttccgtggtgtttggtttccctttcttctctctcctgctcactctgcattatagcagcagcttatttctctaaggctggacagcctggctctcggcagtgacgtcctcccacacctggtcacaagtagtagtggctgtgctatacccagcatcatgcttaacagcgtgttgcccttctgagcctgttgtactcactgatctctttaaaaacaaaaaatagctcttgtaaaaggtcacaataactctatgcacctgatactgcagtggttcctaggccattcttcatctgctctggacatctcagtcatacccaatgctcagtggatcatgaccaaactcctgtcatgtggatgcacgtgagtgggtagcagggagtcaggatcctgccttctccagcaaccccttactgctgtataacttgcataagcctccctggtgactcttgcaggaaccactccattgccctccagctccccagccttctcagttataaacatgctggccagatctcttagcctgcaaagagaactttccccagtcaccatagaccattctccttcctgaaggcttggggcagaccattcgtttatttagagaagagctatacattcttctttctggtcccatcttaaacgtcttctgttgtgctgcaccccagatggtgtctcagatgctttggggaatctttaacagctgaatttgagtcagtcctcttaggctgcacctccagcctctgcagatcccccctcatttcccatggatggtgggaccccattattctctcatctcggcattcagggaacactttccttagcggcccctggtcacatgtcatcgggctgggcaggaagcgtccctgggtgcgtgctccacttctccctctcaggaagcccagtttcatccttagtaccccccctcgtgcccgctgtcggctggttatagcacttccactgctactgtcagataggaagtgatcgaagcagggggcaaagagaaagcccatatttgttctaagcagaaaagcaggaaaaaaaaaaaaaaaaaaagaaagaaaaacacctgttgacctgagagaagtaaattccagaagggaaccaagaactcttcccttccctggtgagtatttccattattccgttaaggtttaatatgcattcagattacttttactaaataggacaccataaagcttttgttatatattaaatgtaaactgaaaggaatgtaaacatatgtattgttaattataaatatagataagtaatgacataatagatgaaaaagtcttattcagatgtatcacattcattttacattacccacctattgtcgcatggtagaatagttttttgtctctgaatatgtgaataacttgacttgcattgatctttttacatatttaataaaaaaaaaagtatatgttaaaaaaaaaa

SEQ ID NO: 456824 - DNA, 3813 bp, Homo sapiens
  misc_feature (29)..(29): n is a, c, g, or t
ttcatagggttacccccccccccgattantgggatatagtcgacccaggccgtcgatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtacattcattaaaacttgcccttgaaggcgtggaaaaggaaagggatttctactttgggaagttgagagagatcgagctactctgccaagaacacgggcaggaaaatgatgacctcgtgcagagactaatggacatcctgtatgcttcagaagaacacgagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactgttgcatatgccagccactgcgcttggttcccattttctttgccaaggtgtattagcggacggccctctggccacctacccgagagatcgtagggtcacatacatccaacttcaccacttggctgcttgagattggttctgctcttttcttcatttctttccagaacaactctttcccaccccaacaccactgccaccacccctctttttatcctggtgtgaaacaatggtaatttgatatatggtatttatattggcatttttcaacccagtgtcactagatgtcacacacatttgtggtgctttgatgtttgcaagtctaacctctgaacataaatttggtcaaataattggaacaaagggaaacagatacttgatatgaaagccataatgacggtgacttgtgtcgtgggggaaaacataaggtcattttctccctctactcacaatactaaagggaaaaaatggattcaaagctaggatttcagggcccagcagtgttcctccatcagcatgttagacaactacacagtatgttgttagttttgaaagacattcactcaaggaaaacaccatctcaactttgcccgctcaccatgtcccttgcccccatgtagcccatttcccaggttatgctcttttctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaataacagcacagaaaaatctatgactcccaatatcttctagaataaagaattttccctctttaacacaagggccctccttgtcattgaccttagctaaaccatggcaattcataaatagaggaaacattaatgaattaaaagcattccttattttttaactaatatttgtacattttcttagtctctttccaagtctttgcctcttttttttctttatttttattttttcctttgacagatggtatcccttcctggatcattcatttcaccttggtttctaactttaggtttactttcacttgttatttgacttagcaggtgcaacaaaaacaagaaacaaatgtgcccaccccactttccgcttaactgaaaagcttaaaataaatttctgaattatgtatcctgaagctttgaaatttctttattaatcgatgaaatatgaattctaaattctagcattgaagcttttcaccaaaagaagtctctccaaaataaatcttttgcagcaaagtgatatttattgagttatgtggaaaagatggcttgtatttttcagattattacaacacactgtgcagaattagacagatgttccgtggtgtttggtttccctttcttctctctcctgctcactctgcattatagcagcagcttatttctctaaggctggacagcctggctctcggcagtgacgtcctcccacacctggtcacaagtagtagtggctgtgctatacccagcatcatgcttaacagcgtgttgcccttctgagcctgttgtactcactgatctctttaaaaacaaaaaatagctcttgtaaaaggtcacaataactctatgcacctgatactgcagtggttcctaggccattcttcatctgctctggacatctcagtcatacccaatgctcagtggatcatgaccaaactcctgtcatgtggatgcacgtgagtgggtagcagggagtcaggatcctgccttctccagcaaccccttactgctgtataacttgcataagcctccctggtgactcttgcaggaaccactccattgccctccagctccccagccttctcagttataaacatgctggccagatctcttagcctgcaaagagaactttccccagtcaccatagaccattctccttcctgaaggcttggggcagaccattcgtttatttagagaagagctatacattcttctttctggtcccatcttaaacgtcttctgttgtgctgcaccccagatggtgtctcagatgctttggggaatctttaacagctgaatttgagtcagtcctcttaggctgcacctccagcctctgcagatcccccctcatttcccatggatggtgggaccccattattctctcatctcggcattcagggaacactttccttagcggcccctggtcacatgtcatcgggctgggcaggaagcgtccctgggtgcgtgctccacttctccctctcaggaagcccagtttcatccttagtaccccccctcgtgcccgctgtcggctggttatagcacttccactgctactgtcagataggaagtgatcgaagcagggggcaaagagaaagcccatatttgttctaagcagaaaagcaggaaaaaaaaaaaaaaaaaaagaaagaaaaacacctgttgacctgagagaagtaaattccagaagggaaccaagaactcttcccttccctggtgagtatttccattattccgttaaggtttaatatgcattcagattacttttactaaataggacaccataaagcttttgttatatattaaatgtaaactgaaaggaatgtaaacatatgtattgttaattataaatatagataagtaatgacataatagatgaaaaagtcttattcagatgtatcacattcattttacattacccacctattgtcgcatggtagaatagttttttgtctctgaatatgtgaataacttgacttgcattgatctttttacatatttaataaaaaaaaaagtatatgttaaaaaaaaaa

SEQ ID NO: 456825 - DNA, 1460 bp, Homo sapiens
  misc_feature (1458)..(1459): n is a, c, g, or t
agctgccagagggcggggccgcaggagggcggggcgcgagcgagagctgggagaaggcagtgagcgagcaggcggcaggcacggtccgtgcggagcaggcgagcgagcgggaagacgcagccaccttcctcaccagccagcccacagcggtttgttccccttctcgggagtgcgccaatgcctgggccgacccaaaccctgtccccaaatggcgagaacaacaacgacatcatccaggataataacgggaccatcattcctttccggaagcacacagtgcgcggggagcgttcctacagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtaatgcatcagctctggccacgcctctaggagcagtgacgtgtgtaagaggtagggggcctaggatcccctaggactggggtaagggagggaagggtaaggaagaatccttggtttcaagtaagtgagaataaaaagaattgttcgaagacaaaatcagtagcccatgatgaataaaaagtgttagtcacaaatctcaaagctgtacattaagatggggcagatggctcagccttgctgcagacttcaggctaccttcccctcccctgctcctcagggctgtcaagagctccaggctagaccgttgcccatcctgcccacttctggccattctagatagtgctgcattagggtgagtctgcctccctctctttttaaaggctgggtcagggttagtctgtctccctcccactctcttcttttttcccttcttcctttctttcttcagctattagtagttgagcttattctatatgaaagatattacgcttaatgctggtaatataaaggtagtaaaatagataccttccnnc

SEQ ID NO: 456826 - DNA, 716 bp, Homo sapiens
agcggaaaaacaaagcccccagctgtcagcagaggaaggaggcgacagcgccggagcagtgtcctgtttcccagaggaacagttcatttcaacagccagggagaaagcctggatgctcaagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataagggatttcaatggaaagcctggaaaggacctttcaagacaacctggatttattaaagggttaagaattcttgatgctaactccaaggaaagagtttagacctttaaaggcccacagggcaaaaccattcctcttcggaccttggaaaagatttaacctccagatcccacctttggacctataagcaaagggctttccagggctcagatcaacgtaaataaaccagatcagtatacagcatataactgctgagctgaagaggtttctgagaactctcacggatcgatgcttaacgcacggcacaatcctctggtagagaacac

SEQ ID NO: 456827 - DNA, 462 bp, Homo sapiens
tgatttttttttaaagaagtgatatgttggactctgttgtagaagaatgagcactagtattcagcaacaagtgcaatttctccatgttatgttgagctctgttggagcctatggtgagtatttgatgtgaaaaccttgctgtgggaattttttattcttccttttccccccacgccagttcgttttggtaagtcttttatttgaacacaagacgcatgcttttttaaacctctagtttttgaagtaactgtagaagagaatctttaaaaaaaaaaatggagggcagaatgcttgttagcaatctgaaaatcaaagctgaacaagctgcttaaagtttctgattaagaagtttaaaaagaaaaattaattgctactgctttccaggtaattgtattattagtttctgtataaaagaaacattattgctgttgtataaataaaattttcctgtggtacaattaa

SEQ ID NO: 456828 - DNA, 2568 bp, Homo sapiens
acacgccctcggggtcggtcctcgaggacgcgcagggccccccacccaccaggacgcacgtttcaagctcatcagtaaaggttccttaaattcccgaagggcaagaagttaaccaagtaaaacagcatcggaacaccaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacacaa

SEQ ID NO: 456829 - DNA, 2559 bp, Homo sapiens
ccacgagacattggccggcgccggcctccgcccccgcctctccgccaatcaccgcccgcctgctcccctcgccgtgggtccccgcgaggccgccaccccggggtcgccgtctccgcctcgccgcagtcggggcagccgctcgcccctcttttccatgtatccgtccagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacacaa

SEQ ID NO: 456830 - DNA, 2354 bp, Homo sapiens
acacgccctcggggtcggtcctcgaggacgcgcagggccccccacccaccaggacgcacgtttcaagctcatcagtaaaggttccttaaattcccgaagggcaagaagttaaccaagtaaaacagcatcggaacaccaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacacaa

SEQ ID NO: 456831 - DNA, 817 bp, Homo sapiens
aaacctaggctaggtacgaggccgggtgttgggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacgccggccgtggtggcacgtggtccgagcacgctgtgggggcttcccttgccgttgtgtccgccaaggtgttgcgctgctctgtccgg

SEQ ID NO: 456832 - DNA, 620 bp, Homo sapiens
tttttttttttctggagacagtctcgctcagtcgcacaggctggaggacagtggcgcgatcccggcctccaatgccaccttccagagccttcatgatgtaactccatccctgtcccctccccacatcgccggctttattgttcttcgtgtcagttcctgccagtggacatttaattctaattcacgtctcactccctcccctactgtgagccccacgtggcagagaccgcggcggagctgcgcgggccggaggaggctgcggagcatcgctctgacctgagccggggacgctgcggaggcgcagcacgttcctctgcccagagctgatgggcaccgtccgtgtctttcgctgcaggtccggggggagactcgggggcctgggatcccccatttagccatagggcggggggatcaggttcagcctctgaaagtccagagcacgatgtttgggaaacggccccgcccgcggcctccgggacctggcgaaggagccccgcggggcgcccctgctaccaccctgcgcggagtcggccccgtccccgagagcgcccggcagcccctggccgtgggccgcaccggagccgcgcaaggcgactgttctgcgcctcggctcggggttc

SEQ ID NO: 456833 - DNA, 2784 bp, Homo sapiens
tttttttttttctggagacagtctcgctcagtcgcacaggctggaggacagtggcgcgatcccggcctccaatgccaccttccagagccttcatgatgtaactccatccctgtcccctccccacatcgccggctttattgttcttcgtgtcagttcctgccagtggacatttaattctaattcacgtctcactccctcccctactgtgagccccacgtggcagagaccgcggcggagctgcgcgggccggaggaggctgcggagcatcgctctgacctgagccggggacgctgcggaggcgcagcacgttcctctgcccagagctgatgggcaccgtccgtgtctttcgctgcaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacacaa

SEQ ID NO: 456834 - DNA, 2462 bp, Homo sapiens
ccacgagacattggccggcgccggcctccgcccccgcctctccgccaatcaccgcccgcctgctcccctcgccgtgggtccccgcgaggccgccaccccggggtcgccgtctccgcctcgccgcagtcggggcagccgctcgcccctcttttccatgtatccgtccaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctgggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacacaa

SEQ ID NO: 456835 - DNA, 2122 bp, Homo sapiens
aaacctaggctaggtacgaggccgggtgttgggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacacaa

SEQ ID NO: 456836 - DNA, 2383 bp, Homo sapiens
ccacgagacattggccggcgccggcctccgcccccgcctctccgccaatcaccgcccgcctgctcccctcgccgtgggtccccgcgaggccgccaccccggggtcgccgtctccgcctcgccgcagtcggggcagccgctcgcccctcttttccatgtatccgtccaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacacaa

SEQ ID NO: 456837 - DNA, 2361 bp, Homo sapiens
ccacgagacattggccggcgccggcctccgcccccgcctctccgccaatcaccgcccgcctgctcccctcgccgtgggtccccgcgaggccgccaccccggggtcgccgtctccgcctcgccgcagtcggggcagccgctcgcccctcttttccatgtatccgtccaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacacaa

SEQ ID NO: 456838 - DNA, 1672 bp, Homo sapiens
gacgactctagagatcccccgatctgactacgcggctcgatctgactacgcggctcgatctgaggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacacaa

SEQ ID NO: 456839 - DNA, 3260 bp, Homo sapiens
ccacgagacattggccggcgccggcctccgcccccgcctctccgccaatcaccgcccgcctgctcccctcgccgtgggtccccgcgaggccgccaccccggggtcgccgtctccgcctcgccgcagtcggggcagccgctcgcccctcttttccatgtatccgtccaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtcgcaggaccaggcctgggcaggcgtggtgggggggcctgcaggtaggtatcacccacccctcagaatggctctcaggctcagattcacagcctccccatggcaaatggaggccttccagggtcctggacccacccccaagcttgggtaggagggatccccctcttaatctcacatttacttgtgtttgaacatctcagaaaaaaaaaaagatgcaaattccaatgtcagggtccccaaatcaagtcttcctggagcatgtccacgcttgtcaccaccgtctgtggctgctttcaagcacgtcagggctgcgtgctcataacagagacggcacggcccccaagacctaaaataccaccagctggcccttgtcggaaagtcccctggctggccctagtccattgactctgggccgagctgccagggccacagaagcctgcggcactcagggctcccagggctcccttctccaacagttgctgtgcctccgtttccccaaaatgcaaggagctgatctcatctgtgttccctatcttttcctggggctctaagtgggccaccccaagggacctctgcctacaaagagaggagtgacagccgtggcggagttgggacgggctccgagggctcttcctcacccgcaccttgctcacccctctgtgcctcatgacagctggtgtagggtcctgtggagacgcaggaccaagaggatgtgtggggagcggggagagagagggaacgagatctgtgttaaggaactggatcatgagatcacggaggctgacaaaccctgagatctgcagggtgaggcggcaggccggagactggagagccagcagttcaagccccaaggcaggaaattccacctttggttctattcaggccttcaactgcttgggtgaggccctccacagtagcacacgttatctgcctcttgactcttgtgctaatccggaatcccctcacacatgcccagaacgacgtgtgaccaatgcctgggctcccacggccccgttaatctgtattaaaattaaccatcacaacagccctgtctgggtatgtggcatgggagcctcggccagcattaacaccgggtctacgcttgccaggagaaagcaggaggggtgaagacagaatcaggccagagatggaagctgtgtgctgcccatggtggcaaggggtttttgtctgtttttagagacagggtcttgctctgttgccgactggagtgcagtagtgccatcatggctcgctgcagcctcgacctgctgtgctcaactgatccttctgcctcagtctcccaagtagctgggaccacaagcgtgtgccaccatgctcgactaatttatttttaaaaatattctgtagagacagggtctcaatatgttgcccaggctggtcccagacttccgggcttaaatgatcctcccaccttggctcccacagcgctgggatcac

SEQ ID NO: 456840 - DNA, 1881 bp, Homo sapiens
ccacgagacattggccggcgccggcctccgcccccgcctctccgccaatcaccgcccgcctgctcccctcgccgtgggtccccgcgaggccgccaccccggggtcgccgtctccgcctcgccgcagtcggggcagccgctcgcccctcttttccatgtatccgtccaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagttcagcaagtcaatggcggtgaccaccccgaacaccatctgccgctgactggacttcccg

SEQ ID NO: 456841 - DNA, 1658 bp, Homo sapiens
ccacgagacattggccggcgccggcctccgcccccgcctctccgccaatcaccgcccgcctgctcccctcgccgtgggtccccgcgaggccgccaccccggggtcgccgtctccgcctcgccgcagtcggggcagccgctcgcccctcttttccatgtatccgtccaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtgagtgggtggcgggcacgggggtatggggaaggcagagatggctagggggcactggggatggctgggggcgcaccctcagtcagccaccgacctgcatgtgtaagacagcagttctgaggagtgtcactgcggcggccacgagcctcaggtgttgtctgcctgcccagtgtggtcacctgctcaggtgagggcaggaggccatggggcggggcttcgagctgccttccagaatgtgtttctagaacaaggctgaagctctcatggcacttattgtttctaatcaagtccaccagggcccctggggcggtggctctgcattgacggggcccatggccgggactgggtgctgcgagcaccctggagc

SEQ ID NO: 456842 - DNA, 1179 bp, Homo sapiens
gcgatggctgtgtgcatgctcacacacgcttgttggccatgggggcgggaagtccagcccccaggcttccccctggggcttccagccagcacttgggggtctctgctgcaccagtgaggtccaggagaggggctgggcaggcagtgcgtgccactcagcaggggcgggggcccggtggggccctgcggggactcggtgactcccccatcccgcaggaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacacaa

SEQ ID NO: 456843 - DNA, 2597 bp, Homo sapiens
ccacgagacattggccggcgccggcctccgcccccgcctctccgccaatcaccgcccgcctgctcccctcgccgtgggtccccgcgaggccgccaccccggggtcgccgtctccgcctcgccgcagtcggggcagccgctcgcccctcttttccatgtatccgtccaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacacaa

SEQ ID NO: 456844 - DNA, 2665 bp, Homo sapiens
  misc_feature (4)..(5): n is a, c, g, or t
  misc_feature (491)..(491): n is a, c, g, or t
gaannccctgggatcagaaaactcgctggttaatgagtggccaagaacatatcagcttaagtttgggaaaaacacacaacagggcattgtgtcagagggtgaccaaagtgactccccagcagatggaccagggaacgaacaggtgacctttgaactgaggccggagtggaagcagcgagggtgtgaagggccgggtgagggtcaaaggcagaagcaagcaggtggggagggttagcgtcatgcctgctaaggagcagtggacgggtcctagcacgtgctgtgagccacccgctgtccagggagcggttacctctgtcttgccagcttcgtggggacagatagttcagctcatcatttatgagacagagaatgggaatttggagggtctgtggctggcctcgtcctgggtgcgcagggggtcacctgaggtgtggtctgaggcctccggggaagggcatttctttgcaggacgcagtttccaggctcaagancgtggagggaattcctaagggtcgctcttcaccaagagcgcagagccctggtagacctcagcatcgtcacagagaaagctgtgggtgcagaggccttggggacaaggcggggacggaatttcgtatttcagatgaccaaggccaatggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacacaa

SEQ ID NO: 456845 - DNA, 1690 bp, Homo sapiens
agcgcatccccgggcgtccccaccacatccccacaggccaggagagtcgctcgcaggttttgggtcatagatggcagccctgggcctggggcccacaggaagagttgggaggggccctggagcctggagcctgcccacccaccaggcctgtgtgcagggggtgagcgctcggtggctgaggctggtccgtgagggccccaagtctaaccccatctcccgtccttggctctgcagcgcaggaccaggcctgggcaggcgtggtgggggggcctgcaggtaggtatcacccacccctcagaatggctctcaggctcagattcacagcctccccatggcaaatggaggccttccagggtcctggacccacccccaagcttgggtaggagggatccccctcttaatctcacatttacttgtgtttgaacatctcagaaaaaaaaaaagatgcaaattccaatgtcagggtccccaaatcaagtcttcctggagcatgtccacgcttgtcaccaccgtctgtggctgctttcaagcacgtcagggctgcgtgctcataacagagacggcacggcccccaagacctaaaataccaccagctggcccttgtcggaaagtcccctggctggccctagtccattgactctgggccgagctgccagggccacagaagcctgcggcactcagggctcccagggctcccttctccaacagttgctgtgcctccgtttccccaaaatgcaaggagctgatctcatctgtgttccctatcttttcctggggctctaagtgggccaccccaagggacctctgcctacaaagagaggagtgacagccgtggcggagttgggacgggctccgagggctcttcctcacccgcaccttgctcacccctctgtgcctcatgacagctggtgtagggtcctgtggagacgcaggaccaagaggatgtgtggggagcggggagagagagggaacgagatctgtgttaaggaactggatcatgagatcacggaggctgacaaaccctgagatctgcagggtgaggcggcaggccggagactggagagccagcagttcaagccccaaggcaggaaattccacctttggttctattcaggccttcaactgcttgggtgaggccctccacagtagcacacgttatctgcctcttgactcttgtgctaatccggaatcccctcacacatgcccagaacgacgtgtgaccaatgcctgggctcccacggccccgttaatctgtattaaaattaaccatcacaacagccctgtctgggtatgtggcatgggagcctcggccagcattaacaccgggtctacgcttgccaggagaaagcaggaggggtgaagacagaatcaggccagagatggaagctgtgtgctgcccatggtggcaaggggtttttgtctgtttttagagacagggtcttgctctgttgccgactggagtgcagtagtgccatcatggctcgctgcagcctcgacctgctgtgctcaactgatccttctgcctcagtctcccaagtagctgggaccacaagcgtgtgccaccatgctcgactaatttatttttaaaaatattctgtagagacagggtctcaatatgttgcccaggctggtcccagacttccgggcttaaatgatcctcccaccttggctcccacagcgctgggatcac

SEQ ID NO: 456846 - DNA, 344 bp, Homo sapiens
atattggttacagtgtatagactagctgaatcaagatgaattcacgattaaaatatactatgacagaaattttaggatacagatactagaacattcagctgccgctacagcgatatgcccgagtcatcgagctttgaattcatcatcgtggatcctccgtgagaactgtttgaaatagttatccgttatggatgaggcgggggtaatcctgggaatggtgacgcttgggaacatgctctcgtccctgcttgccgggaaggtgcagccgtcagaccaagttggcaaagtcatctacaagcagttcaaacaggtacccagtcacctacaggcagctcaaacagatg

SEQ ID NO: 456847 - DNA, 2579 bp, Homo sapiens
gaaaggcggcgagacagggtctcccaagacccccgccccaccggcgcccacgcctgcggtcttgaccgcccagaagatgggggctggccgtgcacgtggccccgggctcccaccccagcccccgcgccggcggagtggaccccactggcggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacacaa

SEQ ID NO: 456848 - DNA, 2307 bp, Homo sapiens
ccacgagacattggccggcgccggcctccgcccccgcctctccgccaatcaccgcccgcctgctcccctcgccgtgggtccccgcgaggccgccaccccggggtcgccgtctccgcctcgccgcagtcggggcagccgctcgcccctcttttccatgtatccgtccaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacacaa

SEQ ID NO: 456849 - DNA, 2354 bp, Homo sapiens
ccacgagacattggccggcgccggcctccgcccccgcctctccgccaatcaccgcccgcctgctcccctcgccgtgggtccccgcgaggccgccaccccggggtcgccgtctccgcctcgccgcagtcggggcagccgctcgcccctcttttccatgtatccgtccaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgcgtaagggccagcagggtaccgag

SEQ ID NO: 456850 - DNA, 1774 bp, Homo sapiens
cacagaccaagggcagcaacgagggctgctccaactggagaagaagtttttcttttgaactttttggttacccaccgtggtttgggctgagtgtgttttcaatgattattactatgagtgatgggctggccaggcagggacccaagaatgttatccgtccaccagggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacacaa

SEQ ID NO: 456851 - DNA, 1751 bp, Homo sapiens
ccacgagacattggccggcgccggcctccgcccccgcctctccgccaatcaccgcccgcctgctcccctcgccgtgggtccccgcgaggccgccaccccggggtcgccgtctccgcctcgccgcagtcggggcagccgctcgcccctcttttccatgtatccgtccaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacacaa

SEQ ID NO: 456852 - DNA, 2319 bp, Homo sapiens
ccacgagacattggccggcgccggcctccgcccccgcctctccgccaatcaccgcccgcctgctcccctcgccgtgggtccccgcgaggccgccaccccggggtcgccgtctccgcctcgccgcagtcggggcagccgctcgcccctcttttccatgtatccgtccaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctgggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaatcaatacctaaatcatcactgaagtgacatcgggcttatctccaattgttggccccctgtcgtctgactctgttccccgaaaatttcctccttttctc

SEQ ID NO: 456853 - DNA, 1334 bp, Homo sapiens
ccacgagacattggccggcgccggcctccgcccccgcctctccgccaatcaccgcccgcctgctcccctcgccgtgggtccccgcgaggccgccaccccggggtcgccgtctccgcctcgccgcagtcggggcagccgctcgcccctcttttccatgtatccgtccaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggattccccgaaagggtcccattccttcgcaggaggcccggagggaggctggaaccagacgggagccacaaactatggaggtgtgaggggtccggtacgacttccttccccccggtggctcgggaccggccggggtcggccagggttctccagaccgtgtgggggggtccctttccccttttgtcgccaaagggggctgtgcggggctgctccgggggccccgcgccggactgtcggccctca

SEQ ID NO: 456854 - DNA, 929 bp, Homo sapiens
gtaatcctccactgccaagtagcacttcagtgtttcatttggacccacctgtcaaaaaattgttggttagcccagaaggagccattttgaataccataaatactccagcatctaaggtttcttcactctctccatctctctctcagattgttgtatctgccagtcgaagtcctgcgtctgtcttccctgcttttcagtcgtcgggcttagagaagcctgacagagctgcatcttgaatttagactaaaagagccagtttttaaataatggggcattgttttgactcccataaaaattttcaatgtttattatactgttgaaagcatactatacattgtgtgtgtgtgtgtgtgtgtgtgtgtgtgtgtgtgtgtgtgtgtgtgtgttttaatgtatcttttcattagcttgcaacaaggctttgttttcttggggagggaaagatctgttccatttcacttactgttctgaggagggtttcaaggttctgtgtttaaagtcaggatttacctgtctgtagaacataaagtgaacaaagtttgaatagtttagagtaagctagccttttgcacatttacattgacatgtttcttcttgaatttggactgttgcagcatatctatgatatggtattcagtgtcattagtgaaatcttatttttgtttctgtaaaaaaaaaaatacatatatatatttatgcattgtgaaaaatgcagtccatgatgtaaaattgtacatattccagaatccctaacaacctgtactaaatatatgtacaaagaactatgctgtcttatttatgttttgtttacataatgtatagttttttaagtattttagtaattttggaccagtgaactgttagcaacaatgcagaagaatctgcatgtaataaactgagttgctgtatttctttgtttgaataccatt

SEQ ID NO: 456855 - DNA, 1281 bp, Homo sapiens
cgggtggggcggcagcgcccgccgcgagcacctccagttctgccggcttctgcgcgccggggccgcctctccttccgccggtgccgcggcgcctcatggaagccccggagggcggcggaggggggcctgcagcgcggggcccggaggggcagccggcgcccgaagccagggtgcacttccgagtggcgaggttcatcatggaggcaggtgtcaagctagggatgcggtccattcccattgccactgcttgcaccatttaccataagttcttttgcgagaccaacctggacgcctatgacccttacctgattgccatgtcttcaatttacttggccggcaaagtggaagagcagcacctgcggactcgtgacatcatcaatgtgtccaacaggtactttaacccaagcggtgagcccctggaattggactcccgcttctgggaactccgggacagcatcgtgcagtgtgagcttctcatgctgagagttctgcgcttccaggtctccttccagcatccacacaagtacctgctccactacctggtttccctccagaactggctgaaccgccacagctggcagcggacccctgttgccgtcaccgcctgggccctgctgcgggacagctaccatggggcgctgtgcctccgcttccaggcccagcacatcgccgtggcggtgctctacctggccctgcaggtctacggagttgaggtgcccgccgaggtcgaggctgagaagccgtggtggcaggtgtttaatgacgaccttaccaagccaatcattgataatattgtgtctgatctcattcagatttataccatggacacagagatcccctaaggtcctggcccaggcctgcccaaagagaagcccaggatggtcggctgcctggggacattgtcaccacgtcgccatgacggctggtccccacaggaccagctgggaggactggttgtgctgctggagaagggctggagaaggcaatggcatgctgccgctttgccagtccctagaagtcgcggtgcaggtgatggtgggagccgcgcctccagcgggcaggccgggagtgtactgtgtgcagctgacccaaggcagccacatctgcgtttgtcctttgagaggactttgactacaatacaggcatgacatcaatgaaaggaaagtcatgaaatcgatgagactgaatccctacggatttcttaaaagccagatttgtagggagaatgaatgtgcaacgtggctgaaatctattttgtgtaataaaaggtgatacaagtca

SEQ ID NO: 456856 - DNA, 550 bp, Homo sapiens
ctctctgagtcagaagatcaccaaggcctgttccatctggaatgttctcggccttgtaaagtgtttggcctcaacgggctggaattaaactggctttgcaggagagctactgtcttcctacatagccaagtccctgtgcccctcccctgcccatgaaatgtgattctctgcttagtgacaggtgccttgtttaacatagagggagtctaactggaacctgttttccttcttctttctaggtgtttaatgacgaccttaccaagccaatcattgataatattgtgtctgatctcattcagatttataccatggacacagagatcccctaaggtcgggagtgtactgtgtgcagctgacccaaggcagccacatctgcgtttgtcctttgagaggactttgactacaatacaggcatgacatcaatgaaaggaaagtcatgaaatcgatgagactgaatccctacggatttcttaaaagccagatttgtagggagaatgaatgtgcaacgtggctgaaatctattttgtgtaataaaaggtgatacaagtca

SEQ ID NO: 456857 - DNA, 1495 bp, Homo sapiens
cgggtggggcggcagcgcccgccgcgagcacctccagttctgccggcttctgcgcgccggggccgcctctccttccgccggtgccgcggcgcctcatggaagccccggagggcggcggaggggggcctgcagcgcggggcccggaggggcagccggcgcccgaagccagggtgcacttccgagtggcgaggttcatcatggaggcaggtgtcaagctagggatgcggtccattcccattgccactgcttgcaccatttaccataagttcttttgcgagaccaacctggacgcctatgacccttacctgattgccatgtcttcaatttacttggccggcaaagtggaagagcagcacctgcggactcgtgacatcatcaatgtgtccaacaggtactttaacccaagcggtgagcccctggaattggactcccgcttctgggaactccgggacagcatcgtgcagtgtgagcttctcatgctgagagttctgcgcttccaggtctccttccagcatccacacaagtacctgctccactacctggtttccctccagaactggctgaaccgccacagctggcagcggacccctgttgccgtcaccgcctgggccctgctgcgggacagctaccatggggcgctgtgcctccgcttccaggcccagcacatcgccgtggcggtgctctacctggccctgcaggtctacggagttgaggtgcccgccgaggtcgaggctgagaagccgtggtggcaggtgtttaatgacgaccttaccaagccaatcattgataatattgtgtctgatctcattcagatttataccatggacacagagatcccctaaggtcctggcccaggcctgcccaaagagaagcccaggatggtcggctgcctggggacattgtcaccacgtcgccatgacggctggtccccacaggaccagctgggaggactggttgtgctgctggagaagggctggagaaggcaatggcatgctgccgctttgccagtccctagaagtcgcggtgcaggtgatggtgggagccgcgcctccagcgggcaggcctaccatggggcgctgtgcctccgcttccaggcccagcacatcgccgtggcggtgctctacctggccctgcaggtctacggagttgaggtgcccgccgaggtcgaggctgagaagccgtggtggcaggtgtttaatgacgaccttaccaagccaatcattgataatattgtgtctgatctcattcagatttataccatggacacagagatcccctaaggtcctggcccaggcctgcccaaagagaagcccacatctgcgtttgtcctttgagaggactttgactacaatacaggcatgacatcaatgaaaggaaagtcatgaaatcgatgagactgaatccctacggatttcttaaaagccagatttgtagggagaatgaatgtgcaacgtggctgaaatctattttgtgtaataaaaggtgatacaagtca

SEQ ID NO: 456858 - DNA, 1221 bp, Homo sapiens
cgggtggggcggcagcgcccgccgcgagcacctccagttctgccggcttctgcgcgccggggccgcctctccttccgccggtgccgcggcgcctcatggaagccccggagggcggcggaggggggcctgcagcgcggggcccggaggggcagccggcgcccgaagccagggtgcacttccgagtggcgaggttcatcatggaggcaggtgtcaagctagggatgcggtccattcccattgccactgcttgcaccatttaccataagttcttttgcgagaccaacctggacgcctatgacccttacctgattgccatgtcttcaatttacttggccggcaaagtggaagagcagcacctgcggactcgtgacatcatcaatgtgtccaacaggtactttaacccaagcggtgagcccctggaattggactcccgcttctgggaactccgggacagcatcgtgcagtgtgagcttctcatgctgagagttctgcgcttccaggtctccttccagcatccacacaagtacctgctccactacctggtttccctccagaactggctgaaccgccacagctggcagcggacccctgttgccgtcaccgcctgggccctgctgcgggacagctaccatggggcgctgtgcctccgcttccaggcccagcacatcgccgtggcggtgctctacctggccctgcaggtctacggagttgaggtgcccgccgaggtcgaggctgagaagccgtggtggcagatttataccatggacacagagatcccctaaggtcctggcccaggcctgcccaaagagaagcccaggatggtcggctgcctggggacattgtcaccacgtcgccatgacggctggtccccacaggaccagctgggaggactggttgtgctgctggagaagggctggagaaggcaatggcatgctgccgctttgccagtccctagaagtcgcggtgcaggtgatggtgggagccgcgcctccagcgggcaggccgggagtgtactgtgtgcagctgacccaaggcagccacatctgcgtttgtcctttgagaggactttgactacaatacaggcatgacatcaatgaaaggaaagtcatgaaatcgatgagactgaatccctacggatttcttaaaagccagatttgtagggagaatgaatgtgcaacgtggctgaaatctattttgtgtaataaaaggtgatacaagtca

SEQ ID NO: 456859 - DNA, 1235 bp, Homo sapiens
cgggtggggcggcagcgcccgccgcgagcacctccagttctgccggcttctgcgcgccggggccgcctctccttccgccggtgccgcggcgcctcatggaagccccggagggcggcggaggggggcctgcagcgcggggcccggaggggcagccggcgcccgaagccagggtgcacttccgagtggcgaggttcatcatggaggcagcatttaccataagttcttttgcgagaccaacctggacgcctatgacccttacctgattgccatgtcttcaatttacttggccggcaaagtggaagagcagcacctgcggactcgtgacatcatcaatgtgtccaacaggtactttaacccaagcggtgagcccctggaattggactcccgcttctgggaactccgggacagcatcgtgcagtgtgagcttctcatgctgagagttctgcgcttccaggtctccttccagcatccacacaagtacctgctccactacctggtttccctccagaactggctgaaccgccacagctggcagcggacccctgttgccgtcaccgcctgggccctgctgcgggacagctaccatggggcgctgtgcctccgcttccaggcccagcacatcgccgtggcggtgctctacctggccctgcaggtctacggagttgaggtgcccgccgaggtcgaggctgagaagccgtggtggcaggtgtttaatgacgaccttaccaagccaatcattgataatattgtgtctgatctcattcagatttataccatggacacagagatcccctaaggtcctggcccaggcctgcccaaagagaagcccaggatggtcggctgcctggggacattgtcaccacgtcgccatgacggctggtccccacaggaccagctgggaggactggttgtgctgctggagaagggctggagaaggcaatggcatgctgccgctttgccagtccctagaagtcgcggtgcaggtgatggtgggagccgcgcctccagcgggcaggccgggagtgtactgtgtgcagctgacccaaggcagccacatctgcgtttgtcctttgagaggactttgactacaatacaggcatgacatcaatgaaaggaaagtcatgaaatcgatgagactgaatccctacggatttcttaaaagccagatttgtagggagaatgaatgtgcaacgtggctgaaatctattttgtgtaataaaaggtgatacaagtca

SEQ ID NO: 456860 - DNA, 1258 bp, Homo sapiens
gagacacagacagatggaggagagagagacgagacagagagaaactccaagatactagacggacttcatgacgcgccaggaggaccagactctccttccgccggtgccgcggcgcctcatggaagccccggagggcggcggaggggggcctgcagcgcggggcccggaggggcagccggcgcccgaagccagggtgcacttccgagtggcgaggttcatcatggaggcagcatttaccataagttcttttgcgagaccaacctggacgcctatgacccttacctgattgccatgtcttcaatttacttggccggcaaagtggaagagcagcacctgcggactcgtgacatcatcaatgtgtccaacaggtactttaacccaagcggtgagcccctggaattggactcccgcttctgggaactccgggacagcatcgtgcagtgtgagcttctcatgctgagagttctgcgcttccaggtctccttccagcatccacacaagtacctgctccactacctggtttccctccagaactggctgaaccgccacagctggcagcggacccctgttgccgtcaccgcctgggccctgctgcgggacagctaccatggggcgctgtgcctccgcttccaggcccagcacatcgccgtggcggtgctctacctggccctgcaggtctacggagttgaggtgcccgccgaggtcgaggctgagaagccgtggtggcaggtgtttaatgacgaccttaccaagccaatcattgataatattgtgtctgatctcattcagatttataccatggacacagagatcccctaaggtcctggcccaggcctgcccaaagagaagcccaggatggtcggctgcctggggacattgtcaccacgtcgccatgacggctggtccccacaggaccagctgggaggactggttgtgctgctggagaagggctggagaaggcaatggcatgctgccgctttgccagtccctagaagtcgcggtgcaggtgatggtgggagccgcgcctccagcgggcaggccgggagtgtactgtgtgcagctgacccaaggcagccacatctgcgtttgtcctttgagaggactttgactacaatacaggcatgacatcaatgaaaggaaagtcatgaaatcgatgagactgaatccctacggatttcttaaaagccagatttgtagggagaatgaatgtgcaacgtggctgaaatctattttgtgtaataaaaggtgatacaagtca

SEQ ID NO: 456861 - DNA, 1446 bp, Homo sapiens
gaagcattgccatttctctgcgcaggtactttaacccaagcggtgagcccctggaattggactcccgcttctgggaactccgggacagcatcgtgcagtgtgagcttctcatgctgagagttctgcgcttccaggtctccttccagcatccacacaagaactggctgaaccgccacagctggcagcggacccctgttgccgtcaccgcctgggccctgctgcgggacagctaccatggggcgctgtgcctccgcttccaggcccagcacatcgccgtggcggtgctctacctggccctgcaggtctacggagttgaggtgcccgccgaggtcgaggctgagaagccgtggtggcagatttataccatggacacagagatcccctaaggtcctggcccaggcctgcccaaagagaagcccaggatggtcggctgcctggggacattgtcaccacgtcgccatgacggctggtccccacaggaccagctgggaggactggttgtgctgctggagaagggctggagaaggcaatggcatgctgccgctttgccagtccctagaagtcgcggtgcaggtgatggtgggagccgcgcctccagcgggcaggccgggagtgtactgtgtgcagctgacccaaggcagccacatctgcgtttgtcctttgagaggactttgactacaatacaggcatgacatcaatgaaaggaaagtcatgaaatcgatgagactgaatccctacggatttcttaaaagccagatttgtagggagaatgaatgtgcaacgtggctgaaatctattttgtgtaataaaaggtgatacaagtcaatagggacccttggctttgctctgcagcgcatgctgcacatgggggtgtgaggggccctcagagactggttccctcagagtgctctcaggtagagtgtgtcccagccatcaggcggcaggcctggggttagggaggatcacttgcattcagaaaagtgagtcctgatcgaacgtaactaaaagtaatgcgtttttaaatgtcaaggtagccagtctggatggggaggctggagaaactcagagctgtggcccccagcacccctctgactccttgctcaaaagccagtgggtaagaaatagaccagtccaggaggcgctctctaggtcccctttcaggctagacgtacgttcagcacgtggcgtagggccgggggactggtaggtttacacaggagggtgggctccggctcctgcaggtgtgggggcaggggtgatgcaggtcagggcagagtcttgcttgactttacagagcgactatgttcagtgtcttcagaatgaagtatctgagcagatgtcacaggcttccctggtgggcaggcttgccctggctgacctgcccttcatttcgtagaactcccctgtgggttttgatgattaacttctcctaaatgtgggctcctg

SEQ ID NO: 456862 - DNA, 1171 bp, Homo sapiens
ctctctgagtcagaagatcaccaaggcctgttccatctggaatgttctcggccttgtaaagtgtttggcctcaacgggctggaattaaactggctttgcaggagagctactgtcttcctacatagccaagtccctgtgcccctcccctgcccatgaaatgtgattctctgcttagtgacaggtgccttgtttaacatagagggagtctaactggaacctgttttccttcttctttctaggtgtttaatgacgaccttaccaagccaatcattgataatattgtgtctgatctcattcagatttataccatggacacagagatcccctaaggtcgggagtgtactgtgtgcagctgacccaaggcagccacatctgcgtttgtcctttgagaggactttgactacaatacaggcatgacatcaatgaaaggaaagtcatgaaatcgatgagactgaatccctacggatttcttaaaagccagatttgtagggagaatgaatgtgcaacgtggctgaaatctattttgtgtaataaaaggtgatacaagtcaatagggacccttggctttgctctgcagcgcatgctgcacatgggggtgtgaggggccctcagagactggttccctcagagtgctctcaggtagagtgtgtcccagccatcaggcggcaggcctggggttagggaggatcacttgcattcagaaaagtgagtcctgatcgaacgtaactaaaagtaatgcgtttttaaatgtcaaggtagccagtctggatggggaggctggagaaactcagagctgtggcccccagcacccctctgactccttgctcaaaagccagtgggtaagaaatagaccagtccaggaggcgctctctaggtcccctttcaggctagacgtacgttcagcacgtggcgtagggccgggggactggtaggtttacacaggagggtgggctccggctcctgcaggtgtgggggcaggggtgatgcaggtcagggcagagtcttgcttgactttacagagcgactatgttcagtgtcttcagaatgaagtatctgagcagatgtcacaggcttccctggtgggcaggcttgccctggctgacctgcccttcatttcgtagaactcccctgtgggttttgatgattaacttctcctaaatgtgggctcctg

SEQ ID NO: 456863 - DNA, 1902 bp, Homo sapiens
cgggtggggcggcagcgcccgccgcgagcacctccagttctgccggcttctgcgcgccggggccgcctctccttccgccggtgccgcggcgcctcatggaagccccggagggcggcggaggggggcctgcagcgcggggcccggaggggcagccggcgcccgaagccagggtgcacttccgagtggcgaggttcatcatggaggcaggtgtcaagctagggatgcggtccattcccattgccactgcttgcaccatttaccataagttcttttgcgagaccaacctggacgcctatgacccttacctgattgccatgtcttcaatttacttggccggcaaagtggaagagcagcacctgcggactcgtgacatcatcaatgtgtccaacaggtactttaacccaagcggtgagcccctggaattggactcccgcttctgggaactccgggacagcatcgtgcagtgtgagcttctcatgctgagagttctgcgcttccaggtctccttccagcatccacacaagtacctgctccactacctggtttccctccagaactggctgaaccgccacagctggcagcggacccctgttgccgtcaccgcctgggccctgctgcgggacagctaccatggggcgctgtgcctccgcttccaggcccagcacatcgccgtggcggtgctctacctggccctgcaggtctacggagttgaggtgcccgccgaggtcgaggctgagaagccgtggtggcaggtgtttaatgacgaccttaccaagccaatcattgataatattgtgtctgatctcattcagatttataccatggacacagagatcccctaaggtcctggcccaggcctgcccaaagagaagcccaggatggtcggctgcctggggacattgtcaccacgtcgccatgacggctggtccccacaggaccagctgggaggactggttgtgctgctggagaagggctggagaaggcaatggcatgctgccgctttgccagtccctagaagtcgcggtgcaggtgatggtgggagccgcgcctccagcgggcaggccgggagtgtactgtgtgcagctgacccaaggcagccacatctgcgtttgtcctttgagaggactttgactacaatacaggcatgacatcaatgaaaggaaagtcatgaaatcgatgagactgaatccctacggatttcttaaaagccagatttgtagggagaatgaatgtgcaacgtggctgaaatctattttgtgtaataaaaggtgatacaagtcaatagggacccttggctttgctctgcagcgcatgctgcacatgggggtgtgaggggccctcagagactggttccctcagagtgctctcaggtagagtgtgtcccagccatcaggcggcaggcctggggttagggaggatcacttgcattcagaaaagtgagtcctgatcgaacgtaactaaaagtaatgcgtttttaaatgtcaaggtagccagtctggatggggaggctggagaaactcagagctgtggcccccagcacccctctgactccttgctcaaaagccagtgggtaagaaatagaccagtccaggaggcgctctctaggtcccctttcaggctagacgtacgttcagcacgtggcgtagggccgggggactggtaggtttacacaggagggtgggctccggctcctgcaggtgtgggggcaggggtgatgcaggtcagggcagagtcttgcttgactttacagagcgactatgttcagtgtcttcagaatgaagtatctgagcagatgtcacaggcttccctggtgggcaggcttgccctggctgacctgcccttcatttcgtagaactcccctgtgggttttgatgattaacttctcctaaatgtgggctcctg

SEQ ID NO: 456864 - DNA, 1842 bp, Homo sapiens
cgggtggggcggcagcgcccgccgcgagcacctccagttctgccggcttctgcgcgccggggccgcctctccttccgccggtgccgcggcgcctcatggaagccccggagggcggcggaggggggcctgcagcgcggggcccggaggggcagccggcgcccgaagccagggtgcacttccgagtggcgaggttcatcatggaggcaggtgtcaagctagggatgcggtccattcccattgccactgcttgcaccatttaccataagttcttttgcgagaccaacctggacgcctatgacccttacctgattgccatgtcttcaatttacttggccggcaaagtggaagagcagcacctgcggactcgtgacatcatcaatgtgtccaacaggtactttaacccaagcggtgagcccctggaattggactcccgcttctgggaactccgggacagcatcgtgcagtgtgagcttctcatgctgagagttctgcgcttccaggtctccttccagcatccacacaagtacctgctccactacctggtttccctccagaactggctgaaccgccacagctggcagcggacccctgttgccgtcaccgcctgggccctgctgcgggacagctaccatggggcgctgtgcctccgcttccaggcccagcacatcgccgtggcggtgctctacctggccctgcaggtctacggagttgaggtgcccgccgaggtcgaggctgagaagccgtggtggcagatttataccatggacacagagatcccctaaggtcctggcccaggcctgcccaaagagaagcccaggatggtcggctgcctggggacattgtcaccacgtcgccatgacggctggtccccacaggaccagctgggaggactggttgtgctgctggagaagggctggagaaggcaatggcatgctgccgctttgccagtccctagaagtcgcggtgcaggtgatggtgggagccgcgcctccagcgggcaggccgggagtgtactgtgtgcagctgacccaaggcagccacatctgcgtttgtcctttgagaggactttgactacaatacaggcatgacatcaatgaaaggaaagtcatgaaatcgatgagactgaatccctacggatttcttaaaagccagatttgtagggagaatgaatgtgcaacgtggctgaaatctattttgtgtaataaaaggtgatacaagtcaatagggacccttggctttgctctgcagcgcatgctgcacatgggggtgtgaggggccctcagagactggttccctcagagtgctctcaggtagagtgtgtcccagccatcaggcggcaggcctggggttagggaggatcacttgcattcagaaaagtgagtcctgatcgaacgtaactaaaagtaatgcgtttttaaatgtcaaggtagccagtctggatggggaggctggagaaactcagagctgtggcccccagcacccctctgactccttgctcaaaagccagtgggtaagaaatagaccagtccaggaggcgctctctaggtcccctttcaggctagacgtacgttcagcacgtggcgtagggccgggggactggtaggtttacacaggagggtgggctccggctcctgcaggtgtgggggcaggggtgatgcaggtcagggcagagtcttgcttgactttacagagcgactatgttcagtgtcttcagaatgaagtatctgagcagatgtcacaggcttccctggtgggcaggcttgccctggctgacctgcccttcatttcgtagaactcccctgtgggttttgatgattaacttctcctaaatgtgggctcctg

SEQ ID NO: 456865 - DNA, 1441 bp, Homo sapiens
cgggtggggcggcagcgcccgccgcgagcacctccagttctgccggcttctgcgcgccggggccgcctctccttccgccggtgccgcggcgcctcatggaagccccggagggcggcggaggggggcctgcagcgcggggcccggaggggcagccggcgcccgaagccagggtgcacttccgagtggcgaggttcatcatggaggcaggtgtcaagctagggatgcggtccattcccattgccactgcttgcaccatttaccataagttcttttgcgagaccaacctggacgcctatgacccttacctgattgccatgtcttcaatttacttggccggcaaagtggaagagcagcacctgcggactcgtgacatcatcaatgtgtccaacaggtactttaacccaagcggtgagcccctggaattggactcccgcttctgggaactccgggacagcatcgtgcagtgtgagcttctcatgctgagagttctgcgcttccaggtctccttccagcatccacacaagtacctgctccactacctggtttccctccagaactggctgaaccgccacagctggcagcggacccctgttgccgtcaccgcctgggccctgctgcgggacagctaccatggggcgctgtgcctccgcttccaggcccagcacatcgccgtggcggtgctctacctggccctgcaggtctacggagttgaggtgcccgccgaggtcgaggctgagaagccgtggtggcaggtgtttaatgacgaccttaccaagccaatcattgataatattgtgtctgatctcattcagatttataccatggacacagagatcccctaaggtcctggcccaggcctgcccaaagagaagcccaggatggtcggctgcctggggacattgtcaccacgtcgccatgacggctggtccccacaggaccagctgggaggactggttgtgctgctggagaagggctggagaaggcaatggcatgctgccgctttgccagtccctagaagtcgcggtgcaggtgatggtgggagccgcgcctccagcgggcaggcctaccatggggcgctgtgcctccgcttccaggcccagcacatcgccgtggcggtgctctacctggccctgcaggtctacggagttgaggtgcccgccgaggtcgaggctgagaagccgtggtggcagatttataccatggacacagagatcccctaaggtcgggagtgtactgtgtgcagctgacccaaggcagccacatctgcgtttgtcctttgagaggactttgactacaatacaggcatgacatcaatgaaaggaaagtcatgaaatcgatgagactgaatccctacggatttcttaaaagccagatttgtagggagaatgaatgtgcaacgtggctgaaatctattttgtgtaataaaaggtgatacaagtca

SEQ ID NO: 456866 - DNA, 996 bp, Homo sapiens
cgggtggggcggcagcgcccgccgcgagcacctccagttctgccggcttctgcgcgccggggccgcctctccttccgccggtgccgcggcgcctcatggaagccccggagggcggcggaggggggcctgcagcgcggggcccggaggggcagccggcgcccgaagccagggtgcacttccgagtggcgaggttcatcatggaggcaggtgtcaagctagggatgcggtccattcccattgccactgcttgcaccatttaccataagttcttttgcgagaccaacctggacgcctatgacccttacctgattgccatgtcttcaatttacttggccggcaaagtggaagagcagcacctgcggactcgtgacatcatcaatgtgtccaacaggtactttaacccaagcggtgagcccctggaattggactcccgcttctgggaactccgggacagcatcgtgcagtgtgagcttctcatgctgagagttctgcgcttccaggtctccttccagcatccacacaagtacctgctccactacctggtttccctccagaactggctgaaccgccacagctggcagcggacccctgttgccgtcaccgcctgggccctgctgcgggacagctaccatggggcgctgtgcctccgcttccaggcccagcacatcgccgtggcggtgctctacctggccctgcaggtctacggagttgaggtgcccgccgaggtcgaggctgagaagccgtggtggcagatttataccatggacacagagatcccctaaggtcctggcccaggcctgcccaaagagaagccacatctgcgtttgtcctttgagaggactttgactacaatacaggcatgacatcaatgaaaggaaagtcatgaaatcgatgagactgaatccctacggatttcttaaaagccagatttgtagggagaatgaatgtgcaacgtggctgaaatctattttgtgtaataaaaggtgatacaagtca

SEQ ID NO: 456867 - DNA, 1267 bp, Homo sapiens
cgggtggggcggcagcgcccgccgcgagcacctccagttctgccggcttctgcgcgccggggccgcctctccttccgccggtgccgcggcgcctcatggaagccccggagggcggcggaggggggcctgcagcgcggggcccggaggggcagccggcgcccgaagccagggtgcacttccgagtggcgaggttcatcatggaggcaggtgtcaagctagggatgcggtccattcccattgccactgcttgcaccatttaccataagttcttttgcgagaccaacctggacgcctatgacccttacctgattgccatgtcttcaatttacttggccggcaaagtggaagagcagcacctgcggactcgtgacatcatcaatgtgtccaacaggtactttaacccaagcggtgagcccctggaattggactcccgcttctgggaactccgggacagcatcgtgcagtgtgagcttctcatgctgagagttctgcgcttccaggtctccttccagcatccacacaaggtgtttaatgacgaccttaccaagccaatcattgataatattgtgtctgatctcattcagatttataccatggacacagagatcccctaaggtcctggcccaggcctgcccaaagagaagcccaggatggtcggctgcctggggacattgtcaccacgtcgccatgacggctggtccccacaggaccagctgggaggactggttgtgctgctggagaagggctggagaaggcaatggcatgctgccgctttgccagtccctagaagtcgcggtgcaggtgatggtgggagccgcgcctccagcgggcaggcctaccatggggcgctgtgcctccgcttccaggcccagcacatcgccgtggcggtgctctacctggccctgcaggtctacggagttgaggtgcccgccgaggtcgaggctgagaagccgtggtggcaggtgtttaatgacgaccttaccaagccaatcattgataatattgtgtctgatctcattcagatttataccatggacacagagatcccctaaggtcctggcccaggcctgcccaaagagaagcccacatctgcgtttgtcctttgagaggactttgactacaatacaggcatgacatcaatgaaaggaaagtcatgaaatcgatgagactgaatccctacggatttcttaaaagccagatttgtagggagaatgaatgtgcaacgtggctgaaatctattttgtgtaataaaaggtgatacaagtca

SEQ ID NO: 456868 - DNA, 3372 bp, Homo sapiens
ttaatacttctatttcttacaaaacaaccgtataggggttaaagtatcagtgcaaagtcccgttcaaatattgactcagtaatgagctctacaagccagcctttgtggcatgttaaattcaaaacaagcttagcatttttttttttttttggatagaaactggtgggggtggggaaagaaagagggaactgggaagagaaggaggggaacttaaaccttgcttcctgctctgtctttctcagaaaaccaaatatggcatcttccatgaggagcttgttttctgaccacgggaaatatgttgaatctttccggaggtttctcaaccattccacggaacaccagtgcatgcaggaattcatggacaagaagctgccaggcataataggaaggattggagacacaaaatcagaaattaagattctaagcataggcggaggtgcaggtgaaattgatcttcaaattctctccaaagttcaggctcaatacccaggagtttgtatcaacaatgaagttgttgagccaagtgctgaacaaattgccaaatacaaagagcttgtagccaagacatcgaacctcgagaacgtaaagtttgcttggcataaggagacatcatctgaataccaaagtagaatgttggagaaaaaggagcttcaaaagtgggactttattcatatgattcaaatgctgtattatgtaaaagacatcccagctaccctgaaattcttccatagtctcttaggtaccaatgctaagatgctcattattgttgtgtcaggaagcagtggctgggacaagctgtggaaaaagtacggatcacgctttccccaggatgacctctgccagtatatcacatcagatgacctcactcagatgctggacaacctagggcttaagtatgagtgctatgaccttttgtccaccatggatatatctgactgctttattgatggtaatgaaaatggagacctgctttgggattttttgactgaaacctgcaactttaatgccacagcaccacctgatctcagagcagagcttgggaaagatctacaagagcctgaatttagtgctaagaaagaggggaaggttctttttaataatactctgagtttcatagtgattgaggcataactatcaatcacaaaagtatattcaaaaattatattttgaacaactcgaatcactcatttatttccatattaaaatcacaaactcatccattaatgtagataaagcactgtttggatatgagatgtagcaaattccaatacattattggacttccatttggaatcatatgggatactgctggtcttatcctgtccctcctccaggtagagagaccacaagcaggctcaacataacataagctagaaaaattagatgactgaatttctatggcatattgataataaaattcattccatttgctgattgtctgaaattttctagaatactaataaaatacatactatagattctttattagtgaagtatgcactaatcaatactttgaacacaaagcctgtgttactgatttggccgttttgtgaagaaacatttatctttgtacgttcttctattgtgctttctatctaatttttattaatttgtaagagtaagcacctttagaatattaaaaattaattctttatcacatgttgtcatttcttcccattgtgttttctcttgtaattttatctgtgaattaatagctttttgtttgtctttttgatatactgaagttttctattatattcagccagatttttttttaagtctcggcttctgatacattttaaaagaccttctaaaaccaaggttttagaatactaacattttatcaaaataatattatagttttgctttttttaaaaaatgaaatctttactatgtttgaaatttagataagtataaacagtgagaacaaactgtttcccctcaaaataatagccagatgtataaacaaaatttattgaagaacaaagaaacacaaaactaaacctgttctagcttaaaatgcagcttttaccagatttctaggaattgggtaaatgcaaggttctagaaaaccttcaatgcattttgatactttatagtttcttatgtcactctcaagaactcctataagaccaagagtcatctttggactgtaggatttcaggggggttttgaaaacaaatttgatgtttcttatttttaataataacgctctgttatttttgacataaacagtacatttaataattaataaataaatattttaagtatgtaaataattagtactccctgtcacaaacaaaacaaaagtaaggttttactaaacagctcatgagccctcattctgccagtgaggaagccttcaaccccgtgtgatactcactctttcatgcaatagggcttccatgtaatgttgccgtataatcactttaaaaagttaaacgacccatctcaatcacctagtttatccccagggaatacactggcatagagagcctatttacactaataaactaccaagctttgttgttcataataagtaaaatggacttgcattgctctcttttttggacaacttcatcaatgctttttgaattatatgtttcaacaaatgaaacgacagttatccaatcagattcctgaaaatgaacactgaaccgttaatcatactgatatgtactactgacaaaggaaatctgtgaggcacacatgattgatgggtatggggccatgaagaccttgaagagcttcaccagaagtatggaaatcaagactttacagagtcttttgtataaagcacacgtgcaaaaacaaacaaaattagaactaacaatgctattgaaagatacaaaagaattgcagtccatagattggtgtttgtaaatatggcctttttctcgtccttattaaacccttagtatacaaggataaataaattctcacctgcttaattttagtgcaattgaaacacataagcctttttaaagagagaaattcccatgaaaacctactagtcagcaatgggaagttgtataaattcaagggataaacctatccctgttttcttcctgcactgtatgataataccaaaatttgggacagtcacatactaacttttcagatttgttcttgtgtttcagaaaaaagtgctcagcatgaatttggaatgttgttttatgtattgttgtggatctctcagtgtttaacatggtgccttgcatatggtaaatgctaagtaaagcgggatcaatgaattatttccttctcaaacatttatcttataccttgtgtgttcatattattattataaacagagctcaagaaacccaataaagttatgtgttgccagtgtaaaccttaacttatttagga

SEQ ID NO: 456869 - DNA, 1654 bp, Homo sapiens
ttaatacttctatttcttacaaaacaaccgtataggggttaaagtatcagtgcaaagtcccgttcaaatattgactcagtaatgagctctacaagccagcctttgtggcatgttaaattcaaaacaagcttagcatttttttttttttttggatagaaactggtgggggtggggaaagaaagagggaactgggaagagaaggaggggaacttaaaccttgcttcctgctctgtctttctcagaaaaccaaatatggcatcttccatgaggagcttgttttctgaccacgggaaatatgttgaatctttccggaggtttctcaaccattccacggaacaccagtgcatgcaggaattcatggacaagaagctgccaggcataataggaaggattggagacacaaaatcagaaattaagattctaagcataggcggaggtgcaggtgaaattgatcttcaaattctctccaaagttcaggctcaatacccaggagtttgtatcaacaatgaagttgttgagccaagtgctgaacaaattgccaaatacaaagagcttgtagccaagacatcgaacctcgagaacgtaaagtttgcttggcataaggagacatcatctgaataccaaagtagaatgttggagaaaaaggagcttcaaaagtgggactttattcatatgattcaaatgctgtattatgtaaaagacatcccagctaccctgaaattcttccatagtctcttaggtaccaatgctaagatgctcattattgttgtgtcaggaagcagtggctgggacaagctgtggaaaaagtacggatcacgctttccccaggatgacctctgccagtatatcacatcagatgacctcactcagatgctggacaacctagggcttaagtatgagtgctatgaccttttgtccaccatggatatatctgactgctttattgatggtaatgaaaatggagacctgctttgggattttttgactgaaacctgcaactttaatgccacagcaccacctgatctcagagcagagcttgggaaagatctacaagagcctgaatttagtgctaagaaagaggggaaggttctttttaataatactctgagtttcatagtgattgaggcataactatcaatcacaaaagtatattcaaaaattatattttgaacaactcgaatcactcatttatttccatattaaaatcacaaactcatccattaatgtagataaagcactgtttggatatgagatgtagcaaattccaatacattattggacttccatttggaatcatatgggatactgctggtcttatcctgtccctcctccaggtagagagaccacaagcaggctcaacataacataagctagaaaaattagatgactgaatttctatggcatattgataataaaattcattccatttgctgattgtctgaaattttctagaatactaataaaatacatactatagattctttattagtgaagtatgcactaatcaatactttgaacacaaagcctgtgttactgatttggccgttttgtgaagaaacatttatctttgtacgttcttctattgtgctttctatctaatttttattaatttgtaagagtaagcacctttagaatattaaaaattaattcttta

SEQ ID NO: 456870 - DNA, 1448 bp, Homo sapiens
  misc_feature (23)..(23): n is a, c, g, or t
  misc_feature (26)..(26): n is a, c, g, or t
ttggtgtacccgtggatcggccnttntggccgggagaaaaccaaatatggcatcttccatgaggagcttgttttctgaccacgggaaatatgttgaatctttccggaggtttctcaaccattccacggaacaccagtgcatgcaggaattcatggacaagaagctgccaggcataataggaaggattggagacacaaaatcagaaattaagattctaagcataggcggaggtgcaggtgaaattgatcttcaaattctctccaaagttcaggctcaatacccaggagtttgtatcaacaatgaagttgttgagccaagtgctgaacaaattgccaaatacaaagagcttgtagccaagacatcgaacctcgagaacgtaaagtttgcttggcataaggagacatcatctgaataccaaagtagaatgttggagaaaaaggagcttcaaaagtgggactttattcatatgattcaaatgctgtattatgtaaaagacatcccagctaccctgaaattcttccatagtctcttaggtaccaatgctaagatgctcattattgttgtgtcaggaagcagtggctgggacaagctgtggaaaaagtacggatcacgctttccccaggatgacctctgccagtatatcacatcagatgacctcactcagatgctggacaacctagggcttaagtatgagtgctatgaccttttgtccaccatggatatatctgactgctttattgatggtaatgaaaatggagacctgctttgggattttttgactgaaacctgcaactttaatgccacagcaccacctgatctcagagcagagcttgggaaagatctacaagagcctgaatttagtgctaagaaagaggggaaggttctttttaataatactctgagtttcatagtgattgaggcataactatcaatcacaaaagtatattcaaaaattatattttgaacaactcgaatcactcatttatttccatattaaaatcacaaactcatccattaatgtagataaagcactgtttggatatgagatgtagcaaattccaatacattattggacttccatttggaatcatatgggatactgctggtcttatcctgtccctcctccaggtagagagaccacaagcaggctcaacataacataagctagaaaaattagatgactgaatttctatggcatattgataataaaattcattccatttgctgattgtctgaaattttctagaatactaataaaatacatactatagattctttattagtgaagtatgcactaatcaatactttgaacacaaagcctgtgttactgatttggccgttttgtgaagaaacatttatctttgtacgttcttctattgtgctttctatctaatttttattaatttgtaagagtaagcacctttagaatattaaaaattaattcttta

SEQ ID NO: 456871 - DNA, 3110 bp, Homo sapiens
  misc_feature (23)..(23): n is a, c, g, or t
  misc_feature (26)..(26): n is a, c, g, or t
ttggtgtacccgtggatcggccnttntggccgggagaaaaccaaatatggcatcttccatgaggagcttgttttctgaccacgggaaatatgttgaatctttccggaggtttctcaaccattccacggaacaccagtgcatgcaggaattcatggacaagaagctgccaggcataataggaaggattggagacacaaaatcagaaattaagattctaagcataggcggaggtgcaggtgaaattgatcttcaaattctctccaaagttcaggctcaatacccaggagtttgtatcaacaatgaagttgttgagccaagtgctgaacaaattgccaaatacaaagagcttgtagccaagacatcgaacctcgagaacgtaaagtttgcttggcataaggagacatcatctgaataccaaagtagaatgttggagaaaaaggagcttcaaaagtgggactttattcatatgattcaaatgctgtattatgtaaaagacatcccagctaccctgaaattcttccatagtctcttaggtaccaatgctaagatgctcattattgttgtgtcaggaagcagtggctgggacaagctgtggtgacctcactcagatgctggacaacctagggcttaagtatgagtgctatgaccttttgtccaccatggatatatctgactgctttattgatggtaatgaaaatggagacctgctttgggattttttgactgaaacctgcaactttaatgccacagcaccacctgatctcagagcagagcttgggaaagatctacaagagcctgaatttagtgctaagaaagaggggaaggttctttttaataatactctgagtttcatagtgattgaggcataactatcaatcacaaaagtatattcaaaaattatattttgaacaactcgaatcactcatttatttccatattaaaatcacaaactcatccattaatgtagataaagcactgtttggatatgagatgtagcaaattccaatacattattggacttccatttggaatcatatgggatactgctggtcttatcctgtccctcctccaggtagagagaccacaagcaggctcaacataacataagctagaaaaattagatgactgaatttctatggcatattgataataaaattcattccatttgctgattgtctgaaattttctagaatactaataaaatacatactatagattctttattagtgaagtatgcactaatcaatactttgaacacaaagcctgtgttactgatttggccgttttgtgaagaaacatttatctttgtacgttcttctattgtgctttctatctaatttttattaatttgtaagagtaagcacctttagaatattaaaaattaattctttatcacatgttgtcatttcttcccattgtgttttctcttgtaattttatctgtgaattaatagctttttgtttgtctttttgatatactgaagttttctattatattcagccagatttttttttaagtctcggcttctgatacattttaaaagaccttctaaaaccaaggttttagaatactaacattttatcaaaataatattatagttttgctttttttaaaaaatgaaatctttactatgtttgaaatttagataagtataaacagtgagaacaaactgtttcccctcaaaataatagccagatgtataaacaaaatttattgaagaacaaagaaacacaaaactaaacctgttctagcttaaaatgcagcttttaccagatttctaggaattgggtaaatgcaaggttctagaaaaccttcaatgcattttgatactttatagtttcttatgtcactctcaagaactcctataagaccaagagtcatctttggactgtaggatttcaggggggttttgaaaacaaatttgatgtttcttatttttaataataacgctctgttatttttgacataaacagtacatttaataattaataaataaatattttaagtatgtaaataattagtactccctgtcacaaacaaaacaaaagtaaggttttactaaacagctcatgagccctcattctgccagtgaggaagccttcaaccccgtgtgatactcactctttcatgcaatagggcttccatgtaatgttgccgtataatcactttaaaaagttaaacgacccatctcaatcacctagtttatccccagggaatacactggcatagagagcctatttacactaataaactaccaagctttgttgttcataataagtaaaatggacttgcattgctctcttttttggacaacttcatcaatgctttttgaattatatgtttcaacaaatgaaacgacagttatccaatcagattcctgaaaatgaacactgaaccgttaatcatactgatatgtactactgacaaaggaaatctgtgaggcacacatgattgatgggtatggggccatgaagaccttgaagagcttcaccagaagtatggaaatcaagactttacagagtcttttgtataaagcacacgtgcaaaaacaaacaaaattagaactaacaatgctattgaaagatacaaaagaattgcagtccatagattggtgtttgtaaatatggcctttttctcgtccttattaaacccttagtatacaaggataaataaattctcacctgcttaattttagtgcaattgaaacacataagcctttttaaagagagaaattcccatgaaaacctactagtcagcaatgggaagttgtataaattcaagggataaacctatccctgttttcttcctgcactgtatgataataccaaaatttgggacagtcacatactaacttttcagatttgttcttgtgtttcagaaaaaagtgctcagcatgaatttggaatgttgttttatgtattgttgtggatctctcagtgtttaacatggtgccttgcatatggtaaatgctaagtaaagcgggatcaatgaattatttccttctcaaacatttatcttataccttgtgtgttcatattattattataaacagagctcaagaaacccaataaagttatgtgttgccagtgtaaaccttaacttatttagga

SEQ ID NO: 456872 - DNA, 531 bp, Homo sapiens
  misc_feature (23)..(23): n is a, c, g, or t
  misc_feature (26)..(26): n is a, c, g, or t
ttggtgtacccgtggatcggccnttntggccgggagaaaaccaaatatggcatcttccatgaggagcttgttttctgaccacgggaaatatgttgaatctttccggaggtttctcaaccattccacggaacaccagtgcatgcaggaattcatggacaagaagctgccaggcataataggaagataccagaattgctgttaacaaataaaatactggccagatgtgttggttcacgcctgtaatcctagcacttcgggaggctgaggcgggaggattacttgagcctaggagtttgagaccagcctgggcaacatagcaagatcccatctctacaaaaaagtgaaaaagttagctgaacaaggcggcatgcacatgctactccagacgctgaagtgggaagatcacttaagtccgagagatcgaggcttcagtgagatatggctgagacactgctctcagcctggatgacagagtgagaacctgtctcaaacaagagaaaaaaataaatcaaatgctattcaaaattctca

SEQ ID NO: 456873 - DNA, 907 bp, Homo sapiens
  misc_feature (23)..(23): n is a, c, g, or t
  misc_feature (26)..(26): n is a, c, g, or t
ttggtgtacccgtggatcggccnttntggccgggagaaaaccaaatatggcatcttccatgaggagcttgttttctgaccacgggaaatatgttgaatctttccggaggtttctcaaccattccacggaacaccagtgcatgcaggaattcatggacaagaagctgccaggcataataggaagataccagaattgctgttaacaaataaaatactggccagatgtgttggttcacgcctgtaatcctagcacttcgggaggctgaggcgggaggattacttgagcctaggagtttgagaccagcctgggcaacatagcaagatcccatctctacaaaaaagtgaaaaagttagctgaacaaggcggcatgcacatgctactccagacgctgaagtgggaagatcacttaagtccgagagatcgaggcttcagtgagatatggctgagacactgctctcagcctggatgacagagtgagaacctgtctcaaacaagagaaaaaaataaatcaaatgctattcaaaattctcaaaaaaaaatataaaaaaaacaacttttgccgggagcggccgcgagccacaaaaaagcttaccaaacaccactcgggtgtgggcgcggggccccatatagtaaccgcacacttgcgccaacgctgtcccaaaggaaccggggccacgcacagcgcgtcggttctccccaaaaaaaccgcggcgccacgagcgtgttgacaacccaaggcgtctggggcactggcccaccacggcccaggacctattatcacgcagcgagtgagaaaagaaatcaagacgctcactatagacacagacagctgaaatagaagagacacatagcagcaccaacaaaagcagacaacatacgcaacacacacaagacacacacaacgacc

SEQ ID NO: 456874 - DNA, 298 bp, Homo sapiens
agattctaagcataggcggaggtgcaggtatgagtaatatatttttaaagttcatatttcactttaaccattatgctgtgtgatgacaatattgttcattttttaggaagactttttttttttgcttttggaagagatcggcttattaaaactagcaatattacttcaactaacattaatgcccccatagatttacagggtttaggacattagccttcattactatctctattgtgaataagtgatgtgacttgttcttttgatagatgaaaaatcaaataggataactttaaggata

SEQ ID NO: 456875 - DNA, 3318 bp, Homo sapiens
ttaatacttctatttcttacaaaacaaccgtataggggttaaagtatcagtgcaaagtcccgttcaaatattgactcagtaatgagctctacaagccagcctttgtggcatgttaaattcaaaacaagcttagcatttttttttttttttggatagaaactggtgggggtggggaaagaaagagggaactgggaagagaaggaggggaacttaaaccttgcttcctgctctgtctttctcagaaaaccaaatatggcatcttccatgaggagcttgttttctgaccacgggaaatatgttgaatctttccggaggtttctcaaccattccacggaacaccagtgcatgcaggaattcatggacaagaagctgccaggcataataggaaggattggagacacaaaatcagaaattaagattctaagcataggcggaggtgcaggtgaaattgatcttcaaattctctccaaagttcaggctcaatacccaggagtttgtatcaacaatgaagttgttgagccaagtgctgaacaaattgccaaatacaaagagcttgtagccaagacatcgaacctcgagaacgtaaagtttgcttggcataaggagacatcatctgaataccaaagtagaatgttggagaaaaaggagcttcaaaagtgggactttattcatatgattcaaatgctgtattatgtaaaagacatcccagctaccctgaaattcttccatagtctcttaggtaccaatgctaagatgctcattattgttgtgtcaggaagcagtggctgggacaagctgtggaaaaagtacggatcacgctttccccaggatgacctctgccagtatatcacatcagatgacctcactcagatgctggacaacctagggcttaagtatgagtgctatgaccttttgtccaccatggatatatctgactgctttattgatggtaatgaaaatggagacctgctttgggattttttgactgaaacctgcaactttaatgccacagcaccacctgatctcagagcagagcttgggaaagatctacaagagcctgaatttagtgctaagaaagaggggaaggttctttttaataatactctgagtttcatagtgattgaggcataactatcaatcacaaaagtatattcaaaaattatattttgaacaactcgaatcactcatttatttccatattaaaatcacaaactcatccattaatgtagataaagcactgtttggatatgagatgtagcaaattccaatacattattggacttccatttggaatcatatgggatactgctggtcttatcctgtccctcctccaggtagagagaccacaagcaggctcaacataacataagctagaaaaattagatgactgaatttctatggcatattgataataaaattcattccatttgctgattgtctgaaattttctagaatactaataaaacaaagcctgtgttactgatttggccgttttgtgaagaaacatttatctttgtacgttcttctattgtgctttctatctaatttttattaatttgtaagagtaagcacctttagaatattaaaaattaattctttatcacatgttgtcatttcttcccattgtgttttctcttgtaattttatctgtgaattaatagctttttgtttgtctttttgatatactgaagttttctattatattcagccagatttttttttaagtctcggcttctgatacattttaaaagaccttctaaaaccaaggttttagaatactaacattttatcaaaataatattatagttttgctttttttaaaaaatgaaatctttactatgtttgaaatttagataagtataaacagtgagaacaaactgtttcccctcaaaataatagccagatgtataaacaaaatttattgaagaacaaagaaacacaaaactaaacctgttctagcttaaaatgcagcttttaccagatttctaggaattgggtaaatgcaaggttctagaaaaccttcaatgcattttgatactttatagtttcttatgtcactctcaagaactcctataagaccaagagtcatctttggactgtaggatttcaggggggttttgaaaacaaatttgatgtttcttatttttaataataacgctctgttatttttgacataaacagtacatttaataattaataaataaatattttaagtatgtaaataattagtactccctgtcacaaacaaaacaaaagtaaggttttactaaacagctcatgagccctcattctgccagtgaggaagccttcaaccccgtgtgatactcactctttcatgcaatagggcttccatgtaatgttgccgtataatcactttaaaaagttaaacgacccatctcaatcacctagtttatccccagggaatacactggcatagagagcctatttacactaataaactaccaagctttgttgttcataataagtaaaatggacttgcattgctctcttttttggacaacttcatcaatgctttttgaattatatgtttcaacaaatgaaacgacagttatccaatcagattcctgaaaatgaacactgaaccgttaatcatactgatatgtactactgacaaaggaaatctgtgaggcacacatgattgatgggtatggggccatgaagaccttgaagagcttcaccagaagtatggaaatcaagactttacagagtcttttgtataaagcacacgtgcaaaaacaaacaaaattagaactaacaatgctattgaaagatacaaaagaattgcagtccatagattggtgtttgtaaatatggcctttttctcgtccttattaaacccttagtatacaaggataaataaattctcacctgcttaattttagtgcaattgaaacacataagcctttttaaagagagaaattcccatgaaaacctactagtcagcaatgggaagttgtataaattcaagggataaacctatccctgttttcttcctgcactgtatgataataccaaaatttgggacagtcacatactaacttttcagatttgttcttgtgtttcagaaaaaagtgctcagcatgaatttggaatgttgttttatgtattgttgtggatctctcagtgtttaacatggtgccttgcatatggtaaatgctaagtaaagcgggatcaatgaattatttccttctcaaacatttatcttataccttgtgtgttcatattattattataaacagagctcaagaaacccaataaagttatgtgttgccagtgtaaaccttaacttatttagga

SEQ ID NO: 456876 - DNA, 3319 bp, Homo sapiens
ttaatacttctatttcttacaaaacaaccgtataggggttaaagtatcagtgcaaagtcccgttcaaatattgactcagtaatgagctctacaagccagcctttgtggcatgttaaattcaaaacaagcttagcatttttttttttttttggatagaaactggtgggggtggggaaagaaagagggaactgggaagagaaggaggggaacttaaaccttgcttcctgctctgtctttctcagaaaaccaaatatggcatcttccatgaggagcttgttttctgaccacgggaaatatgttgaatctttccggaggtttctcaaccattccacggaacaccagtgcatgcaggaattcatggacaagaagctgccaggcataataggaaggattggagacacaaaatcagaaattaagattctaagcataggcggaggtgcaggtgaaattgatcttcaaattctctccaaagttcaggctcaatacccaggagtttgtatcaacaatgaagttgttgagccaagtgctgaacaaattgccaaatacaaagagcttgtagccaagacatcgaacctcgagaacgtaaagtttgcttggcataaggagacatcatctgaataccaaagtagaatgttggagaaaaaggagcttcaaaagtgggactttattcatatgattcaaatgctgtattatgtaaaagacatcccagctaccctgaaattcttccatagtctcttaggtaccaatgctaagatgctcattattgttgtgtcaggaagcagtggctgggacaagctgtggaaaaagtacggatcacgctttccccaggatgacctctgccagtatatcacatcagatgacctcactcagatgctggacaacctagggcttaagtatgagtgctatgaccttttgtccaccatggatatatctgactgctttattgatggtaatgaaagcaccacctgatctcagagcagagcttgggaaagatctacaagagcctgaatttagtgctaagaaagaggggaaggttctttttaataatactctgagtttcatagtgattgaggcataactatcaatcacaaaagtatattcaaaaattatattttgaacaactcgaatcactcatttatttccatattaaaatcacaaactcatccattaatgtagataaagcactgtttggatatgagatgtagcaaattccaatacattattggacttccatttggaatcatatgggatactgctggtcttatcctgtccctcctccaggtagagagaccacaagcaggctcaacataacataagctagaaaaattagatgactgaatttctatggcatattgataataaaattcattccatttgctgattgtctgaaattttctagaatactaataaaatacatactatagattctttattagtgaagtatgcactaatcaatactttgaacacaaagcctgtgttactgatttggccgttttgtgaagaaacatttatctttgtacgttcttctattgtgctttctatctaatttttattaatttgtaagagtaagcacctttagaatattaaaaattaattctttatcacatgttgtcatttcttcccattgtgttttctcttgtaattttatctgtgaattaatagctttttgtttgtctttttgatatactgaagttttctattatattcagccagatttttttttaagtctcggcttctgatacattttaaaagaccttctaaaaccaaggttttagaatactaacattttatcaaaataatattatagttttgctttttttaaaaaatgaaatctttactatgtttgaaatttagataagtataaacagtgagaacaaactgtttcccctcaaaataatagccagatgtataaacaaaatttattgaagaacaaagaaacacaaaactaaacctgttctagcttaaaatgcagcttttaccagatttctaggaattgggtaaatgcaaggttctagaaaaccttcaatgcattttgatactttatagtttcttatgtcactctcaagaactcctataagaccaagagtcatctttggactgtaggatttcaggggggttttgaaaacaaatttgatgtttcttatttttaataataacgctctgttatttttgacataaacagtacatttaataattaataaataaatattttaagtatgtaaataattagtactccctgtcacaaacaaaacaaaagtaaggttttactaaacagctcatgagccctcattctgccagtgaggaagccttcaaccccgtgtgatactcactctttcatgcaatagggcttccatgtaatgttgccgtataatcactttaaaaagttaaacgacccatctcaatcacctagtttatccccagggaatacactggcatagagagcctatttacactaataaactaccaagctttgttgttcataataagtaaaatggacttgcattgctctcttttttggacaacttcatcaatgctttttgaattatatgtttcaacaaatgaaacgacagttatccaatcagattcctgaaaatgaacactgaaccgttaatcatactgatatgtactactgacaaaggaaatctgtgaggcacacatgattgatgggtatggggccatgaagaccttgaagagcttcaccagaagtatggaaatcaagactttacagagtcttttgtataaagcacacgtgcaaaaacaaacaaaattagaactaacaatgctattgaaagatacaaaagaattgcagtccatagattggtgtttgtaaatatggcctttttctcgtccttattaaacccttagtatacaaggataaataaattctcacctgcttaattttagtgcaattgaaacacataagcctttttaaagagagaaattcccatgaaaacctactagtcagcaatgggaagttgtataaattcaagggataaacctatccctgttttcttcctgcactgtatgataataccaaaatttgggacagtcacatactaacttttcagatttgttcttgtgtttcagaaaaaagtgctcagcatgaatttggaatgttgttttatgtattgttgtggatctctcagtgtttaacatggtgccttgcatatggtaaatgctaagtaaagcgggatcaatgaattatttccttctcaaacatttatcttataccttgtgtgttcatattattattataaacagagctcaagaaacccaataaagttatgtgttgccagtgtaaaccttaacttatttagga

SEQ ID NO: 456877 - DNA, 1074 bp, Homo sapiens
  misc_feature (958)..(958): n is a, c, g, or t
  misc_feature (963)..(963): n is a, c, g, or t
  misc_feature (973)..(973): n is a, c, g, or t
  misc_feature (981)..(982): n is a, c, g, or t
ttaatacttctatttcttacaaaacaaccgtataggggttaaagtatcagtgcaaagtcccgttcaaatattgactcagtaatgagctctacaagccagcctttgtggcatgttaaattcaaaacaagcttagcatttttttttttttttggatagaaactggtgggggtggggaaagaaagagggaactgggaagagaaggaggggaacttaaaccttgcttcctgctctgtctttctcagaaaaccaaatatggcatcttccatgaggagcttgttttctgaccacgggaaatatgttgaatctttccggaggtttctcaaccattccacggaacaccagtgcatgcaggaattcatggacaagaagctgccaggcataataggaaggattggagacacaaaatcagaaattaagattctaagcataggcggaggtgcaggtgaaattgatcttcaaattctctccaaagttcaggctcaatacccaggagtttgtatcaacaatgaagttgttgagccaagtgctgaacaaattgccaaatacaaagagcttgtagccaagacatcgaacctcgagaacgtaaagtttgcttggcataaggagacatcatctgaataccaaagtagaatgttggagaaaaaggagcttcaaaagtgggactttattcatatgattcaaatgctgtattatgtaaaagacatcccagctaccctgaaattcttccatagtctcttaggtaccaatgctaagatgctcattattgttgtgtcaggaagcagtggctgggacaagctgtggaaaaagtacggatcacgctttccccaggatgacctctgccagtatatcacatcagatgacctcactcagatgctggacaacctagggcttaagtatgagtgctatgaccttttgtccaccatggatatatctgactgctttattgatggtaatgaantgggnactggttggntttttggnngaactggatttatgtgcgccggtttaagcaagttgggaaatttaaagggtttgtgaaagggggggttaaacgggtggggggggtcaagtttt

SEQ ID NO: 456878 - DNA, 454 bp, Homo sapiens
  misc_feature (23)..(23): n is a, c, g, or t
  misc_feature (26)..(26): n is a, c, g, or t
ttggtgtacccgtggatcggccnttntggccgggagaaaaccaaatatggcatcttccatgaggagcttgttttctgaccacgggaaatatgttgaatctttccggaggtttctcaaccattccacggaacaccagtgcatgcaggaattcatggacaagaagctgccaggcataataggaaggattggagacacaaaatcagaaattaagattctaagcataggcggaggtgcaggcaagaggattatatacatctttttgttggccggacgtggttactcacgcctgtaatcccagcactttgggaggccaaggtaggcagatcacttgaggtcaagagttcgagaccagcctggccaatatggtgaaaccccgtctctactaaaaatatgaaaattagcctggcatggtggtacgtgtctgtaatcccagctacttgggagggtgaggcag

SEQ ID NO: 456879 - DNA, 763 bp, Homo sapiens
gcaaccctcctgctcaagccatcttcccaccttagcctcccagagtgttgagattacaggcatgagccaccacacgctgcctattttttttatttttacgaatttttttgttgttgcccaggctcaagcgatccacccacctttgcctcccaaagtgctgggattatgtgtgtgagccacagctcctggcctctttttttgtttttcctatcccaagttgtattactagttttggggagtttgcagacaattgaatattctataggctgtgttgcagctttagatggatcgacctgtcatgtttttgaggttatccaggctgtatatctctggagagaagggaatggcaaagagtgggagtctgagtcaagtttggttttttttttttaagagacaaggtctctgtaatccaggctgcagtacactggcatgaccatggctcactatagacttgggctcagccaatcttcctgcctcagcctcctgagtagctgggtttggttttccccagggccatatgtcagcttatttaccctcctcacttggtgtctcccagcctgccagcccatgctgttcatccagtatctgctgaatggtgattacctattaagtggaactaacacaaaattgcttatctaaaagcaattattggtgattatttccttgcagtggcccactagagggcgccattgttaagtgtaattccagtaggtgttttgtgttttttttttttaatggaataaactgaaatctttacatggta

SEQ ID NO: 456880 - DNA, 2460 bp, Homo sapiens
aagacagttttggtaaaaagtcacacgccacacaacgtgagattttattattccacgggtgcttccttgccaatagtagacatggcagctcggctcccttcccttcgggttcgccttattgttgccaattgtaaacatggcctctaggccgtgagttctcattggcagctgctctgagtccccgcccttccccgcccctccgaacgcggcctggagttgtggagtcggatatcgcagctcccgactgagctgcgcctgcgcaactcattggcgccaagatggcgatggagatgaggcttccagtggctcgcaagcctcttagcgagagactgggccgcgacactaagaaacatctagtggtgccgggggatacaatcactacggacacaggattcatgcggggccatggaacgtatatgggagaagagaagctcattgcatctgttgctggctctgtggagagagtaaacaagttgatctgtgtgaaagctttgaaaaccagatacattggtgaagtaggagacatcgtagtgggacgaatcacagaggttcaacagaagaggtggaaggtggagaccaactccaggctggattcggtcttgctgctctcgtccatgaaccttcctggaggagagctgaggagaagatctgcagaagatgagcttgcaatgagaggtttcttacaggaaggggaccttatcagtgctgaggtccaggcagtgttctctgacggagctgtctctttgcacacgaggagcctgaaatatggaaaactaggtcagggggttttggtccaggtttccccctccctggtgaaacggcagaagacccactttcatgatttgccatgtggtgcctcagtgattctcggtaacaacggcttcatctggatttacccaacacctgagcacaaagaagaggaagcagggggcttcattgcaaacctggagcctgtctctcttgctgatcgagaggtgatatcccggcttcggaactgcatcatctcgctggtaactcagaggatgatgctgtatgataccagcatcctgtactgctatgaagcatcccttccacatcagatcaaagacatcttaaagccagaaataatggaggagattgtgatggaaacacgccagaggcttttggaacaggagggataaggaggtgctccagaagcacgggactgtggaccttgcaggagtgaagactgtgatgtgtggtccccatatgtggctcagcaaagactcgagagatcatccctttgtctgcattgacggccctgtgacggcctccagcccacaggcctgctttctcctgtcctaacaccaagcctgggtggcagatgaacagtgcttccttgggttgccagctgagtcccggtattagggaatagtttcagctctttcaaagtgcacagtgttacagtcgaatgggctcccatcctggaataatatggagaatcctttgtcttccactcactgtcattcacaaggcacagtgccccatgaaattgccccaatagaaaacatggcatccctgacctccaaatggtctgttttggcctccattcctatatcctttaaatgactgagaatgcagctggtaaagttggaagaataaagttaaccaagcaggccaggcacggtggctcacgcctataatcccagcacttagggaggccaaggcgggcagatcacctgaggtcaatagttcgagaccagcctggccaacaaggtgaaaccccatctctactaaaaatacaaaaaattagccaggtgtggtggtgtgcacctgtagtcccagctatttgggaggctgaggtgggagaatcacttgaacctgggaggcggaggttgcagtgagctgaaatcgcgtaccacactccagcctgggtgacagagcgagactgtgtttcaaagaaaaaaaaaaacaagcagccttttgcttggttggaatctgattttctgttgcgtgttccttgtagccatagatgtgattatgtccacaccgggctgccttaatctgtcctgcttggagagtgacttgtaagatgctgaattattcatgataatacagtgaatgttctgggtccatgtactcagataaacatgaagaaaataagcaaagaaaaatggagactgggaaagcaaagctgttttcatcctataattgaagtagtgtggagcattaacttgtggatgattcagagttaaaagataaaaagacgccagagttctcgctgaagaatgtgagaattcctgtgcattgttttttctgatgactatctaaaaatggtgccctgatgtaggtttgggggaacattcttaaaaacaagggtgctatgtgcctgtaatccagcacttgggaagctgagtgggcagatcacctgaggtcaggagttcaagaccagcccggccaatacagtgaaacctcgtctttaccaaaaatacaaaaattagc

SEQ ID NO: 456881 - DNA, 2186 bp, Homo sapiens
ctggcgatttcattcatgggacagtcattccacttgtagttacatgaaaaaggcattcattgcatttggccgttgtgtggcttctgatgtaaatatgtggcttgttcgatttcagattactggttcatgtttttttttttttgagatggagtctcgctctgtcgcccaggctggagtgcagtggcatgatcttggctcactgcaacctccacctcccaggttcaagcgattctcctgcctcagcctcccaagtagctgggattacaggcacccgccaccacgcccagctaatttttgtatttttagtagagatggggtttcattatattggtcaggctggtctcaaactcctgacctcaagtgatccaccagcttcggcctcccaaagtgctgggattacaggcgtgagccaccacatctggccttactggttatttatgatatgacacatgaacatggagcatgtgtccaggtgtggaacttggcttataggttcaacagaagaggtggaaggtggagaccaactccaggctggattcggtcttgctgctctcgtccatgaaccttcctggaggagagctggtaagggctacagctggggccatggactagggcccagtgggctggggggagccgtgggaccctttgttccaccagaggactttgatttacactgaggttgcccctttgactcctgtttgtctgctgtgaagtttgctgcctagatgtgtatgtagacttttcaccctgtccaggtctcccgaaagagggagcagttggcatatggtaggatcagaaacatccatggggtgggatcccaacagagagttggggagagaagcccttagatgctggttgttaacagttttcctttttggatataacagccttgcatagtgaagatgttccttgaaaagttgtctttacattaggtttttgtgaattgaaaggcatttcattcaaccatgtgtggaatgtggttgctggcattccagacaaccacagtaactaagccacagccttttgtaaaatgccatggttcaccttgatcttcagtccagcgtgtatttacagagaggcttactgtgccaagctctgtgccgagtgccaagcacgattgagttccccagcaggggatataagataactgacctagtccctggcagtagaagaataaataagctgtggttatacaaaaggaaatttcagtgagagaagcttgtaggaaagacaggcattggagttgatcctggaaggatggagagactttgaatgactagttcagggaatctgagataaagggaaatgtatgagcagagatatatccaagcaggagttagtctggtcctgctggaccacagagggctgtcatggaagatgactatggaaatgttggctaggtgagattgggaggggtctgaatgttcctcagagaagggagggaaagaggaagaggagctgtggaaaagtcttttgagatggaaagtcgtgattatcactgattcccctcaagtggcttgggttacctactcttgctatagttctcagtgcttgaatattgtggttggcctcaaacatctcaaaaggaagtgaaagagaagtgatggagacctttctgaggatctggcttaagtaatgtcatttctttgtgtatttcagaggagaagatctgcagaagatgagcttgcaatgagaggtttcttacaggaaggggaccttatcagtgtatcctgcgctttgcactccagcctcttgatgcttttctgtgggactgggaaatgggccttccattgtatgtctctgacggaagaaccatgtcatccttgcagggatccgagtcttagaccaagtgtcgggctctgctgcatcctttctcagtctccttaattcaggctgactccccagctcttgttgggacctgctgctaagtcatttctttgggtcttgtaacttacggtggcctgtgctttagactaggcttttgttaatggtgttaacttttagcgcagggagtggagaaggtgttgttcacgtcaagatattaatgacaggccgagtgtggtgactcatgcctgtaatcccagcgctttggaaggccaaggagggaggactgcttgagcctaagagttcaagaccagcctgggcaacatagcaagacccccctctctacaaaaaaattaaaaaag

SEQ ID NO: 456882 - DNA, 1235 bp, Homo sapiens
caccaatttgaatatacttaggatgtatattctgtagtctccttttcattcatcccgccaatcttgcagtgacctagcttcgtgatatatttctttagctaggtcctaggtcagggggttttggtccaggtttccccctccctggtgaaacggcagaagacccactttcatgatttgccatgtggtgcctcagtgattctcggtaacaacggcttcatctggatttacccaacacctgagcacaaagaagaggaagcagggggcttcattgcaaacctggagcctgtctctcttgctgatcgagaggtgatatcccggcttcggaactgcatcatctcgctggtaactcagaggatgatgctgtatgataccagcatcctgtactgctatgaagcatcccttccacatcagatcaaagacatcttaaagccagaaataatggaggagattgtgatggaaacacgccagaggcttttggaacaggagggataaggaggtgctccagaagcacgggactgtggaccttgcaggagtgaagactgtgatgtgtggtccccatatgtggctcagcaaagactcgagagatcatccctttgtctgcattgacggccctgtgacggcctccagcccacaggcctgctttctcctgtcctaacaccaagcctgggtgacagagcgagactgtgtttcaaagaaaaaaaaaaacaagcagccttttgcttggttggaatctgattttctgttgcgtgttccttgtagccatagatgtgattatgtccacaccgggctgccttaatctgtcctgcttggagagtgacttgtaagatgctgaattattcatgataatacagtgaatgttctgggtccatgtactcagataaacatgaagaaaataagcaaagaaaaatggagactgggaaagcaaagctgttttcatcctataattgaagtagtgtggagcattaacttgtggatgattcagagttaaaagataaaaagacgccagagttctcgctgaagaatgtgagaattcctgtgcattgttttttctgatgactatctaaaaatggtgccctgatgtaggtttgggggaacattcttaaaaacaagggtgctatgtgcctgtaatccagcacttgggaagctgagtgggcagatcacctgaggtcaggagttcaagaccagcccggccaatacagtgaaacctcgtctttaccaaaaatacaaaaattagc

SEQ ID NO: 456883 - DNA, 714 bp, Homo sapiens
gttgatttggagttccagggtgatactgtctgagtcataaatgatttatttgtgaatttctgtggctggtcacgtattttggtcctgtttgtatttcccttcccctctctgtgtctccttatagcctgtctctcttgctgatcgagaggtgatatcccggcttcggaactgcatcatctcgctggtaactcagaggatgatgctgtatgataccagcatcctgtactgctatgaagcatcccttccacatcagatcaaagacatcttaaagccagaaataatggaggagattgtgatggaaacacgccagaggcttttggaacaggagggataaggaggtgctccagaagcacgggactgtggaccttgcaggagtgaagactgtgatgtgtggtccccatatgtggctcagcaaagactcgagagatcatccctttgtctgcattgacggccctgtgacggcctccagcccacaggcctgctttctcctgtcctaacaccaagcctgggtggcagatgaacagtgcttccttgggttgccagctgagtcccggtattagggaatagtttcagctctttcaaagtgcacagtgttacagtcgaatgggctcccatcctggaataatatggagaatcctttgtcttccactcactgtcattcacaaggcacagtgccccatgaaattgccccaatagaaaacatggcatccctga

SEQ ID NO: 456884 - DNA, 894 bp, Homo sapiens
ggagtgcagtggcgcgatctcggctcactgcaacctccgcctcctgggtttaagcgattctcctgcctaagcctcccgagtagctgggattacaggcacgtgccaccacgcccaactaatttttgtatttttagtagaggtggcattctaccatgttggccaggatggttttgatttcctgaccttgtgatccccccgcctcagcctgccaaagtgctgggattacaggcgtgagccactgagcccagctatagatgtcttaacatcattgttttctgttcttttgttccgggtaataataaggagctgaggacagctgaggaagggcttggctgacaaaatgccttccgacagagccctaactactccacgtaaacctaggacagtctcaatggtagtaactttgaacactgcatttgataactttcaaatacaacttggctctttttcattaaatggtatgcttctctataacaacacaataaacaacttcttacctcactttctttttttgagacagggtctcactctgtcacccaggctggagtggggtggcatggatcacagatcactggagcctctacctcccaggctcaagtgaacctatcttagcctcccgagtagctgggtccacaggcatgtgacgtaccaccatgcctggctttttttttttttttttttttttgagacagggtcttgctctgtcacctaggctggactgcagtggcacaatcacgtctcaacctcctggtctcaaccagtttccaacttcagccttctgagtagctgggactacaggtgctgagccaccacatccagctaattgtttttgttttttgtttttcggcagagatgaagtctcactatgttgcccaggctggtcttgaactcctg

SEQ ID NO: 456885 - DNA, 740 bp, Homo sapiens
  misc_feature (61)..(61): n is a, c, g, or t
  misc_feature (117)..(117): n is a, c, g, or t
tttaagacttttgcatcttcccaaccccttaagccctggccccctgaggttccctttccgnctctctccttttaatttttttaattttaattttaattttgagacagagcctcgctntgttacccagggtgggttgcagtgagctgaaatcgcgtaccacactccagcctgggtgacagagcgagactgtgtttcaaagaaaaaaaaaaacaagcagccttttgcttggttggaatctgattttctgttgcgtgttccttgtagccatagatgtgattatgtccacaccgggctgccttaatctgtcctgcttggagagtgacttgtaagatgctgaattattcatgataatacagtgaatgttctgggtccatgtactcagataaacatgaagaaaataagcaaagaaaaatggagactgggaaagcaaagctgttttcatcctataattgaagtagtgtggagcattaacttgtggatgattcagagttaaaagataaaaagacgccagagttctcgctgaagaatgtgagaattcctgtgcattgttttttctgatgactatctaaaaatggtgccctgatgtaggtttgggggaacattcttaaaaacaagggtgctatgtgcctgtaatccagcacttgggaagctgagtgggcagatcacctgaggtcaggagttcaagaccagcccggccaatacagtgaaacctcgtctttaccaaaaatacaaaaattagc

SEQ ID NO: 456886 - DNA, 788 bp, Homo sapiens
ctccaactgtgggctgggaggtgcagctgtctctcttcctccaggggcgctgcagctcagcactggggctgaggctgtcctgggaacaaaggcaggctgggtctggttaaacagcccttagacaaacgtccaatcagtccagtggatgttattgctggcaaagcttgctctgtcatctgagcctctaaatggaatttcactgcttttcttgtacgaggttgcattattgaagctatttactattttaaggagagcatacttcctaaaacaaattaggatttactagtctcttagctttatctgggtgaacgtttttattttctgagtggaacaaaaacctcttcccttaatggagtggctgcagacagccacgttgatgtacatggagtaggcagaggactgctgcagtatgctgactttcacaaccctgggtcctgcggactcttccttggcaggacgtggacttgagctgtcctgccaggaccagacatggatttgcacccagctccacccatctccttacctacccagaggcacacatctcacaggcaagatgagtgtttggggttcaggtatgagctagggtcatggaacaacgcagtgctcctgggccagcaggaggctccagctcacttcctcattggcttcagcttctctaatgtctggcacatgagttctggcttagagtgcaaggaagactgcaaagggaaatgacagagaagagtattgaaggtcaccttctgctgggatgtatgaatagcctctgagtcccaaagcgttctctgcaa

SEQ ID NO: 456887 - DNA, 571 bp, Homo sapiens
ctccaactgtgggctgggaggtgcagctgtctctcttcctccaggggcgctgcagctcagcactggggctgaggctgtcctgggaacaaaggcaggctgggtctggttaaacagcccttagacaaacgtccaatcagtccagtggatgttattgctggcaaagcttgctctgtcatctgagcctctaaatggaatttcactgcttttcttgtacgaggttgcattattgaagctatttactattttaaggagagcatacttcctaaaacaaattaggatttactagtctcttagctttattgggtttggttttccccagggccatatgtcagcttatttaccctcctcacttggtgtctcccagcctgccagcccatgctgttcatccagtatctgctgaatggtgattacctattaagtggaactaacacaaaattgcttatctaaaagcaattattggtgattatttccttgcagtggcccactagagggcgccattgttaagtgtaattccagtaggtgttttgtgttttttttttttaatggaataaactgaaatctttacatggta
